United States Patent 7,868,149 (PLANT GENOME SEQUENCE AND USES THEREOF) - sequence listing, part 122

SEQ ID NO: 67973 - DNA, 2340 bp, Oryza sativa
cgacgtggttgggcgtgtcttcctgaagtagagtatctagaagggtgatcgctgctaccgcgttctgctgtggggtgcgaaaaaccgctgtcccctcaacgtcttgttgtccgatgagttcgcgtgctcgccgtccagcctccaaggcgcgttgtcgccagtcctcagcctccttcgcagcccgctcgcgttcctgctgctcacgctgcagccggtctcgctcttgtgcttatcactcctcttctagtcggcgacgctcggcttcctgtcatgtgcgttgttcttctgcttcacgggcttgacgctgctccactgtctcgttatcagccatgaaaacaccgaaaaagagaggcgtataattgtcttcataggcttcgtcaaagtcgtcgaggttgctgaagtcgtagttgtagccgaagtcgtcgtagtcgaggatctccgttggccgtgagtcgacaccaggagagctgaggtagccatccaattcttccgttgaaaccgtcccgagaggctgaagtatgacaccgacttccctgaagctagattggatcggagccgaggccggatcccatctagacctacggggagaggacatccttgtggtgaagaccgcagccaaatcatcggggagcttcatcaggatcgatcgattggccccatcatcttgattaggtcatgttggagtagatgagatcacgtttgagtggtttgaagccaactcggatcagatgatcttggagtagatctcggccgagttcgggagaccgaacggggcggagacctcgtctcttcctgactagtttgaatcagagtcaaggagagagatcctgccgaagttgtcggtgatgaagtcgaggctgctgaaccggaacgcctgcccgagagggaagacgaagtcatcgatgccggagacgaatcccatcgcactaatcagcgagaagcttgacgcaacccctacctggcgcaccaactgtcgaaacaagatttcggcaatacgaaaaggggtggctatcaagcaggaaaagtggatgggtttggagacaatgaattttatataggtttaggccctctcaatgagaagtaataccctactcatgtccggggattgatccgccgagtttgttattgatcgtatgatctgggagaaaagttatgccccaagaggcacccggacccctccttatatagtgtaaggagtccgtattacagcatacagcccatattcctaatggaataggcaagtaaagatagaatacaatcataaccgactaggatcccggatatttccttaatacacaagttaggaatttaacccgagccctttaaagatattctatctacatatggtacctctgtacccagtcggatatacatgccatgtgggtatggggtatccataatctccacagttataaaatgtgaaccaagataatgaaagccctaaacttgtaaaataaaagtgaaatatttaacaaaattattcattatactcaacttaattaagaggtaacatgttctgaacatgcaactctaacgtcatgcacatatagaatactatacacctagaacacgttataactccaaaaattgtgaaaccaaaagtgttagtcttagaaaacacatccctacatatctgtggagtcaaagttagtaagaatcacttcataaaaatattttataacactacctaggtaaatactatcctataccgagcaaacttctaaaattcataactcacaaataaaaagagataaaatagaaattcttgcacctaaattcatattagaccggtacctattcactgtgcacaaatcatgcattttagagcattttgaatttttcgcatatttcaatgtttaattgcataatgtgtactttatatagatgattgcttaaacgatgaagaagtgattttggtgctgactttttctagttaaaaggcaagtcccacctccctctctctttgatcactttgaacctatgttttgaaggttattgaaaatgtttgcaaatcttacatgtcgattgtacactaatacattaaaattttgttaaacttgttagacaaactcctattatttgcattatcaccttaatcccgcatatatccatatccctcattcctaaccttaggaatcatatcctgttactacttggaatatgagttacactagtttactatattgcttagccaagcttagaatggttttacttatcacttgggctcatattaacatgaaaaatgattttattaagattctggacagagatgaataaatcaagtatttgacaaataaaatgatggaaaacatggattttaggtttgggcctcaagtggtg

SEQ ID NO: 67974 - DNA, 12097 bp, Oryza sativa
  unsure (1)..(12097): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatctactggctctggcagttgcctgaaagattttcagcggatggccatcgatgatatcatgccgtcatctatagaaaacttgagtacgtaccggagatggatcttgaacactattcaattaattagatctttgagcttaaaattatttggaacatgatatgacctttagaggagaggtgaggtcgtggggagagagcttgagatgaatggactaggtgagttcctatattcctttaatagatttcaatagtgatggtgaacagtaaatccgtcgataccatgtgggttccccaaacagtatggtagatgaacttttgttttctcaattcaaagccatcagtttttaggtgaagtacgaaatgatggtaaacatgattcggagattttataatggaaatgattttgatttaatttttgaggctttatttttttatagaagcacaatacaaatgcagacgctcacaacgagtgtatacttatccctacgaatacattcacatacaccctacccctataaatattttcgaaacaccggatccctatgaaattctcttttctaaaattccgttgcaatgctagtgtgctgaaacctgaaatggtcggaggtaggattacacatggaccatggggcagcaacacatgctaatgacagcaatcttaaagctgcggtcactcacctagttagctggtggcctgacctgtactgtacatatctagcctccccccctgcaggtggtgccaaactgccaaatccagcctggtggcatcatgtatctattcaagtgctctcgtgctcatggatcttgggagataatagcctctgatcgacaagtatagcagcattgctgtacctggatttgtttgttaaggtaggtcgtcattgccatcctgttgaggagtgaagtgccgtcaggagttaagccagaaagttagctttgaatggttgagggctaatggaccggctaattagttgtggctaatatgacaaaaaaagtttagtgttgttcgtactcagttataattgatgctctattaaagactactctagctttggatcggcgtgtaaaccatcgacctaaatggatagcgacatatagaatcaaagtaaggtaaatatttttcagaacaacgtgtagcaaagtatgggcatttaattagtatattataactgtctacaagttatatttagtttaggtttctttttaaactatgcatataagttattggtggacaaagttttaaaactttaataaaatcttattctaaatatcaaatatttattttcagagggagtatataagttaagatagggattaaaaagaattatctatttgttttgaggacttcaaattgccatgttatttcaaaaaaggaaaagcaatattgttatattgaaagttttcgcatgaaacataccgtttagcagtttaaaaagtgtgccacaaaaactttatcttcatccaactctttgataaatgaacgggaccatagtctcgtgcaattattacgcaagaaatccgactagagctatgtttagttcgtgtgacaaatttttttaagtatacaaacacacatttgaagtattaaatgtagactaataacaaaataaattatagattccgcctgtaaactgggagacgaatttattaagcctaattaattcgtcattagtaaatgtttactgtaatattacattgtcaaatcatggcgtaattagactcaaaagattcgtctcgcaatttatatgtaaactgtgcaattggttttttttccacatttaatggtacctgcatgtgtccaaacatttgatgtgacgaaatttttgaaagtttgaagggaagtaaacactgcgtacctatactagttgctgagtatgaattgaatgcccctgccatgtgtgcagtgacgaaaaatattccattatctaaaaatatgtgcagtgacgaaattgaggtaacaaatttcaaatgaaattgaagcttagctctgaatctgatggacggccgcttgggcgtagcctcttagcaaatgctgggtatgggccaaatttttgtgcttcgtctggcagtttgggctggggctgttgggccgttgtgctccccaggcttctctggtcagattttctttttgaaagcacaatgcaaaagcggacactcatactgacgtgcgaatgctcacctcatatgagcgcatacaatacatcccatccctaaaagattagattaacatattttgagattgataaagtcatctcagatactttgttttcgagaggcacatagcctaccactgattgaaaatacaagcgctagcgtgagtgggagaccccctacgtttagattgctctttctttagattatattcctcctcctattttcttaaaaatgaaatgtcattaagtttttcttcaatcatttaattcaacctcctatgatttatttggtgtctccaaattttattttcaggttttaaccttctacctataacattgtagttggtgccacaccatgacatccaaattccaaaggcagaccacggcggatgcgatggccaccgaagaagaagagggaacaatcggatcgatgatggcatggagtacatggaactcaagaagtacatcatgatgttcaaaggcataaacccttattttcatatttatgtaaggatatattcaaaaataattttactataaccatagggcaaaagatatcttaaacctcgtacgaacacagtccggttaaccgtacctaagcagccgcctgggctcgacgacgaaaattcaattaaattttaatattgatgagtaaattaatggtgaaatttctataataaatagtactagttagttatattgaagtttcccgggctcaaaatttttttttggctccgccactgcatttagatatgtcttaatggctagataagttttgatttttttatatacttatgtaatttgtaattttttatattgctagaaaaaataccggtgcgttgtaatgagatgaaggctattttaatcgtattgttgttagatttttttctaaagtatatatagaatttttattttgatcgtattgatatctaattcggaatccttatttggatgatgatcatatcatgcacgttgttttcttatggtatggagagaattataaatatattaggaatccgactttcgcctcaagttagcatgcgaggtttttaaaaggatttcttatacgattccttatgtatttttaaaagcgaacgaacttaaaaacaaattcaaatacggatgacgtatcaaagtattggcgaaaacatcttttaatttttataatagtagagatatagatttatatttatacactgtagagtctcccctacagttcactttttttttaaaaaaaaaagcaaacaaacggagacatcgctgatgatatacgacgtggattcgacgtcgtcgttctttaaactggatgtcacggtgtccggcgaccggcggcccgggggtggtgtgatacagtcttatgcaatcgcgcaggaaaaatctgataactcttactagtaggctattagcgagtatgattaaggccgggtttagggtttagttcccaacttttttttcaaactttcaactttttcatcgcatcaaaattttcctacagatataaactttcaacttttcttttcaaactttcaattttagtcaaacttccaattttagcatggaaataaacacatctaaattgagacagctccacccaactccacttccagttttggtggagctgaaactgtttggctgaactccagctccaggaggggtggagctggagctggagctgtgccaaacaggccctgagtaccttttgtgcagtactgcagtgacgaaatgatagtaacaaaatacatgtatccaatatcaatttcatcattttaaaatattgcacagtcaaaatattatgtgcgaagtgagcacaacttaagtgattaggttccttgtgctataaccagtttatctaggtttacgtactagacttgacacggatactcgaatctactgctaattattattttagtgatagataatgtacccgttgaaagtgaggtgcctcaatttcaaaatatacaagtctagtgttttaaaggtgatcgtactcattgattgatataaggtgtacgtgtgtccattgatagggtgaggtaaatgtacgtgtattataagcgtatgtgtttgtatcatgttttattactgcatgcccacacaaggaggaaaaaatgatcaggccccagaaatcatcgatgagtttagagtctattactctcttgccgagggcttactctgattctgatggatggccgcctgggcggctgggccgggtgctgatagtcgagcagggatgcgggaggccagccggtcgtggaaaatgttgttgggtatatggtccaaatttctgtgcttcttctgttagtttaatttggagatgattgctcagcttgggctgaggctgttgggccgatttgctcccgggcttctatggtcaggttatctagaaaaacaagcgtactcacccttataaattcacacatttttattctactactataagcatcttcgagacactaaaccgatatattctaaaattgatggagtcaccgcctcactgtcgagggagataaaaaaataattagttataaatacgaacacccatactgagtcaaaaatctatacttagttatgttctaccacaggaatttaaccagctaagctataagttactaaacattcctcctatttgatacaaggaaaaagaaatgccgacattgtttttctcttttaaacctcttatatatttttttttcaaaaagatgtctccaaattttaatttttagatttaaactttctaactacaacactaggactgttaggggtgataaaattcccattcggtaggggtaggtccaaaatttgacatgcgcacccatcaaggtgggccgtgggtcccagagaaaatatagtgctgggatggagagctgttcctactaacgggtcacccacgggtttcagcggaatgtggcctacctaacttggctaccaagtttatataaaaagacccacctcgtccttcaacccagcaggatctaggtataaaaaaggagggtattaacgcaaaaccctagacacctcctagtcatcaatgcctatgtagtgagtcgcatagctagcatagtcctacactgtcgcttaggcacactgtctccctgactgatctggccgttggcacatcgttcccttctctctggccacctcccgacactgtatcttctctccctctcactgctagtgccccacaccgttcttcgctgcccacatcgtcgcccgtagttgttttatttctcccgttttcttcttccagaggagggcggcatgggaggaaataagggattggggccagagcttctgtttttcaacccaatctcaatttgccctgttgccaaccctagtgatgagatatagaaagatatttctatatcacggtgggaacaaaagttttatatgcaaagaaaagttttccctgaaactgtaatttaagtattaatgaaaagatatattatatctttgcaccatagaatggacaaaaattgctcacagagatcactatttatgttaagggtgaagtatgacgctggcatatccctaggctacccccatgcatcatcatcatcatcatcatcctcctctttgacccgctaaacgtcaagacatctcttgctgctcctctacgactatccaagtatccatcacacgtctctcctttccacctcgtcaaaaccgtcgacacgcgcgcgaccattcgatcactccacgacgacgacatccatccacagccagagcgcggcggatgcgatggccaccgaagaagaaaacttcgtcgatgatgatgccgacgtgaagtcgatgtcgtcctcgtcgtcgttgtcgtcgctctttgacctcgacctcactgcgttcggcgaccggtgggtggtgtcgggaggaaaggaggaggttgattttgctggtgccgatgatggtggtggcggggcggtgaacgtggcgtccgacgaggacgaagatggtcgcggcggcggcgtggcggcggcgctcgggccggctgctaggctccgcgagcttcttcttcgcaagctgaggaagccgaaggcggccggcggcggtggcgcggtgtcgccggagggacagagcggccgattcttggcgaaggtccgggcggactcgatgccgcggctggaggcgcgcgcgatcgccggcggcgaggaggagcggcgcgccgccactactactaacccgaaggaggccgcacggaagtacctgaacaagatcgcgacgagcctcgcgcgccgccgcggaggtccagacccagcagcaatggtggtcgctgccccgacgacgaccggcaagacgaagacgagccgctcctccatggcggcgccgccgccgccgcgccgcggtatagacggctcggcccagcacttgcaggacggcatcgagagcgccattgcgcactgcaagctctcgctgcgcacggcgacggcagagccgagctaaggaggagtgcaaatgttgagtcgttgatgcatgcatgaagcatgatgatgtgttcctcgcagtgagatttgataaaggctttgttcttggcatagacgagttgccaaataatcgcattcgtttttcattaaatccctttgagatgatcgcgtctaaatttttagataatagaatttattccgacctttgcttcaaataagctatagacaaataatcgcgtctaattattgtttaattagtcttatgccaattggttttttttatccttaaggggatttttcttaagaaccgatactaaatatgtcattttcattgagtatagtaagggaaaaatttgcatattagaaaaagaaacaacaataaaacaggatgagagagctaaggtattagctttgggaggtgctttgctgctcctaagggcatgtacaacggtttttattagtggtctctatattactatgcaagtaaatttgataacatggaagaaagataaaagagaaagtacaaacatggttgttatgcatgacaatggtttagagtcaactcttagcatttattagatcaaattttgttacatgatgttgaaagaaaggaaagaagagtaagaaaaaaaaatattttgatacattaatggtagagaccatattgtctctaactgttctatgacattagtctctagatagtatagagcttatacctatctctatctttgtacatggccagtatttggcctccttaatttttgggcccaaagctattgtggataattcccttttctagaacactctagttactgcttctagatttcctacactgttaataggatgagcgtgtagttcccctttatatggcaggcctgggctagggctcgtggctagtgttgttcaccatttatggactgtcgtctccttcatcttgatggcttaagttgttctcgtactgtccatgcaaataatatatccaagattctcctcatgtatttgcatttcattaggagatggaaggatgttttgtgggtgtgtcaagaaagcagataaatggtgtagttatttggttagtcgtagactacaagtctgccgaacatctacactttgttttgcaagaatatctaggtaaagagcttgcattttgttagagcccaaggattccaaatcatcatctcataatttgtgttgttagatctagctatgtaaaggggtggaggcaggcctagggcagctagggcttgagccctaggtctgcctccaaaatgaaatctaacaccttattaggtgagccttatcttagccctagtctttaccaatttttggctctagcacttcacgtgtatactccatggcttgtgtgctttcaagtaatttcatttcctttattggcagtgagatgcacccctatattgtattctatagggtcactagttggcctaggagttcgaccaatgatgctcgcatcaggtgagaaattgaggtcttgtatctatgtgttactttcgatggattggctgagagtcttatttttctttttggagattgcgtaaatttgtggtgttacatccttaaggtgtcttccgtgtatccaaattgagtcacacaagtgtattgtctcccctttgcctattgttattgtcgtagttgccaaaagtaggaatttatctatattttcgcatgggtttctatccctacccatatcttctctagcaccttctattcatgacaaagtcatctcacccacaacacccttgcaaacgtttccaggttgagcactcactactacaaaaggcatctttggtgacagccaagaagctattttgagatggctgggtgctctgccatcaactaaagctcacaagcagtaacagaactgcttgcgcgtaccgcttatgaggaccgctagcgaaaattgatttttacaagtgcatcccttaagcgaaccacctgtgaagatgttctctggtgtaaaaaaaatcacattcaaaccaattcagatgcaattcgacaatcacaaattcaagcatcaatttggatatgctggcctcaatgcaattccagatttccaaaatgacatatgagaaaagatagattgctaagaagtacctgatcccgtagaaaatagaaatcctcagatatgttctaatcccaacttccattgctgcctctccagccgccaagatccaaaacattcacaccgcaacaagaacaacagcggctgcctccaccaccagcaccaccacagcgtgctcaccattgaaacaagccacgtctcactgtcggctttgagcttcacaacagtggatcggcagcgaacgaagagcttcacagtggcagctcgacatagatgaaggactccacggtggtggctcgacgaggaggaaggaggctatctgactccgccacatctggactgaagaggaaggaggccaagggtcggcctccgccacggcagcggctagacgaggaggaaggaggaaggagacctgcctccttcagattttgagggcacggggaggcccacaccgatcccacggccatatctgctgcacgcatcgctatcaccgtggctgccatggccaccgagagggaggggaggggagggggggggggtgagagggtgtgaggaggataggatgaggagatggagtctatctgtgtacggtggagataagatggagtccatgccatccgtgtgaaattttagtataatgaaaaaaaatttgcagtcggtgctccttagcagcttccagctattttcgatggttacttaagaggtccgcttgcaaaacagtcagtgaaaattgattttcactgatggatggtgaccgcaatccctctcaagtatttttacaagcgtgtattcactaaactcgccagtaaaaataaaatggtgatgctatgaaaattgttttcgtagtagtgctcctagctcactatgtgccattggcatgcttgtttttctttcccagttggtcttgtattttccacccgtgagttctcccgatcccacccgtagcagccatttttctttcccacattgtcaggaacctccagaaattccttggagacttttaacgccataaggaggtagacaggctgcaacgttaggaccaatccgaccaacgttgttcgtttcgctattcccatgtttcttccgtaccagtaggctatacatccaactggtttatcaaaaaggggttgaaggccgcgttgtatagtcttgtgatggctagtggtataagttgaggtattttatagggaatgatgccctttgtcgagggatggtccgcttgattaatttatgtattcaaatagtcatgaattttttgttgacaagattggtaaatataagatatatcactccacgaacatttaagtttaaataccacctatttaagttgaaacaaacagattgtgcctactacatttttttttctttctttatataattttatgtgttgaattgtttgcatagtaataatttgtattgattgaaaaaaaattcaaatttgtatagattcaatttaaatgtgtagtaataagttgtgaagtaatatatcatagtatagatctatcttgtaatttttctaatgacattttacctttttagatgttatgaaaaacgaggcaccatgccttaagattgaatttagtttcccgttttgttgggctgattgatccatgccacccaatagaatagagcgacatagagatgggccatttggcatggtacatggattcgcgtccttttctgcaagatctctaacccaacccaactacagtactaagtagtttttccttgtttgcagccggtagattggcctaatgcaactctgcaagcccatttcacttcccacagaccacatgccgaaatgctggcaagctgcaaaatttccttcaattttgtaaataacgagattaccgggagcaatgcaagcaatggtggtgacaaattaggggttatgcctccgttaaaactgggcttcgtcaaaatatcatctcgtaaatatgatttctcaaaataccaaacccaactgatgtgttaacacttataaatgccttttcatcacttactaattgatttacttacttttgtcatcttttacaacatgaaccgaccgatatgctcttcattgggctatgttagagagtgcaagttgcaaactaattccccatgcatacaagacgaactaattcctcatgtatgcaaaacgaaactgctcattagcacataattagttaagtattagcttgaaaaatattaaaaatagattagacatgattttgtaaagtaatttttgtaactagaaacataatagtacatgagtttgttgacatcctccattggggaaaataacagattatccttaagtaggacagctagcagagtaacagatgagtgttgttgtggtaaaagtgttctaactcttggagtacttactgttgctgtagtcctaacttttcttgatagataatcatccattttgtttgcctctccttttatccctcttatatatgttggttacttctctttgtgttaaaatctgcaatggaagagaagaggccgaagactccagtgtagtgcataatgtgcaaagtgttgttgtttgtagcatggagagcagggattggttatctgaaatgaagattggatgttgtatttgaagtctggaacacaccttgtatgctactatgctagtattatacctgcaagttcagcttagagagaggaggtatattttgaagaggtagcttgaacagggccgtcccatgaattttggaggccccgtgcaaaaatattatccaaatactaaacataatctataaaataaaataataaaaactttggctacttgcagcacaaagagagaaatcctctctcattttacgcgcacatatttcccgcaatgctatagatggtgcgttttttatgaaatagatattgaaaagttgctttaaaaataatattaatccattttcaagtttgaaattattaatactcaattaattatacactaatggccgacgtatcttgtcaatttctcttttccatcctctcaaacgcacacccttataccccatgatatattttgcagcaatataaattggagtggaacaaaaagtgtatatgcgcgtaatcttcaattgaaaagcataattcttttattgtttcccgaaataaaattttcaatgatttgcagaagatggttgaaacttgaaag

SEQ ID NO: 67975 - DNA, 4646 bp, Oryza sativa
atcagctatgttactgttgtttcctaagaggactacatcatacaaaaggaacatagtacaggtgcaggatatgtgaagaagccaaagaaagaaggtagcagtgccaaacaacgagagaagaaaacaaataacaaggttggctgcactgaacgtaagcacaaggaatcaaagaattatggcatcaagtaaatttaccatcataaagttcacccaaggattcaaagagaggaaaagatttgtttttgctgaacttccttactttctcatttgactacacaagatacaaaaacagataattatggcatgaatacaaataatagtgatttgaatgaggacaaaacaattatgctcaaaatatcatactgtaattatgtttgcccaaacagcatcatcggcaacaatcatgcaccgttgattatcccaagaagctccactctgtttccttgcctccttaagcaacctataatctcgttttaactccttctccttatcttggatctgttgcttattcatggtgacatagggatgtctgtcacgaaattctttgacgaccttgttccatgcttcacttgtccacccgttttggcaccggtaatgtgggttattgtgctcatgaagtaaatcaactaaagccttttctggtcccgggttccatgaagctcttgattgttgagctattagacaaaattagattatagtaagtaaaatttgtaatcattaatatgaaaggaaaatacttcacaaaaaaacaagttagatactaccttttggagaaaccttcttcttctgtatgctacagctctttggtgatgccttcttttgtagatgcctttgttgctgctgcaataggcttgctttcggagatagtcttccaaacatcataactatattgcaatattttattgaatgagaaaatacaaactacgttgcttactattaatttgtccatatcataaatgttgattgcataaataaatacaaataatgcaaaaccaaaatattatctatactattcttgctagttacgaacataatcttcccacatcttcttagcaatcatatctctaatattattcccactgatcatttgattgctaagagatggcacatcatttcggtattcactgtcaccttctggtagatcgacaaaattagtaggttctatattatcaggttggttgtccaaccagccctcatcaccattaagcaaccggatcatgttgtggaacaccgcagcagctgctggaatccgcacttggttctttatccgatggaaagtgcctactttcaggatgggaaatcgcttctttagaacccctagagctctctctacatggtttctcagaatggcatggcgatgattgaataactccttgtagtctctaggtctacgatgaccacgtccaaactcctttagatggtaccgaacaccacgataaggagtaatgaactatggtgtgttggcataaccaccatctactagaaaaaatttaccatttgggacttgaaagccactattcattgctgatctaaggaccctagcatcggttgcagacccctcccaaccacatgagataaaagtgaaatttaggtcgaaatcacaagcaactatcacattttggctcaaagtcccttttctgttcctataaggagctgccttctctccatctatagttataggaatgtgagtgccatcaatagcccctatgcaattctgcagcaaaaagggaagaaaaggacagaatatgcatgagttatttaattggaaaaggaatagatattcatttctagtttgagtgccagattcaccttgaagtaaggaaagaagcgaggatttgttctaatcttccaatgcgtttggtcggcatgaggaagcttgagaaatctataggtgagagctgggattatcttgaaaatagacttaatatgccgatgaagtgtagacccactatgcttgaattcatattgtagatcttgaaagcttgcattgtgagcgagcatgaacataaatatcccaagtttctcctcaatcctcaagcctctactatcctttaacaacttttcctctctaagataattcgctattgtcttgaaaacatgaggctccatgcggaatgcaactttacaatccattacatgtccttcaaggatttcttgaagccgctctttaccggatagtcttgagatatgtctaggtattttctcactatttgtcataccgcacagcatatacatcgcaggaaaaacaaaaagcatcatatcatcgtcctcttctctcctccttttaatttcatccgccattctcgaactgattttatcactaaaagagatatagaattactatactttaaactatgtgtgagaacataataatatgcatatgtattacaatattattaaacatgaaattagaggcattcaaggtggctacatgcataaatacttttaatactttcagcaaataaacagtctgcaatggaaggagggggatcaataatgtgttcagattttgactagttccagaagtactttgtgtacttagttttgtttaaacctcagagatagcaactttaataaagtgaggatatccttctagggtaggatgtttacttgaaaataacagcctcctgttcactagcaaaaaaaaactgagaccatctgccacctgagcaagatcacataacattgtacctacaatctctctctctctccaacttcaaattacttctgttactctagtaaatatgcaggggcaagattaaatgcttcatatcaggcaaatgtaagtacaactgtatttagttttttctcaaataccttgagtaatatcaactccttcagctttacttttgccaaccccacacgcctgtgcctctcctgaaatttaattcagcacaacagattatatttttgtcattcaatagcaatttatatagctttgtatggtatgacctctagtaatatatctgaacacccagtttcctgaaactagttgtgaacatagtagcagttcagaatagataaatatgctaaattgattgctaagagtaaaataggtattcgaacaaaagatggacagctacatttctcaagttttaacaagggcattttgctaaacaaaaagccatggaaaaaattaccaaaactagaatgtatactacagtgtccacctgaccacctcatagcatgactttaaaaatttttgtatcttcttgctcattcaattggcatatagtattggtcgttcaatctgaagctcaaatgaccttggccaaaagcaaagtgatgcattctagacagcaacaacagagtgcactagtttttattttttaggtgtgctcccactgcatctacaataattcctggagaattaacaaaccaggtttctccctcacaaaaaaaagaaaagaaagaagagagcccatgttcagaaatataggatatgccaattcaaatatatatttccttgattacagagcaactgataggcaagatttgcgcacacacacagagatgtgcatggaattttctgtggtttcaggttctactactacaaaccacatcacccctccttctaagcagaacatgactgatacttcaatccatacagccactcaatacatcaactagcaacaaattcatccactagataagtcacaaaatcttttctgagtgggaaaagaggagatcaagaatcagacctgcttcttggtgtccgggctgttgccctcgaccttgccctctcccgcaaccggtgaatccgaagcgaggaaggagagatggcgagcgccggcgactggctgggatggagagcgggaaggagagcggtggcggcggctgaagcgggatggagaccggcggcggctgaggacgggatggagaccggtggcggctgaagctggatggagatcgtcggcgaccgagggcgggatggagagcggcagcggctggagatatgctgctcctggatctccaccctagagccgcctcccggacctcgcgtcgcctcccggacctcacgccgcctccaaaccctagcgcagcgaggagtcgaggaggccgagcgctgcggctggcttggaaaaaaaaatcgtctccgaggcgatttttctctccccgtgggattggtgtggattgggtggagaattactcccaccccggcccaggcgaacgcatacatgggccacggaagaaaattcgacccggccgggatggcacacggggatgttggcccattcccccccaaacccagcctaaaagaacaaggcctgaagattgggggccctgtgcgatcgcgttggtcgcactcccccgggacggctctgagcttgaataaaaacttctgcacatataaagattccaacgacagtaaggttgtgacgttgtccttccacgaggcatctgcatagcatctggtgcctaacggaataggcaaacagttgtgaaaagcatttgtattatctgttagagtaaaatccatcaccggtccctaaacttgtaccgctgtgtcatcctgatccctaaactcgtaaatcgatcgttcaggtcctcaaacttgtttgactgtgtcatcccggtccctaaacttacagatcactcgtttaggtcctccaacttgttcagttgtgtcaccctggtctctaaac

SEQ ID NO: 67976 - DNA, 7709 bp, Oryza sativa
ataaaaaaaaatttaactccaaagttgtagatcgcgttgagggctataagtttgatataaagtttgtcttcattagagttcacatgaaaaagttatgaatttttttaaatataaagtctttagatcgtcctatttgaattagatgatattcaaatccaagtttagggaccagggtgacacaactgaacaagttggaggacctaaacgagtgatttgcaagtttagggaccgggatgacacagtcgaacaagtttgaggacctgaacggtcgatttgcgagtttagggactgggatgatacaacggtacaagtttagagaccggtgatggactttactctatctattattacctctggttcttttgaactttgtagttgcgtcagttgggtgtaagtagatgcagcattattacatatatgggattatttggatcaggtgcagtcacaatagtgaccgtaacttgcagtagtagtacgcatcattggatataaattgaacggctcaggtcgcacatggtactgttcatattatcgtatcagcaaatactgttcatgtgggtactgtagcttttgatctgaaccggtgatcacaaaaatggatggtcgaagttgtgtgcagttgttaaatcacctaatcccaattcatatacgtggtatggctcccattcctttgatttgaaaatgtagtcatttatggctttccaaatcttcgaaagcatgatagagattttttatagcgcattttcagttttcatagtagcaagcaaataagccaaaatatcttgcattgtctgcattggtgtgagagcatctatttgaaggtgaaaatcagatacaaaccaagttagccttgaaaattgacaatgaaagaaaaggtgaaaatcatctacctgctgaccacatcttgaacaagttgaggcaatattagggaaattgtttttccaaacttctttaagaagattgattgttaaagtaggaacagagggttgatgaggatgaagatgagagtgaacttctttgtaagcacttttttgttgcactcacctgattgggtatgtttccagcaaagttggtcctccaaaacttgtggaataatttgtacctgtaagattgattcagtagctttctgatcaaacatttgtgaaattttttcagtgtcccatctcttatatatcttgataaaaaaatcagcaatatttataaaggcaataggtatggaagagtatcgaggacaaggtgaacatgaagacatgggtgcacagtgaagatggcatggacacggtcgggccttcacgctcgtgccaaaatttggtaaggctattttgttttcaatcacaggacgagtaatttcaccgtccttaagaaagtaggttaaaataactaaattttaaattaaaatttttttggtaccttgagatatttagtatctagagatatcaaatttgtcattaaaaatatatatctccagataccttctcaagaatgataaaattattcttataggactgacacacattactacacacgcaatacgttcacatactcacgaatgcatctcctaacaaacggcacattcctaatattgataaaattatttttaaaagtctacttaattacgcatgtgtaatatccgttggcacccaaacttgaatatcggttggtccctaaaattaatcttaaaccctagcattccacgaatattttaaggagaaaaacaaaagaccataatgcatttaattaatataaaagttgtatttgttgaatttgtagatgtggggtattgaagtaatgaaatttctcgttttgcgaattggtggtagccaagaaggtagaagttgatttattttgcgacaaacttcaatctttataagttggtttatttcgggacagaggggagaagtgccgtacaagatgacctggttgtccagacttattaattaacaaaataaaacacgtgtagtgtcgacgtgtagtgtgggcatgtcggatcggcgcgcacacacacgcgatgataacatgatagccagccggcaggtagatcgaaaatataggaaggagcttaattagccatggatggcgcgcaggtagctgcttcattcagttgcgcacccagagcatgtcgtcctgaggcaggaagtggcagactgccaccttcccgggcgccacgccgagcctcttgtacgcctccgccaccgccacgccgtgcccgtccacgtccccgtggcacgccgccaccgcctccgccatggtcccgtcggcgccggccagcgtcaccgtgtacgccgcgcccttgatcccgtgcaccccgaacacggcgtacgcgtagggcatcctgtggcatgccaccatgtcgcccccgggcaccggcacgggcctcacggcctccaccctgtacgcctgcctcggcgtcggcccggccctgttgaccacctccgtggacacggcgtggacgtcgcgggtgccgaggctggaggcgacgagctcgaccatggactcgagcgacgtggcgcagtagtgcttgtgcttgggcgccgtctcgctggcgatccgcgcggcctcgcacacggcgagcgtggaccgcatggcgtcggcggtcggcgagccggcggggatggagagctgggagaggatctccgggagcttttcggaggcgaacgggacggagtcggcgcggccgcgagggagcagcgcggcgccggcggtggcgcgggtgaagtggagcgtcatcttggagcccgggaagaggtccttctcgaggaagaacacggagcccaccgtatcctccttatccttcgaagctgaggccgctgagctcgccgggctgatgaggtcgcgaatggcgccgggcatcggcgaggtcgggagcgcgatcttccagtacatctccgccggcgacgcggcatggctggctcccgcggctgcgacctgaaatgcagtcagaaactagttgaattgaaaactatcaaagccaaaagttgcaactggaataagtactaattgtattacgttctcatcagaaattcaatgaactccatatgttgatccatcaaccatcttaaggtaaacatgttgatccagttagtttaaaattttagctagggttccccgcaaaaaaaaaaggttagggtacgtaattttaacttaatcttcaatctctaaataatatatatctctctcccaacttatctctgttctaggcttctagctcaaaacaactaaaccatacaaagagcgatatatatgtgtgtctgctcaccagaaggagaaggagagcagcgagagacctagccatgctaattaacgagctgtcaaggacacaagtatatgatctaattcactgataagagtgaaactgagcacaagcagttcatagcttttgggagctatttatagatcagggaagcgggaagaagacgaacaaataatacattgcattggccccactggattatgcagaataaaaaaatatgtcatgtagcaaagatgctatatcacattcacgatcatgccggatatctctattattgagcaactaggagggtagcctgcgcattcgcgcgggcatatattgtagtgtatttcagatatatacttataagtaatagaccgattgtgttaaatgtcgtatttgttatatagcaaaatatggcatattgatattatatatattgttggtttgattataaacagagtaatagttagattagaaatcagacgtggagcttataattattgattatttctcttttagttatacaaaataggaacgagagagtaatgaaaagcgtagagctcgagctagagtgggtgtgtagtgatggacgcatgtgagggtgatgtggagtggatttttttttgtaatttttctaattgatttaagtgaaagccaattattagatgttattttccttggatttgtaagatttttttttaaagttgtaacatgtcatggattaagatttttataaaaatagatttgatagttgaaaataatattagtgatacgtggtaacttaatatggctctaaaaggttataaaagttgactttgtactttcctaatttttattatgtagaatgattaacatgacataatacttgttgtcaattttttaatatttcagtgttgtttgcttgttggcctatgttcaaattacgtattttaaattttacatagtaaaatatgagtaatataaatcaacaattcaaataaattaaaaatcggatgttattaggttgtcattgctgacggtagttatagaccaattttgactgtcaatacttttgtagataatggagaactagcaatgcttgcatgcatatttatttagaaataatctagttccacttgtacttgataaagtaagtatttgtttacaagagatcatcacataaatggaggagaaatgattgaaaataaccgtttaaccaatcagaggtcgacatgtggcagatatatggatggatgtgcccagaatctcattgaaacacctacaaatgggcccaaccactatgccactgggccgaggatctgtcaggagacgtctaggacgaaggactggcccagggaggccaaccacggttcggccaaccttgggttccgctgacccatgcctggctccgatcgcccaggcccaagccgaaggcggttacataccgatcttctaatgacggttgtactggtattggcgctccaatcatcatactcaatctataaaaggacctccccaacttcacttcaatacacaccaagaaggaaatcaagtgaagaagctctcttaggctgagttcgggaatgaggtttgggaaccctcactccctggcacggaaaacggagcagcgattagggggtaattaactaagtatttgcttgttttttcaaaaatggattagtatggattagcaaaaaatacaccatttagcagtttgaaaagcgtgcgcgtggaaaacgaggaagggaagttgggaacaggaggtaacgagcgcaaccctagtttacatattttgctctagtgctagtagagttagaattaaatattcttccttagttcttcatgtcttgcagagaagtcgggtatggttctagtagctcttcctctcttgtaagactttattcaataattaaatattgttttttatatagttttggtcctttactatacttgcataattattcgagtaccaacttcggtttatacttgactcgtatttattatgtagctagcttactggagatatgcaatggtattggcttagtgttcatttatttggtaatatttagtaatgtaagcgcggtgattagattattagatatcattaagtggtgctatatgccacgcatacgtaaagataggccgctgatgctgacaactcaatacgtgtattcgttcacgtgcgtagatagggctaagaaaggttccgggtgcgggtacttctccatatctttaaccggttggatagtcatgacggattgtcgtaagaaactcgacaatttggggtggtttctcgatataccagtaggcatagttgtacattagcaagcatatactaaaataactatatattaaaaatatagaaatgatgcttttctttattcttctctagttagcctagacttataatttagtgagagtactctaaactatcccttctatgtgtcattcctctccccttcctactttgtatgactaaaagagaaataatctataattaattataagctccacgtctgatttctaatctaactattgctctgtttataatcaaatcaacgatataagattcatatacctatattttgctatataacaaatacgacatttaacacaatcagcctattacttataagtatctcaaatacaacctatgatacatgcccgcgtgagtgcgcgggctaccttcctagttttcctaaaagctacaactacaatagctcaatcttccctacaagctgaacttctggctctacaattgacaatataagtggcgatatttcttgattttgcaggtaccatatttttaacggacaacgagacgatcgcaaatacaatgaatatgagacattttgaagctgatccagcctattcgaatcttcagcggttactgagttaaattcaagcaaatattccttttagcttattgcaggtgttgtggtcttgtggataacgagagaggtcaatcgcatggctgacaagttagcaaaaaatgcgagagatgaccaatgaaatccagcatttgttttgccacaatatcgccaacctagcttatccaagcagaaggtgatttgctaaggatatgaaagaccatttcagtacgtactctaaattgtatgaaaaccatgtaattaatatgtttgagcaatggaataaagtttgagttctaaaaaaaattgcatccttttcatgttctaatgcatatcatctagaatatgcttaatgcttgggctggaatatatatacacggaatggtcatcgtaggcgggcctggcctgagtaaggtgtaaacatatccgagcccttaaatggccttcctgtgaaaaaccaagtcctcttcataggcagccagttttacagccagcatactatagatgaaaacggagcggataattcatggatagtccggataaagatatttttttatatgaatgtgaatatggtatatcagagttttcgatgaatatgaataatagaaggatatccgatgaacaaaatgctattcagatatccactgaaggcatgagacatatctcatttctttctaactctagaccttcaacttacttctttagaattttaatagtagcccatctcatgatactagcccacactattaatattacttaaatatttaaatatttttttgtaaattttactatattttatattataatttcagttagacatgtatttatatcaactctgatgtacatgttaaacttaattagcattgttgactctatgatcaaacttattatataaaacgatatatttatatatgatagtatttgtttctattagaaattgaagtgtttttcatgttctgagaaatatttatttccctattcgtgtccgatcatattcgatctttattcatattcgagataattcatatttgttttcatatccgagctttcgtattcgttttcctatccgacagaaaatacggaaagaaatattgtataagcattatccatccatatccgctccattttcatcctaagcacatacaggacactcaggagacccgcttgcgaaaaaaaactcaggtggagtgcttaagaacctatttgtgaagatgactttttcgcgggcagcccgtatactctcgggagcctatcgtattaccggcgagccttctcatggccggaaacggatcctctgactttggatggaaagtcacggtcttgcaattcacttcatcccagccaaccactgcatccaacggcacacatccatcttcccctcatttgcctgcatatgttgggagtagctaagaaaatattttacgtagtggtgtatacaaccgtgtaacattgtcatacaagatgtatggatcgatgaatcgtacatgcagacttattaacatgctgccacaagtatagtagtggcatttcgggtcgtcgcatacacatatgataagacatgatacgcatatagctccaaaatataggaaggagctatcttgagatcacacaatttttatcccctttca

SEQ ID NO: 67977 - DNA, 4649 bp, Oryza sativa
agcgtcagcttgaagcccgggaagagctccttctcgagaaagaacacgttgcccaccgtgtcctccttcgaagctgaccccgctgagctcaccgggttgatgaggtcacggatggcgccgggcatcggcgaggtcgggagcgcgatcttccagtacatctccgctggcaacgcggcatggctgtctcccgcggcggcgacctgcagtgcagtcagaaacaagttgaattgaaaattattaacttgatttcaaaatatacctacttgctagctaacatgcatacatacttatgaaccaaaagttacaacgaaagataagtaaaaaaaaacttatattacgttctcatcagaattcaatgaactccatgttcatgagttcatccatcaaccgttttaactatggggcatatattgttcctgttaatttaaattctagctagagtaatttcaacttaattttcaatctctaactaatatatatatctctcaccagaaggagtaggagagcagcgagtgacctagccatgctaaataacgagctgtcaaggaaacaagtatatgttctaattcactgataagagtgaactgagcacaagcaggccataaattttgggagctatttatagaggaggagtgggaagatgacgaacacgtaatatattgcattggccccactgtggatacggaacgaaatatatacatatcagtcttattatcagatgtagcaatgctgctactcgatatatatatcgcattcatgcgaacatgtcggatgcctctattattgagcagtctgatagcttaacagcaatcattctgtggctggggttacccgtgtccttctcgatattctttgaataatccaacatgcatgtctatttctagtaatttatggattccccaatagagagattttagtttggctcagttctatccatggacgaggccatgagaactttttttttttacaagcggttcaaatagttatgaatgtttttttttcaaaaaattacaaaagtaggttattgtatcgcatgttcattgaaaaacaatcaaattcaatatatgcatggagtaaaaaaaacaaatcaaattgtaaaagtaaccatatatactttccacaatttgatttttttctcgatataggtattgaatatgaacttgtactaaaagacgtaacagtgccgtaggcaacaaatttaatgaatcatagggaacactcgacgaatacaatccctgttggtattaatttgttatggtcacacataaatctgcaagtacatagttaccgatatagcatttcacatcagagtattgtaagtgtattgaatcacaagaagcatatgtgtataatccaagaaataggatttttctaaggacaacaattaaggatttttctaaggacaacaattaaatggtaggcttaggagagataggattcctttgggtaaataatcttagttaagttaaggtaaaactctattagtttttttgagcatcggttcacccctgtttgccaagggactccgacctgtagctctatgatgtacccgaacgtggaggattaagaagaacggacatatttgtcacagctgcctataattccatggagcacacaacaaatgatggtaacctctaacctagatagcacctctacaatattgattacaactcggccaaaaacttccttctttatctagagtcttagtactagagtacttaatataaatactaagcgatgaatccacaatgattagaatatatcttacttaaataactgaagtaaatactaaagaaaatcatgaatacttacttatataaaagaagtatttgtcgaggtacaagataggagagagtgccgacatctctagcaatcctccagtacaccccatggagagaatgtcgacatgcactcctccgaaactcggagggaactccgatattttgggcacttttttcggagctttccctcactatcttcctatattctaactctactgtagagtaggctaaatataaaagtgagttgtactcaactttttggtgttttgagagtggaaacttctccttatgtagcttgggaatcaagcataatcgccattgtggaggcctgaggaagtgacacgtggaagctggcggtgattagtcacactccaggtttgactgaaccttggttcagaggaaccacattcaccgcctttcttcatcattttcgcctcagtcactatcctgtgggtcctcatgacggtgcatactaaattcgcttcaattatgttagtttcatatgattagttagcccatagattggccagaggtgtgtttctcttcgcgtggagggtggttttcatccataattacatgcatacaaatatttcttggtatttcttacgaccacagataaatccgcaagcgcacggaataccgctgtatcacttcaccttcgggtgaccccaaaaggatatcgaactcaaggaacgtgtgtaatccacctaaggataagacaatccaaggacaaggtaggctaggtaggctagagaggactttctatgtgttttaattatctaagctaagcaaaggtaatttcctatatgttgcttcgggcatcgacccctgctggtctaccagcgtggttccggctatagctctatgatgtatccgaacatggaggattactgagacaggattcagggctgtcaccacctgccgcctacctctgacaaatccgtgggatacacaacaaacaaaggtaatctctaacctagacaccacgtctaagttattaattactactctaatacttgtacaggaacttctttctttatctagagtcctagtactagagcacttagtatgaatactaaacaatgaacctgcaaagatggaaatctatcttacttagactaaataattaaataacataagaaaggaatacaaatgcttactttttagaagaagttctccgaacctggagcagagtgtaccgacaactctggtactcctccagaattcctcctaagaagctacactcgtcgaggtagaagtcggatgagcgccaaacttccgggcactcctccagagcttcccctcactctctaccttattctaatgtacaaaagatacaatagagcctgttgtaattcagctcaaagttgtgtctattggaatgtgagtgagctcctccttatataggctccaaataacggttaggggcatgggaattgtctaaaacaccctgcaaccacctctgggaagaaatccgagccgtcccggtgaaagcagatggcgggaagcgccatgattggttcggccgaacccaaaaactctcctcccagcctctccttgggccgggaggttgcttattgggcctctaaccacctgggttatgttttggcccaattctaaatggttttattgacttattgggccactaatccgtgtaaacgcgtcctgaatgcgcagagatgcattttgacatgacggatgtgttttctcctcaaattacctgcatacacatatttcaccaacactagtggaaatgattagttataatacttaccactaagttggataccattaagatgttaccttcgttgtcgcatagcgtgatggctccatgcgatgaagcatcgacgatggtatatggacccatccatttacttcgatgttttccatgtccgataagcttcacccgtgagttgaacagcagcaccttgtccccagcttttaactccttgtgcttgattcatttatcatcccatctttttgttctttccttgtagatcttggcattgtggtaggccttgtccctccattcctctagctcagagagctgcatctttctgtgctgtccggctttctttaagtccatgttccaagtccggatagcccagtgcgccctgtgttccaactgtactggaaggtgaaaagtctttccgtagacaaggtggtatggtgacatgccgatgggcgtcttataagcagtcctatatgcccatgcatcaggtagcttgttcttccatgccttcccaatctcattgacagtcttctgcagaatattcttgatttgtttgttgctcgtttctgcttgtccacttatctggggatgatacgaagtggcaatgttgtgctgagccccaagttcttgcaaaaagtttcaaaaggtcttatcgataaaatgagaccctccgtcacttatcaccatccgtggagttccaaaacgagggaaaataatctcatggaacatccggcgggcatgcttggtgtttgcggccctgcatggcattgcctctacccacttggacacatagtcaacggccaccaggatatactcgcagtcataggactttaggaaaggtcccatgaagtcgatgccccatacatcaaatagctcaacttgaaggttgtatgttagtggcatcgcatctcgagcagtgatccctccatgcttctggcaccttgtgcatctccgaacgaattcctttgtgtcatcatacatctatggccaaaagaatccactccaccagatctttgcgtgtgtcctgaatgctccatagtgacctacatatggggcagcatgacacttctcaatgatctgcatgccttcatctgccggaacgcatctccgtagtaagccatctgaacaaactctgt

SEQ ID NO: 67978 - DNA, 5125 bp, Oryza sativa
tttcagttgtggcataattaagctgagctctagtcaacgttttactagcatatgctatagcatggtgttttctatccttagtttgtccaagaacagctcccacggcaaaatcactagcatcgcacatgatttcaaacggcagcgatcaatcaggaggttggatgattggtgctgagatgagtgaatccttaaggattttaaaggactttaaacactcatcatcaaagtcgaacggaacatccttagctagcaaggcagttaagggtctagcgatttttgaaaaatcctttatgaaacgcctatagaaccccgcatgacccaagaagctacggactcccttgacattgacaggaggtggaagctgtcgaattacttcaatttttgctctgtccacctcaattcccctttcggagatttgatgtcccaggactattccttcacgaaccatgaagtggcacttttcccaattaagtatcaagtccttttcttgacatctttgtaagaccttgtttaagttctccaaacaatgatcgaaggatttaccatagactgaaaaatcatccatgaggacttccatgatgtcctcgatcatgtcagagaaaatagacatcatgcatctttgaaatgacgtgggtgcattgcacaacccgaacgacattcttcgatatgcatatgttccgtacgggcacgtgaacgtggtcttacttttatcatcgggatggatggggatttggtgataaccagaatacccatcaagaaaacaaaagacggaatggtttgctagccgctcaagcatttcatcaatgaaaggcagtggaaagtgatccttcttagtagccttgttgagtttcctatagtgaatacacattctccatcccgtgacggttcgttgtgggatcaactcgttgttcgagttttcaacgaccgtcatgcctcccttcttaggcactacttgaacagggctaacccactcactatatggcatgggataaataatcccggcatataggagtttcaagacttccttttttgacgacctccctcatcgcattgtttaacctcttctgaggttccctagatggtgtgcaagatggttctaagggaatgcgatgagtgcagagggccggacttatgccttttaagtcttggagggaatagccaaaagaaacatgatgcttttctaaaacggtgataagttgggtcgtctccctctcagagagtttgtcacttataatgactggagactccgcatcaccgtttagaaatgcatagtgtaggcctgaaggtaagggctttagctcaattggggcacgtgacggctgatccatttttggcagttcaatcgtttctccagattcatcctccccttcattgaattcttcgatggattcattgaaatagactctggggcctcgaatggagaaatggccatcaccttctcaattggttcaggaataggaagaggctccgtcaatgaattgattgattgcaacacaaggacagaggtggcgattcttcctatgttcaggttgaggacaccggattcgggcatatctaagagtttctctatgggatggcctatgagtatgtcgaaatcagatatatcgaacacatgaaaatctaagatgacctcaacgctgttgtgccgtgtgggcactccagagataatccctaaaccttcggtagtagagtttgtggaaattcggaaggttttgacggttggttccaacggtttgtcccctaagcaatcaaatgcaaaggttgctgacataatattggcaccaacagagggattatacagaacacggaccaaattacctccaatgagacacgtaatggttgaggagtggcatcgtatctgaatcgattcagatgagagctctccttcccttaaacattcattactcacgatggtggtcaacttcttcaccgtctctttaagcatagctttatcgagaggttcattagaattgaccttggtcggtggtctcttctcgcaggaataattcgaggtgttctcataatctttgaaaagatcctcctcgaattggaatggaatttccggaggatgaatttcttcttcctccggctcctgcgactgggatgaggattcgatagttgagtcgggttccgactccacgtgcagaggttcctcatggataatctcgacctccgggacggcttcgctttggccaaaagaatcattctcgaagataagatctaagagttctcttccttcgacagttgtcttatgtgcaaacgatcctccagcggaaatatcgagattttcaacagactccttatctaacctgtaccaaaaatgttgtaacaacacatggtcatgtaaagacaagtctgggccaaactgagttaacagtgagaaccttactcaggctgcaccgagggattccttctcgttgtcggaaagaaaggatgtctaatcgaagattgattacacaggttaatggaaagaaagtaaggcagaaattgcacttaagctactcccattcaccgtggaatttcttgacagacatagtgtaccattgcttcgcttcatctctatgagaaaaatgaaacaatttccacttaagagtttcatgtgtcatgcctacgatggatatgcaagaacacactagctcaaagtcccgaagatggaggtatgggttttcactgatactactagagaaggttttctctcgaaccatggctataaagccaggactgatttcatagccatccgaaagggttggttttgaagaacacgatggctcacaaagattagcccgaggagcagaaaggttttgaattgtgggttgctccattaaggaaaggaataaaagaagaagaaataaaaataaagattagcaaccgttctccggcaacggcgccagaaatgcttgttggtatttcttacgaccacagataaatccgcaagcgcacggaataccgctgtagcacttcaccttcgggtgaccccaaaaggatatcgaactcagggaacgcgtgtaatctacctaaggctaaggcaatccagggacaacaactataggtaggctaggcaagctagagaagacattctatgtgttttaattatctaagctaagcaaaggtaatttcctatctgttgcttcgggcaccgacccctgctggtctgccagcgtggttccggctatagctctatgatgtatccgaacgtggaggattattgggacgggattcaaagctatcaccacctgccgcctacctctgacaaatccgtggaatacacaataaacaaaggtaatctgtaacctagacaccacgtctaagttattaattactactctaatacttgtacatgaacttccttctttatcaagagtcctagtactagagcacttagtatgaatactaaacaatgaacccgcaaagatgaaaacctatcttacttagactaaataattaaataacataagaaaggaacacgaatgcttactttatagaagaagttctccgaacctggagcagagtgtaccgacagctccggtactcctctagaattcctcctaagaagctacactcgtcgaggtagaaatcggatgagcgccaaacttccgggcactcctccagagcttccccttactctctaccttattctaatgtacaaaagatacaatagagcctcttgtaattcagctcaaagttgtgtctattggaatgtgagtgagctcctccttatataggctccaaatgacagttaggggcatgggaattgtctaaaacaacctgcaaccgcctctgggaagaaatccgagccgtctaggtgaaagcagatggcgggaagcgctaggattggttcggccgaacccaaaaactctcctcccggcctctccttgggctgggaggttgcttattgggcccccaacaacctgggctatgttttggcccaattctaaatggtttttattgacttattgggcatctaatccgtgtaaatatgtcctgaatacgcggagatgcattttgtcatatgacggatgtgttttctcctcaaattacttgcatacacatatttcaccaacactagtggaaatgattagtaataatacctaccactaagttggataccatgttttatttcattatatacaggtattgacggtcagatattatgatttaaggaccgtcaacaatattcaccaacactcgtggaaattgttagtaataaatcctatcaataggtttaatatttcattgatttgcttttttacaggaattgatagttatatttggtatttaaggaccgtcaacaatttcaaaacatgagtaggtattacctctcatcgagagggcctaaggctgtattcgataccaggagttcctaactcccccctctcgttttccacgtgcacgcttttcaaactaccaaacaatgtgtttttttacaaaaagtttatatacgaaagttgcttaaaaaatcatattgatccatttttgaaaaaaagctaattcttaattaatcacgcgctaatggaccgctccattttccgtgtgagggtgatgggttcccaacaccaaccaacgtgcacagcctaaacctgtctaaacctttgtcctgatatccatccaaatttagatctcatacgctaccccttttactactgttgatataggacactgacagttggcgcgccatgtaggggttgcatcaagttttacaatgacaatcgtgatgaaatcatctttaggagtcgtcagatttgtcttccctccaaggaagacatttagtttcggcagttttgactttctcaccgacaacttcagcaagcattcagtcttcgactcagattcaaacaagttggcggggttcgagacttcctcggtcccttttggtctctcgaatgcggctgtggcccactccagatcggatttccatggctcggcctcaaattggccaggggagtcaatgccactagcttacccggacaacatctccaacaacggcggcaaactaccctaagattctgatgcaactctctccgcttctcgctgcgacgatttgggacctacaccgtccccgtgaattcaatccaggcatgattcgaccatgtccgaacatggtcccagggaagtaagcctcctgatt

SEQ ID NO: 67979 - DNA, 23829 bp, Oryza sativa
atgtgacaacatcatccaaactacaacaaaacagcattgctgttgtaatgctacttgacaccctaatcgatgccttagacaacgccatgactctgatgctcatcaaggtcaatgccatgatggtcaccgcggtcgcacaataggaaagggagctagaggcactcagcgaccaagccaaccgccagaggagtctattaccaacacacccaagactccatcgggcaaccgaccaagcaaatggccatctcttcacctttcaagggaccgccggtcagccgagagcagtcggggccacacagcctcaaatcttcaacactgcgagcagaataacggaacaaatcctttcgtcgaaaaccgtgataacaatcatcgtgaagacgaccaccatgaaagtgaccatagacaggaagacgaccacgggcatcgggaaggcaaagacctcaggattgaacaacaccgtcgtcgccgagagagaagaccaggatcgctgcagttcaccactccccccccccggtcgacccatataacctgattatgctgatgaaggaatagcaacttttacccgagacctacgtcgagtggactggccggccgacttcaatccagctggtatcgagaagtacggcggtaaaaccgaccctgagtcgtggctcaccatctacaccttggccattcgcgcagcaggaggagatagcaaagccatggcaaactacttgcctgtggcactcactgattcaacaagaagctggcctttggggcttcgagatcggtttgttgcaaattttcaaggcacctacgagaggcccgggatacagttcgacgtttaccacgtcatacaactgaaaaataaattattaaaggacttcatccggcgtttcttcgagacatgcaacaagattccagaagacacaaacaatgtcatcatcgttaattttcagaaaggaattcgtgacgaaaatctcatcggcaagttcacccgcaagccgccacttaccgtcatgaagctcttcaaaacagccaattcagccgaagccatcaatattgtgcgggaggacaagcagtctagtgctccacatctggtgaaggataataatgaatatcacaagaaggatcgcaatcgacgacctggaaacttggtggccacaacgtcttattgtcagtcacattgtccgagtgctagaaattacaaccgaatcttgaacgggcccagtccaaatcacccaaattccaaacaccctgctaaggactgagtttgttgaagaccgtgctaagcagttgaagctagcagctggaaaaggaacttcaggacagaacaatgacaatactgtccggatggtttccaaattccaatacccagaattgagctaaaccacatatttggtggccctttagcttataagttcaagagaaagcagaagctgatcgatcatcatatcaacataatacacttggtgaataacaattctcaaaacacgagtagggtattacctctcatcgagcctgaacttatctaaacttttatccatacaatccatccacttttaaatctcgtacgctagcccttttagtatcgcctatatagaacatcgacagtttattaatttccgtattcaccaatgccagtgccgtgtgccatccgaaaccactacaaatatgctcgaggttgaaaattctgtaattgaaattatggttggaatatgtcaaaataaagtctagagttgatatagactactggacctccataaatgtttaccattggaacacagtattagtcctagctagtcaataggtgggaagtaattcgacaagtaggtactggtattggatatacaaagagtttatgaggatgtttgtccatccaatagacatatatccaaatatatatgaatcttgtttgaattttcgatccataaatcaaccgagatctagttctatgccaaatttttacttgttcccacaatcccgtttcggcaccaatttttaagttgctgctgaccttattttttcacctgggaattaaaatgtcaacgagacatgcaggaatggaatggaatagataatggatacacttccgaagttcttaaacagtgtgttttttctaataactttcaatatatatatgaatttcttagaatacctttcaaaaaataatttttgaatttaatttgtaatagttagttcgttcttttgtaccttcaaataattatcacaaataattcatccactcatccattccattccattctattcagcacaaaagagtggttgttcgaacatgccatgttaacatttctaactttgcctaaataccatcgaccatttgcatgcaacggtgaccatatatactttctttatacagacataataatcttctgctattatatcgaccattcagaagttttccatggtaaacactagggacaaaatcgtggagccaaatcatctcaccttctaattaaaaaaagcatctcacctgcttcactcacttttcttttcatcagggaattagtttgagtgaactaaatcaatccataggtacattaaagctatatccctggtagtattctgaattaaacagaagaaaatgaacctcatgcatactgcaacaaagctctactatgcgcctctaatttttctccttctactggctactctatatatgcaacactatatatgtacatctaaaaaaaatatagcatgattgtcaccttgtcctcgctcttgattttttgaattatcgtggcgactaaaaaaatgatgtagacccctctttggaagagaacacaatgattggagctaatctctctaatatactccctcgatccgtcctaaaatataagtatttttagcatagtgtcaagtcaaatatttgtaacgttggctattaatagaaaaaaaaaattaaaaagatcaatcatgtaaaattaatgttactagatttatcattaaacaaactattacaatatacaactctttttttgaatatcattgatcaaagtagtatctggaagaccatgtcgaagtccaaacgtgcttatattttggggcggagggaatacaaacagcaaaacatgaaggactctcattattcaaaactgagcaaaatagtcgttgtcaaaaccaacgaaagcaatctctaaaataaacaaaaaactgtgaaagcatgggaagaacttggcatcattcagacatccaatccccgagctgacagacgttatagacacaggcatatgtacagagcgcagttagctgcgacgttgctttccaacttcaaaatgatggttaattaatcaaatgattgatctacttgatgaattgttgcacatgcagtaaagaattaataatgctgcttgttatggaaaaatcctggattcgaggacaaattaaagtcgatcagacaggagaggaaaatggcaacatttgataaaaggacaaggctgattagaaagatcatgtcaacagtatcttaaagcagttgaatgatctgttatttttagctaaggtaatttaattatatattcaattggatgatcatgtcaacagtttctttaaaaaatagctgatttctaaaggcctcgactagagagggtcgagaaactcataggtaattaaatgaattatggaccacctgtaaaaacaatctaacataaaaacatgtaatactccctgcggctcaaaatataacaatttggccccgttcgtttcttcggtaaggataggataaaattttaaattctcgtggcacatttttcaaactgctaaacgatacattttgtgaaaaactttatatatgaaagttgatctaaaatatcagattaatccattttttaagtttgtaatatttaaaactcaattaatcacaagttattatcacctcgttttgcgtgaaacacttaatctttatcttcctaaggagattcaaacaccacttttgtagcctttaagatttgccccaaattataacaacttcttcaccaacattctttttccaaccaatcacaaccctccaccattcaatttttccacctacctacacttcgcatccaatcacaaacttctcccatttaattttttttaacttgttaataaccgtcttatattctacaacggaggtaatattacttttttggacctaaaagcagaaaagcacatgtcactggtgcagaaattatttttacaggtggcgcattacccctttacgtgggcgtttctcaacccgcctctaggtgaggcttttagaaatcagctatttttgataggtgcatgaaagaacaccgcacgtgaaacaaatttagtctcagcctgcaaaactacgattttcacaggttttttcataaaccggccgctagttgtgttggataattgaagaataaaataaaattgcagcacctatgcagcattgcatgcccatagggatgaaaactgagcagatatgaacaaataatgccataccatatttgttttttttattttcttccagatatgaaaacgaatatgaatatatcacatatggaaacaaatatgaattatctcaaacacaaataaggataaaatatgatcaggcatgaatacataaacaaatattcccttgaacatgaaagccacctaatagaatcaaataaatgtctaattgatactaaaatatataaagtatagtataatttataaaaatatttataggtctaaataatattaataatgtagactactgattaaagaggtagctaggttgaaggtctagagctagaaagaaatggggtatatttcattcctttagtggatatgcgaatagcatatatatatatatatatatatatatatatatatatatatatatatatatatatatatatatatatatatatatatatatatatgtatccgtatccggactatccgctccaaatggtacccatatttgtcagtactaccatagagacagtgtatctatatgtgtagtggcgatggagagagatacaatggcgggggcgaagccaggatttgagattaggagggtgtggagtgaagataaaccatgagaccaaacaacttatattgatagcaaaggaagtgaaatagttaacgtaaataataagcaatacgtaaactagtccttttaagagaaacttgaattttagctctttaataatatcattgtaagtttgaaactagtctttattgctaaattcttttaatgtaaactattaaataatctcacaaataagtatcatctattttactttgaaaaagatgagaaatcacaaactaattttgtagatcatgtttattgctaatatttttagacttgctaactaactaaactgataatactttcaaagcaaaatttgctacaggacattcaaaaaacgtgtaattagctaggagacaccacaagaatgtgtatttgctatagagcatcgtaaaaaactggtaattagctgatggacaccaatgaaattattttattatatttgaaggaatatgagagagaaacaagcattaaagaccagtttacccttgcctcaaattagttagtcttcactaatcacatattctcatcgccaagaaaagagcaagagagaggagaagacacggctggccacgccaccgtcactctctcgagcgcagcagcagagtcgtgtcgtttcctccgagggcagcagcagtcaccactgccaccgccgctttctcgagcgcagccgtcgccgctcccttcacgctgccgttaccgcgcaccggaccacgcgcaccctctgcgccgtcgtcgccgctccctttctccgcgcataggaaccatcgtcgcatctcccattttccggaagaagcaaccgccgccgctgccgcttcctttctccacgtgcagcagctgtgctgccaccacagctccctccctccgcaagttgccgctgcgccgccatatgaccgtgcgaggcgtggcgtcggcgccggcgggcggaggcggctgttcggtgcgttccggcggctgcgggtgcggtggctagtggcgttgtaccgccgctcgctgcggcggctgcgcgcgtactacaccaaggcggtccaagacttcctcgagggcgcgacggccatgagcacgctgcatgcactcgtaggctgccaccgactgctcgtttggcgccgtgttcacgccgatggtcgtcgtgaaacaataacaccagtggttgccgctcctccttcgctcgcaggacatgaagaaatggagcagtagcaccggtgacggcaggcgagcgaaggagcggcggcgacaggcgagcgcagctggtggagcggcgacggcgggcgagcttaggaggagcggcggcggtggcaggcgagtgtggcgggcggagcggcgacggcgacggcgacggcgggcgagcttaggaggagcaggagcggcgggcgagtgccacgacgacaggcgaagcggcagcgagcaaggttgaaggcagcggttgagagcagagagagaatgagagagggagtaaaggatatggaagaaaaaaagaaaaagaaaaaaaatcaaagggtagaaccgtacttacatagctgtttctctcttcaatttttccagatataataaaataatcccacgggtgtccagcagctaattaccacttttttgtggtgccctacagcaaaaacgcgttcttacggtgtctcctagctaattacacgttttttagatattctgtagcaaaatttgcctactttcaagctacacaaaataaactagataaatacttatcttagctaacttaatatagagtaaaaacatgggggtgtagtggtggtagtgtttggatagaggggtgttggcacctttagcaccccctacctgcgccactgcctccagccacgcctcctcctcgccagtgtcgcccgtgaaagctgctcctatcgttgccctatgcagaccatcgtatacactccgccccgctgattaactccgcctcggccttggcctctgcctccacgccatccccggtcacctcttcctccatggccccctcatccttgtcatcggcgtcatcaccatcctcatcagagttttaaataaataagttgttattttttattgtttttatatgtaaatcattttacatatgctacacaaaacattttgcgatattcagtgtcaaagaaatattttatgatattatcttctgttttaagtgattcccccctcatatgcaaaataaaaaagaagagtagcctttcaaaaagaagaaaaatacatgcatgaaagaaaccttaaaaaatatacagaaacttctatatattttgtgtagagcctagagaaattcatatatttttgaagagaaaaactagcgaagatgtaccgtccattaatggttataagaaaaggacatccttttttatcgcttggatgtaacctttgtgcgtaccatatcctatcttcctatcccttctttctatatagttaaagacccaaagctaaattgtggttgagccacgtcacctgtaaatctcagccattgaatatgatctgaacgcttggtaacgcttcaatcccagcccacttctccttccggcccgtttggttggggggagtttttagaagggattgggagtttagagggatgaggctattaactattttatttggttgggagatatgagaattttggtgggatggggatggggaattgagaaatgaactccctccttttcaatacctggatagggggtggtaattgggagggaattcctcctttacttcgcctaaacaaatctcagccatccgttttcattaatgatctgatctccatctaaactccctatcaatttccaccacctaccaaacaagagactgggatgaaaaatcaaattcacatcttaatctcaccatcaatttcctcgtgtaaactcccaatccccttccctcaagttaccaaacaagccgttcattgccatccgccctaccgataccgccaccagatgtggtcgcgctcccttctcctgcacccgtgctccttctccgccccgcacggcgccgcgctcgcgctcttttctgcttcgcacccgagcgcgcgtgagagagatgcgccgcggagcgctccttcccctcgatcccccgctgtcgctgcgctctcttcttctctgcccccgtgcgcacgcgagagagatgcgccgcgggcccgccgacccccgccgcgccggttccccccatcgcgcgcttctcctccccacgtcgcactgctccccccatcccccacacggcagccacgccgcagcgccgcgcgcctgtagccctagccaggtgcggctgcaggtatcgcgtgatggaggatgcgctgggagccctagcgccatgccggtattcacttccttccttaatcacccgcatttacaatagaaactgccaaatcaattgggtgaggaggcgaaccgccaaatcaattgggtgaggaggtgcagtggttaatacaattcatgtgccccttctgatttgtcttttataattctcttgcaaaccttttgataggcctcttgcaatccggcctctcctcaaatccatacatccctcacatcaaccgttctgtgtgcaagcctcaaccacgcaccccttcatcctacaagggcacatgattgcaatcgagtcatgtaaggttagttgtcgacaacctttatcgattcattgcatgtaagcctattgactgattttatatgtctgaattggttatttgccctgagtactgattttaatttcttaaaaaaaatgtcaatttattctatttggtaaacctgaacttgatatgaaatttgaccggattctatttgagtgtgcattatgatttaaactaatctgaggcagtatgaaaggtctgtcgattggtttctctgaacctaaaagaaattaatccctatcctatacactagctgttgttttagtttgtttatgagagattcgtgatccctgcatcctatacttatacttcctccgttccaaaaaaaggcaaatcctaggtttccgtgtccaactttgacagtccgtcttatatgaaatttttttataatttatattttcattgttgttagatgataaaacatgattaatattttatgcgtgacttgtctttttaatttttttcataattttttcaaataagacggacggtcaaatatttggcacggaaaccagggtttgtcttttttgggacggagggagtatgttctaacacttcaatttatttgagcagttgggaaggacccagaggattgctatatagttgtcctgacatagcgaggagcagcaacttactcggtatgtattttgttcggctcttcgcacacaattcatgtttttcctacgactttctataaatgtaaataaataatctttatcctatgcactggctatttttccaattacttaagaaaaaaaccgtgatgcttgcagcggatacttatatttcctaccactttagtttgtttgagcagttggggagataccagggatcgctacacaagtgtcctgatgtagcgaggaaccgcatacctgctcggtatgtcttctgttcagctcatcctgtgaggcacttcagtacgtgtgaattccacatgatttttgtctcaattaaatttcagatatattgaggtaaaaaaaaagatcatgcagaacataccgcatttgtcgcagtgaaagaacttatccacaccaccagttctgaaaaaaattgagcatatccaaaattgatcaaactgaataaaacagtaaatgcagaaaataattcatagagatagatttgggacttgcctgcatatgccgcatccatcacagtgatactggttctttgagacctggaacaaaccaaacaaatatatttgtcaggatttatgaaccataattgccacattagaaacttagatgtaacgtagaatcatcatttataatccaaaaatgcttacatcatcatcaaagaagttgcatttttcacagaagtatttccccatgcatgccccacaaccagagcagtactttgtacccgtcgatcaaagcgaacaattttcatgtgatcagcacagaaaaaaaagttagcacactccagaaattctactgttgtacactcgagaaattctactgttgtactgttgcacgcgcaggaaagctatgcactgagtgctgttttcgtttgttaaaaaagaaactatcctatgcactggctatttttccagtttcttaagaaaaaaaaccctgatacttgcagctaatacttatattccattgactttaatttgtttgagcagttggggagataccagagaattgctagataagtgtcctgcatagcgagggatcgcagacctgctcggtacgccttctgttcagctgatcctgtgctattcctaaaaagatcttgctgttcctaaaaaaattctgcttgcaatgtttccagtataagtttgagagattttgtgattgtgactataaatttgcaactccttggacttgaaatgagttttccttgcttggtacttttagcaattaatgatgcaaatatcatatttaattggtcaagtagcagaactactcacttttgaaattatatactatgttatatcctatttggtcaggtagcacaactgcccacttatatcttcattcttccctccataatttttttatacattttaatattatgtgtgcatgtagctaaatctaaaggagtttttgttgcttctaatgttcccaggtcatatgttgaaaggagtaaaacgcagctccacattgttagcttatgaccttgatgccgtttcaaggttttcttacttgagtgcatattttgcgtatcagtttgtttttagaactaaacaatacaatctgattgttcatatttacatgcatatttcatcttttctaatgtgcccgtcgcaatacgcggggtttcatctagtattattggtacctaatacctattaagtggtatttaatcttataaaataagatatataagaagccacatcgtcaataattttaagctatcaaatggtattagtacaaatataacaactgttggatcaagaagctacttatccatctaattcaattatttattagtcgtacatccaccttcctttactcttcctcatagtcactcgtagcacttttacctattttgcacataacaccgtgtttttctcttccaagtctagaaaattagtgctaacttttttcgaatacaatttaaattatattttaagatgttagttttgctttattatgcatgattagatagcaaataatataattattatgtattgtcgacgtttgagatcgcgactacggtatttggacggtatggggatcgttggtatcagggtatatgcgagattgaggtcaaagagatagagacagggatttttatacaggttccggccacttatctgacatgtaatagccctacatcctgttggccgaagccggtgttgctcctttattcatcataatcacaccagtacaataattgggataacttgtctagctgtcgtcgacttggcggcatggataaccaattcgtggtcgacgacagggtagtcttcctcctcgaatacgaactcgtcgagatcagagatggcactagatccctcttgtcggccttcgtaggcaccgtattgggtttgtctaggcttatctctgatgttgatatctagcagcgtattggtttgtgtatatgttgtgtcttgtggcttgtcccctctcttcctagggggcttgtatttatacccataaatgcccccttgtccaaatagaactagggagaccaatatggatacaatccgagtagttcttgtcgtttccatgtagaactctagtcgttcttcgacatggtacatggtgggccctgccgagcttagtcaagtactattaggtatgtggtattcataaccatgacatgcatctttacttgaacctattttcagaacaagtctgagtgaagtagagagatgcaaactatctagctgcaacgatacctatattgtgcataaaaataatattcatatattataacaacacacaattacactttaaaaaataaagcatgaattgtattgtaataacttatgtatacataaatccacattatcatatattttgtgcatacaaagagttgcacctaaccatttaaaacttccactactacagatcctatttttccgtgcgggcgttctgattatcccgtgtggtggtccggcccgtctgcagccacgtgtctgggaaaatcggtattttcgtgtgcgggcgggctgaccgcacgggataatagattatcccgtgcggtcgtgttatacggaccacacgggataatcgtttatcccgtgccttccaattataccgcccgcatgcaacaaaaaaaacaaaaaaataataaaaaaaaccctaccctaaccctagaaacggccgccgccgctcgcgagcagcacgccgccgtcacccgagctcagcgcacccggatccacacttcgtcatcgtcccgcccactgccaagccgcgcggggccccgccgccgtccgcgcccgctgtgcgtgcacgcagagccagcagcatcgcctcgtcgtcatcgttgtcgcgcccgccgccgctcgttcgctcgcggagccgccgcaccgcctccgccagcagccgccgcgccgcctcgtcggcggcggcggcagcggcgctcgatcggtggggaggggaggagaggaaagaggcagagagaggagagaaaagcggcagagagaggggaggggaggagatcgaggagagtaaagggggagagagaataaaaaggaagaagagagagagtgtgtgtgtgaaaaatttgaagtgggtgggagggaaaagtgggagagtatttttcggtgtggtccacttaaaaagcccgcacgcgaaaatcgatttttccgtgcagtcctcttaagtcgaccgcacgggaaaatgcatttttccgtgtgggcaagagcccaggtccgatccacggattttttcaggcggagctacttatggtccgcctgaaaactaccggggccggcgtccagtctagtagtgttcgactttgttcggcaagtatgatacaaacatgggccatacaggtgtctctttctgctagactaatcgcgtgttcaccagcccatagagagcaaccgtacctattccgagcaccacacgttatagtctcccaaattatgggccaaaaaagctggacctatatatacttctaactgtgtgagaaagagcgagagatgaataattcataaatttcacatgttgtcgtgactcgtgaactgaatatcagacgctattatcaactaacacaacaaaatctatcttacaatacactttttaccaagtgtaatcatattgtactattaatctctccattttatatcataagtcgctttaaatttttttctagtccaacctttttgagtttaatcaagtttataaaaaaatattataatatttttaatatgaaataaatatattatcaaaataaattcaatgttacataatgatactatttttttagtgttgtagttgttgataaattttttaataaacttggtcaaacctaaaagaaattgactagaaaaaaataaaaacgactaatggtatgaaacggagggagtagcatttaggctcttcatgtatcgtgacaaaagattgttctgagttttgtctttaaggccgagtttagttacaaacttttttttcaaacttacaactattttatcacatcaaaacttttctacacacataaacttctaacttttccgtcgcatcgttccaatttcaatcaaacttccaattttggtgtgaactaaacacaccctaacagttcaggtagtgctcaaatggttggatgaatggacagtgcacatgtacatacacagttgcttgctaagacatgtaaatacacttagtattttgcttatgtagttcatgcaaatcatgcacagatagtttcctttgtttaatggctatcttgtccattggattgcctatcttataattttataggatttctcatcacattaggcatgcccatttgtgaaaaaaaaatttgctaagcccatgatttttttttttgcaactaatgctacatgtagtaaaatcttcagcagaaaaaaaactacctatgagtattttggtttgtcacatgcacatcacaatagtcatgagctaaataaagtttgtcattttctgaattccaatgtgccttcctttatatgtcaaattcatttttttatgcagaggaccttatacttgcaattaatggtgttttcttctacagaaccctccatcaagctagtaagctaataagtctataacccaagttgacaggaaacaagttgactcccattttttgtcaggactcatgaaagtgaaaaacactttcttaactatgggttcttggattgtaaataatggggaacaaataagattttgggaagataaatggctaggaaatatggcttatagagaaaagtatccatctttatatgctattgtcagaaagagaaattcttctgttgctagtgttatggcttttgttccgctcaatgtttcttttaggagagctttagttggtcagaatttaacactttggtatgaattgtgtgcatctattgttcatattaagttgaataatatttctgattgttttagatggaactatcatcagaatggccaattctcggttagatcaatgtacttatctttaattaacaatggttacattgaaaaaataagttaatttggaagcttaagatgctgcttaagatcaagatctttatgtggtacttgcttaagggagttgtgttaaccaaggataatttagcaagacggaattggaatggtaatttaagatgttgtttttgtatgaaaaatgagtctatccaatatttgttcattgattgtcattttgtaaagtttatttggagagcagttcagttttcttttggtttatatattcctactagcatatctcatggtttttatgattggcttcagggagtggtaaacaaaaagagcaaactgatacttgttggagcatctgttttgtgttgggctttgtggttgagtaggaatgatagggtttttgacaaatcacctaccattacctatatgtaggttatttttaaggcaacatattggcttcgtctgtgggcacagttacaaaagtgtgatgaagatggagaattctaattgttgcatgtcgtaagcttgaaacgatggttatgcaactgtttgccaatcatgaatggaaatttaccaatagactggaataatgttattttgtatagtttggtttccttttaattttggttggtgtgtttgcttttatttggactacactctcttatagagtgctactccctccatcccaaaatgtaagtatttttagctatgaatctggacatctgtatccagattcatagctaaaaattgctatattttgggacggaggtggtagattataataattggctgtagctcttttgtgcaaatgccgggatgttattttattccattatctaaaaaatcaagctagaaggagttgcgagttgcaacctcccccctcctactctctcttccttggttgtacctttttcatccatgttttcccattagctttcagttcaaatgaaccacggttagtttaccatatagttgttttcaacatgattgtttcttaagcagacaaggaagtttgcgatcaccctaatgagcgcattccgcggtagtgagcagacaagatttttttgcttcttttgcaaacatgaattcagttcctctgcttagattgctatgaaaataccaataggccacttcatagctgtatacctgtatcatgtcaattatcaaaccatgcttgcacatccaagaaaagtgtgtgcagcggattattgcagatatactttgatacagtaagtgaagaggaggaatttggatacatttatatgataaataatttccagtgctatgatttcagctgccaaatttacaattttcatgtacaccgggatattcttcttggatgcattcattaacttcaaactatatatgataaggaatttcagtgttatgatgctacctgccaaatttagattgttcacgttgacaggggatacttttttggatgtatttataattaataaattcaaattctttaacaatttatgtgttatcttctgtgtagataacaatttcaaaatttttcagacgcagaagactccaaagctcctattcctgcaaatgacaggagatactccaaagctgtcatcgacaggcttcctatagcttaaatgcttaattattagagtgttattcacttctgtaaaactgatctttgctcggtcgacccaaaaccataatagttccggaactaaaaataatctttagccccggttaaaaaccccacagctattctatgatctttagtcccagttggtatctttagtcccggttcatcccctgttagagacatgtcagggggccgaggatctttagggactaaagatcactttagtcccggttggtattaccaaccggaactaaaattcaatacgtagtatataatcccaaacacttatcctctcctccacaatcgcaaccacttattcacacagatcgatcctccccttcctcctccccttcccctctcctacaaatattacacagatctttcctcccattcctcctctcctcccctctcctccccctcctcccctttctcctcccggcagtggcgggcaggtggccagcggggccgcgcgcggcggcggccgtggcgggcggcggcaggcggcggcccacattgttttcttttcttttttttataatttgtgattcactaagatgtataatgttgtgattcattgtacatttgtatagatctgagatgtataatctgtgtgatgtattttatttgtttgtaattttttgaggatttgtgatgtactacctccgtttcatattataaaagtttctagcattgcccacattcatataaatattaatgaatttagacattcatatatatttagattcattaacacccatatgaatgtgggcaatgctagaaagtcttataacctgaaacagaggaagtatttgatttgtgtgtataagtaactttaagatttgtgatgtggatttgggatgttactttgatttgaggatttagggtttgatttggggatatgtatgccactcgattcaggagaaaaaaaaagggaccatctggactgccgctaacctctttagttccggttggtgttaccaaccttattatcacccactgagaaaacatttgaagatgcatgcatgttgccacaccttgcatagattcagaatgtcgacctaaaaagagaggtgttcgccacttaaattcagagcttgtaattgcaccaagagtcttaagactaaagtatacgccattcctgaatgactcaagaccaagacttgattgttcaggttcagataggatatcaaagctacatggattttttcttatacaattgcttgtttagagtaattgccctactagacaggagtgggtccactattgattcaagggtattcagatgtatacccaagattttttaataaaaataagtacatatacattacatatatgtattaaaaaataatttaaaaaagcttcaaacagcccaacaagcaatcaaactactctttttgggcctgcttcatcctttggcccattggcgccggcccaaatttctcacccggccactccctctcaggcctcagcccgcactcccagcccactccctttctctccccctcccctaatcctagcttctgcctgttgtggaggcggaggtgcgcggcgcgcggcgggaggcgactcgcaaggcggcgcggcgtgcggcggcgggcggccggctgcggactgcggcgcgtcggccagcaagtcgcgaggcggccggcagtcctgttactcctggacagcagcacaggtagtcggggatggggagtgattgtcgcattatctgattgaagatttgtagtataaatattgaattcactgatttcatgatttattctacacttctacttatctaaatatctagtataattgcttagttggtagaaccattgtttatttgtttagttacattcattgaaagagaattcttcttgcaagttaaggataaggacatcatcacttatttttaaaatatcaagcatcgaaaagttgatttctaaattgtaaaatttcttcccaatttattcttttctatcctttatgtattctatatgttggtactttgatatattaccaattagtatttctataagttaaacaatttcaagtaatgatcaattttatctttgtgtgaacttatgctcgattttattttatatcgctatatattatataattattaatgtgtgatactataaaagctaaggcttttaggtgtatgaacaaatttttttaccctttcctatttcaaatacacaagttgaaaatgttagcccccccactgctactagacaagcttggtctagctcggtctgttactcaggtttcgttgtctagctcatgaatctggtaattccactgtaatgtaagcgcactatactaatactcctactacttctaaaaagaagagagaaaatctgcatgtggggtcctctactgagctgtcaatcaagtaaggtcgaaccgtttggtgacatgatttattttccttaattttacgaaactggagttttccataattttactactatcatttctgtccatacaaaaccatgataccatacagacaacaattttctgtacactgacgttttacatggaattgaagacaaatattaaataatatttctatggcacaagcgtaaatacattggtaatatccttcaaaactagatcaaatcttgctagtacatatgatacgttcgataaaaaatacttgatgatatattataaaaatcgacactgatgaaaccaataatacctactcaggtggtgtttgaatcttctgaagatgaaaatgaagattagatgtttcacgcaaaacgaggtgataataatatgttattaattaagttttaattattataaactttaaaaataaattaatttgatattttagagcaactttcatatagaaagttttcgtacgaaacacatcgtttaacagttttaaaaacgtgccacgataatccgaagtggatggcgcacagttttgacggactcatacagggatgaggtgtgactgaggtggctgtcatgtagtagaggtgcatggaggaggcagcatgggatgaatcggctgcttccatgcgagaaagtcacacttatcacgtttatactgtcgacaatatacctacaattgcagcccctgaaaagaatattacaacccccttagaaaaaagaatgaaaaacgctatatgatgttatacaacccagatttctattaaaaaaaaagataaaacgattactcggatcataattgagggtgtcaaagtatacttttttttctttcatctctaaacactaggtatgagtaatccgcgtacggatgcatcatatatgggccgcattgctacactgggcctaactatggtttggacgatggtcgttccaggcttcggtgccagtggcaaaggcaagaccaaataaccacttccatttttcttttccttcgcaaagaatcaaagtccagttgactagtttacgagttgcataaattccacggatgtgaatcagattccaagcattcaacagcacgtccaacgtacacgacaagacgaaatggttacaactaatttactaatcatcatctgggattagcatttttttttctgcctgccagatgctgagatgatttgctttgctgatcacaaaagaaagaacaaacccaacctacagccagctttgaagccccgggtttgttgctgatgcatggcattttccagactggaaacgcagagcaaaaattcgcagcaacggtcctccccccatgtgagccggtggggcccaccgccgcccgctacacgccatcgcgatcccagcgaggtccagccgtgtagtgagcgagagcgagagagagccgttgtgtatacttaacaatgccaccgttgtatatatacaatccgtgttgcaagaaaatcaatcgacataagcaagggaaatatcagcatctgcaaaaatcatctcagattcgttcgccatggcgaggatcccgttcgccgccatcgtcgtcgccatcctctctttcgccatcgccgcggctgcacaggcgcccgcgccgtctcccaccagcgacggtgagggatcggatccttccatgattcagtttcagctgttgtgattttggcctgatttatttgtgaatgtgtgattcagtttcagctgttgtgattttggcctgatttatttgtgaatgtgtgatgagtttgcagggacgtcggtggatcaagggatcgcatacctgctgatgatcgtggcgctggtgctcacctacctcatccaccctctcgacgcctcctccgcctacaagctcttctgagcttatgcagagatctcttcgtcgccatggtgttccttctccttcttggatctcctcctcctcccttttgatagtctagtggtggatctctcattctcggtgtaattaattagtgggatttttatattctttttcagctcgcgttcgtttgtaatttgggtcggtggtactgcgctgaggatcgatttcgcattgtgtatatcattcatcattctttgctgttctcatatgcatttgtatcatgttgggaaatttgttttatccctaagttttggattggatttgttgcttgctccctactcgacggacgtgagcccattaattgcaattgggcttacggaccagctcggcatgggactgtacggatttgggtcaaatctatatctataacttaatataaatattcgtatttttccggtcgtcacctcatatgtgcggtgtttgttttccccctcgcctccccacaaatcccagtcggaattgcatcacccccatccaaaaaaaatccccaatcgaaattcaatcaatcttcacaatgggaattcaatgaaaccccccgaatcccaattgcactaagaatcgggaaacacatcccaaaattggcacaatcaaatcggatgaacacactgcaagaaaattcaaccaatctttatccccgaaaaatcatcccacatacatacatcacaaaactacactccctcctgccggtggatccatccgcggccgccgccaccgccggcggatccatcaccgttggatctagggcgggagggaggcgagaggggaggagggagccgccgccggcccgcggccgccgccaccgccgatggacccaccctccgacgttgccgacaccgccatcgccgccggatctgggacaggagggaggcgagaggggagaagggagccgccgccgccgccgtatccgcccgtagccgccgccaccaccgccggatccacccgcggctaccgccgccgccgccaccaccgccggatctgccgcgggagggaggctagagggggtggagggagccgccgccgccgaccctagagggagaggaggagggggggcgccgccgccgaccctagagggagaggaggagggggggcgccgccgccgtcgctttgagagaggggatcgggggcgccgctcgccggtcgctgctccgcgccgctgcagccgctcgggggaagagggggggcggcgccgccgtcgtcgctcggcgaggaggggggagaggcagggggaagaagggaaatgaatcttagggttagggttagggtttgggtatatttatttaggttaggattaatctggaccgtccattcgatcggacagctccagctgctcccacgtcgggccgccgacctattgggccaccgaatggaggacgcaaaatagacttcaatggagaaaggaaacaggccagacacatagaatagacaaaagggaggaaatataaactttgctatattcggcccaaacatagaaaggaggattttgatttttttttcaattaaataattgttaaatgatttttgtattattaaaaattagcaattaagctctgataattccaataaaattccaaagagcgtaactaatcatggagaatttaataaaattaaatttaatcatgtcattttatttttcacacttgctttacttgtaaattgatttaattatacacctacctacttaaaaataccaaatattttaattaattacataatgtaaattttttttttaactttttctcaatttttttgttctgtacacttcccgttgcaacgcacgggcacctttgctagtaattctaaaaacaataatagtctttttctcttttttagatacacagaacaaacacagaagctcataatacgcgcacactcatacacttatgagtatctccagaaaattggaccggcatatcttaagattgatgaagtcactacaagtgtctcgctgctgacaggtacgtcgcctatcacaagaaaaataattagctataaatacaaacaccactattaagtataggacttgaatggagctagttccaccacaagtaacctaagctcactttgtaatatattcttcaacacattacaaacgcacacaccaacacatacgccttcgagtgactcgattggtaagctattcttataaacggatctaaggaatcggaccggttaccactatgaatgcctccaaaggaccagatcgtatagtatcgcaattagttggcaaggttccttgtggtacaacttgttcatccgtgttccaattttagctcgccatgtgtgctcatatagagggtggtaaagtagcatctttatctcaagttagcttctgatcttagcaatgatagggagaaaatcagctagacactggcacgggatagatcatctcaaccgggtggcaaacctcatatgtgtcgggggagagctcccgtcacgaaccaaaggtcacagatgtaagaagtcatctgtatcgggcattttaccatcacggatgatagttatctcaatcaggccaaaactaaaacccgtcacaaataggtttgaccctacagatgagtcaaactagggcccgtcaccgattagatcatctgtgacaggctcatacttgactcactagtttgggattgatgaagagagggtgagagaaaagaatggaaccactctcacccctaggccctacgacgtggccaacttgcagaagctaggtcgccgccacaagaggatatgaatctagagtgagcttgcatcaattgcttaggaagattcggcaagaggatgcctagatgacacctccaaggagagaagcgacgaaagaaccgccgccgccatccgtcagggtctcaaagagaaccgagaccgagctttcacctggcagccacacttgaggggttgagatggcccgacaacgccctcaggaggggagtgacgcttgaacgccatcgttgctgatccggccaaggccgggctgggttttcgcccgccgtccaccgcctgccgatctaccactgatgcaccattgctccaccgccatctaaacttccgccagcgcatgggcatcactgcaccggtgccccccaccggccaatctccgcgcactgccaccggttgcacctccaccggcctctcctctcgctgcgccggccaccgtctccaagccagcaaagccttgtcatgtcgcactgccacctcggctgcgcctccacgcaccgcggccacctccgccgcgcctctgtgtgcgctgcctccaccgcc

SEQ ID NO: 67980 - DNA, 23166 bp, Oryza sativa
  unsure (1)..(23166): unsure at all n locations
aaaagtataaagaataaagatatcaattaagaggaggccgtgggtgccgcatctacacaaattcgaaaaatttatgatgttcctcctcctcctccatagtcagcaggtcacttttaaagggctgctctacttgctgaagcttcgtgcactgcgatatgtacacatacttcatggatgaaagagcgtgcaatccttcgatggatgatagctccgagcagccaaatagaaacaggtatttgagctgaagatttgtgccggtcggaatggactccatgttacagtactccaaatttagggcgatgagatgagtgaggttctgtagacaggctggaaatgacttatcaagaccaccgcacttgttaatatagagtcgccggagtgatgagggcaaaaccattgcctgttcgcacaccaagttatcgcaccatgagatcttcaggtcctgtaggtgataaagttccgtgaaactaccaacgggtattgattgtagacttctgcagagcctaatctctatggacttgatggatggcagatgttccggggacaagaactgatcaagatttcgcagcatatcacagttgtcaagacatatatactagtgaggcatgaaatggcgttgcttcttctgatactgctgcttgcctgctgcagcattctgccaccaccagtagaaccacaaaaaattgttagtacttcaacacctaatgatgttaaccttagctcttcgagggaaggtaacgaggggattgataggcttctcaagaagatacacttgcgaagctccatcatccttaaagtcggtaggctttctggattaaaccaactaggagaaaagctgtcacccgcaaagctatcgacattaaggcgctgaatccttgacggagggcacaaaccttcggccacaccattgtcatcgttcatcaccctgggtacaggctgatctcgccacagtagaactagtgcctgaaggtattgcttgtcaatgagtctagcctcaacagcctcttccttgctcttaacattatagatagaactgatagttagcgttccactgagctgattcatgcccttcagctcactaatcttccgcccattccctatcccaactgtaaaatgtatcaagttccgtagaagagacatatttccaagcccacttatctctgataatttcggagagcaacccattggcagtgctagacgacgcaagttgattagctttgtgacatccggactaataacttccagactagaactacttgcatcaagcacttgtaagcagtaaaggcaccataatttttctggcaattcttgtacatggctacgagatatatcaagataacggagactgtgcaactcaccaatgctttcaggtaacctgaccagcatgcaaccttttaagctcaaaaataggatattagagagctgattaaaccaggtaatctcaaacatgaggatggttccaaacttaagtgaatgcaatttattcaaatactgaatatctcttgtttggctcagggactcgctgtccacctcgactgacatatagcgaactgcatgcggcattctcctctggttctgatagctcaaatcctgcatcaagaagcacttgtccacggagatggactgcgccatatcatggatcaagtcatgcattacatatctactttgatcaaggcaattggtatcagtttgaagaagaaacctgcctcttaaatcatccaaatacctaatccctatgtcttcaagacgcatgctcccttctggtgcaacgaagccctgtgccacccacatgccaacaatctcatctcgttcgaagctataaccctttggaaacatggagcaaaatgcaaagcaactcttaagttcttgtgggagatgtaagtagctcagttgaagggctggtaatatatcattgtctcgatttggcagctcccatagttccttgttctgaacagtcttccaatgttgcacagtcagctccatattcaacaggcgtccaatagttttggcagccaaaggagacccgcataacctagaagcaatgcttcgaccaatatcatgcaattgaggatatgactcagggcactgtttaccaaatgcacacttcttgaagaactcccaaaatatatctctatccaatccctcgattcggaaaggattacagttgttgctagcgacaagattagcaacatctggagatcttgtagttactaagatcatgcttccttcaaacccatacctcaatggtgcaaaaaatgtttcccattcgtccttggcattaggccacatatcatcaagcactaaaaggaactttcgtctcctcagttgcttcctcaattccacctgaagagcgtctaaactgttcgatgatttgtactctttcctggtgatggactcaatgatctcttttgttatccttttcttgttgaagaggtccgaaatacagacccaaattctcttgccaaagtgagcttccacccttggatcattgtagatgaactgagccagggtagtcttccccaccccaccaatgctaacaatcggcaagacagaaacattgctgacgaatttggcctgagcaagtctaggcctggccctgatactctctctttttagttgcttcgctttggatgctgatgtggcaactgtgcccaccgctgctctctttcatttcgcccgtgcggcaccaccactcctggtgagtggcacgtgcagtgactcaatcatctgatcttgttcattgtcacatccaatcatggaacacacacccaacttctcaatcactaaatctcgctctttgtcacgaccaaacacttgaggcactccaatgactgaacttgtctctggcatgtgttgaactttctccatcttaagacccagaggcttaagcgctctctctaaatcatccacggccttgtcaagcttatcttgagcatcctttatccttgttttgctaccacagatcaagttttttgcacgatacagagaggaagaaaagaatttacctgctcggctacggtcagtgtcctccatcttctgccgcagcacctggtcatcgaacttgcgaagaagatcctcggtgtcatatgtggtgtccttgagctgcgtgagaagcaccgcgagatccttgttcttgaaccttccccactcgccacgattgatgactaagcgagcattgggcaaggatgcccggaggcaggatagatcatcttccagattggtcgctccgtggatgttgatcccagttgagatgatcttttctacggtctccatcaccgccatagtcgtccttggctcctccggatcttgtcttcgtcttctttgatgagtgcgagcctcaagagtgcaaggagattatggcgtgggaagtgaataatgcagcagcattgacctactaagtctaactacagaggcactcctttccacataatgatgcaagttgtgagttttgcatttaatgagttttgcatttaatgctgctgcatttaatgctgcccaagcagcattaactcctttccacataccgatgcaagttttgcatttaatttactaacaaattaaatgcaaaacttgtagatatgactcacttgacaatcattccacgtgatcctgttcaattatctaatcatctctctaagaccttaaccgcactacatattttgcatcttaagattccatatgtctgccagtaaaaacacaagtgcgcaacccacgagagaagaataccttcggatagtagactgtagcgtgtactttgtataaaccttgggtttctgtgaaacattttggcgaaaaatctagagttactagaaaaaattagatatgtttgaaccatgataaaatagaaagtggcatgaatgctatggtatgtttttgtcacctttttgtccgtgacactatcacaagaagtgaacgagcacatggattcccacttgatcgttaagaaagtgggaggaaatgcaattgtggatgcatttgaccaaaaaaggagtgatattaacaaaggagaatttagccaaaaggagatggaaaggaagcactaagtgctgcttttgcaattgtgaagaatcaattcaacatctctttttttattgtcactttgcacattttatgtggaatgctcttttcatgatacttggttttcaagtgccatcctgtattgctaattttctggtggttggtcatggtgcttagtacctaagtttagggaccaactctttgttggagttgtggcaatgtgttggccactttggcttgctatgaatggtatacactagtggagaaactatctttggtcggtctggcaaaatccacaatagttccagttccaaaaagaaccgggactaaagattgtttttagtcccggttataaaaattttgatgatcattaatcccggtttatcccctgtcagatgtttgtcagggggcgaggatctttagtcccggttggtgtcaataaccaggactaaagatcacttatcctctcctccacaattacaacttagacagatcgaatctctcccctctcctaagatctaacctctcttcctcatcctctctcctccacctcctccccttcctcctctcctccccatcctccccttcctcctccccctcctccccttcccatccggcgggccggcggggccacgcccggcggccgtggcgagcggcggcagcggcattgttttttcttttttatttttaaatttgcgattcactgatatgtacaaatttgtgattcattgtttggatctgtgatatatttgatttgtgtgtaattttttaggattttgtgatgtattaaatttgtgtgtataagtaactttatgatttgtgatgtgaatttgggatgttactttgatttggagatttggggatttgcctacttgattcgggtgaaaataaaaaggaaaaaaagaaaaagaaaaggggaccatttggtactgccgttattgtctctttagtcctggttggtaacagcaaccgtcaaccgggactaaagatggatccttactcccggttgaaaaaccgggactaaagtggggttcccaagcgggagtaaagatggtttttccaccaatggtagtctttaacgtcactatttttttgggcgggcaccgggtgggtggggggggcattaggctcaccagtggtctttgcttcttaaggaggaggaggatggtgaggcagtgaggaatggatacaaagaaactggaaacaatcactatggaactgttcttaaaatcggggtggaatgggagaggaagactacaaccttatttggctctggtgaagcgagtaatgtaacgtggattttggttaatttttgtcacctatggtggcatatgttctataattcttttttaagcccaagtgcctgacgttgtatgaccgtggttgtgtaaacccccgttgggtgtataggttgggtttttattaggcaaaatttactacagcacattgaaaaaaacgtgtaattagctcgtggacagcgcaagaatgagaatttgctatcgggcaccacaaaaaacgtgtaattagctcctggacactcagggccttattttaatattttctgtgaatttggagagagaaacactagtgagagtacgattttgccccttccctcacaagtcacaccggccagagcacagcgccgccaccacctccacccgcggtcgtgcgcccacgcaggccgccatcacacgcacatctgcgccgccgctgccgctgcagccagccaatgaacgggcatgccgctgccgccgccggcagctgacgcactcgtgcgccgctgccttctcccccatctgcgccgccgtgccggaagatgaggaagacgacagcgacaaggatgacaggaaggaggaggccgtggagctcggagatgctgcgcatcgactgcgcgtggaagtccgtgaagccaacgagcatccccgccgtgtgcgtccaccgcgagaagctctacgccaacacgcggtatgggatggtgtacgcgttcgccgagctgcgtacgtggagcgcagcttcctggtggagtccccaccaggctctccaccgagcaccggcgaccgccacgggctgatgcaggtggagctgctccggcccgtggccgcagctgaggaggaggggttcaaggtgcgcgtgctggacaagtgcggcgagacgtgggaggaggcggacgacatcggcgacgtggtggtggtcgtggacgcgtccggtgcgggggcggcatctacgcgggagtgccccaggttgaggctgagcaccatgtacttcgccgtcgaccccaccggcgagacgcgcgtgtgcacatacagcctcgccgcagcgggcagctacgtgtcgcccacctctcccgccgtcgtgagcggtcacgctggccgcctctcacaccctttcccaccgacatcgtcacgcccgctcctcgccgctcactgccacgcccgcgtcgccctgcctttcccgttgtcgcgacctagcgccgtcccgcgccgcgccgccagcgcacgcaagccaagccacccctatggtcccaatccaagggcacacttgtctttatttagtgtttctctctcgaaatccacaggaaataataaaataacaccccgagtttccaggagctaattacatgtttttttatgccaggcagcaaattctcgtttttgcggtgtccacgagctaattacacattttttcgatgccatgtagcaaattttgcctttttattaaacccattattataaaaactgggaaggtagtccgcgcatacgcatgggcatatggtttgaattttaattatgaaagttgatgcgtggatgatagttttgaaatatttattgacgctattttaaacatgtgttcgttaataactgttttgggcatattacttgaaaccgtatatcctcaaagttattagaaaaaaaatgtgtcacaataatggagttgcttcatatctatttgtattatgtgcgactctttttcaaaaaaaatttagagttagtctcatttggatgaccctaagttgattttagatatttgaatatagcttttttagttttctaagtcactaaggatgtaaaagcttaatcataaattattttttatcgctaataagctatttagcatataatcagctattggccaaccgatgggcctgctgaatgtttcacgttggagcctatatctatagttgacttgacctatgctgctgatcaatgttacacgatggagcccaccggcctaattgtctggcttattcgtgaaataagccaaatagaatatacataaacgaaaaataatatgtgaataaaacttttatatatatatttttagcaatttaaaagcaaagattgaaaaataaacttcgataaaaaaaacctaaaattaacttctaatttaagattgaaaatttaaatttttactggtaagcataaccataaacgaaaaaaaagatgtcgaagctccttcaagatttttgtgggaggtatcgttaattcgtgatcacatttgcgtcgaagctccttcaagatatctttgacccggcacctacaatcagtacagagcgttaacacggacggaagaagttgcaggatctttcctcagaagcatccttttgccaactaccctaggaattatatattgccaagaaaataactactgttctggtgctgaatgtttcattcaccttgaacttttgtcaactgccgtctccaaaggagagaaaaaataacataaacttttacgaactccagatgctaaaaacttaagatatttcatctcaccattatcttgtattatgtgattcagaaagtaaaaaaggaacagttatgcagtaactaggagtggaagtgcagaatggattccattagacagtgatgattgagagtaaattgaaaagaaacaacttgaagctctagtcctgtggagattatggtaacccatacccactcggccactatattttgattaattggatatagcgggtaatccatgtttatattatctattaggctagaacttaggtgttatgttgccttatatgatacagcacggcctatagtctcggctaaatactaccatgtaatagattaagaaactgatgcctattcggtttggttttcctctttataaccctgttctccaacctatataaggtgggtggaaagtcctccaagagcataaccacacaaataaccagagataaacacagttagatcgtcagatctatacacacccagcggttacaattctcgaaacaggagtagggtattgcttcttatcaatatggcatgaacctgtctaaacctttgtcccctctattcatccactttacaactcatgcgctacacccttttcttatgggttaatcgtatccatgccattgtaaaatatgtcgattcagagaaatgccctacaattcaccaattcttaaccgctccattgaaattttagaaaattaggaccacattttcaatccatctccatcttcttcctcatgtgcacgtgggacccacccatcagattcatcttcttcctctatcctcactttttttatgatctctctccaccgcagtcaggagggagggatggactggtgcggcatggcttggggcatgaactagatgcctatggcggcggtgacggcggacggtggcaggacgaacctaaggaggcgggcgtcaacttcagtgccgccgtggcgtagattgcgcggtggtgggtgaacgggaggagcgacggcgacagggtcgctacagggctccacggtggcagccagggcggggcggtgcacggcatgtgcgtgggtatcgatgcgacgcttgcggaatgccgggcatggagggggcggggtggcatgccctatagcaccagcacgtcgtggtggcgcgggggcagctagaaagaggtggaggttggagccggaggcgaacggggacgttgggccgctgccagggccgaggctgaggtggagccagtccctggcgccgttgtttcctcgacctccgttgctgctgctcctgtcactgctactaccactggtcccggcgacctcctactggtggtggtggtggtggtgggtgttggtggcggtggtcgtctccgttgcgctgcagctagaggtgctggttccgcgtcagcagcgatggggacccacccatcacctccctccctcccgcggtggtggagagagatgagaaaaaaagtgtggaggatggagaaagaagatgaatctgataggtgggtcccacgtgcagatgaggaagaagatggagatggatggaaaatgtgatgatagtggcacggtcctaattttgtaaaatttcaatggcacggttacgaatagacgaattgtagtggcatttctctgaatcagcatatttacaatggcatggatccaattaatccttttcttattgccgatctagaacatcgatagttgactgttgacggtcgttatagaccaatttcgaccgtcaatatatccagaaataagaagtagcaacgcttgcatgcatatttgtttaagtataatctatcagttaacgccaaaatttggtaagcccaaattcatcatcggcctagagtcagtatcggcttcagagtcttagaatcggccgatgggagtcgtcaaatcgccagcagttgtgttcttggtggagttggatcaattaaaggaagcttatctagaagagtccgagttcaaggaggatgtgacatggcagtttatctattaattaggcagtatttgtaagtttccttttatctttaggaatgtgtgtttagtgtccgataaggactttatgttttccttttatctctaggaaagtttctttcttgttctacaaggactagtatttacccatgggtataaatatgtacacccggggttattgtaaattatctcttgatcaataatactactttcggcgcatcgccaccctctttcccgaggtttttacatatcaaccggcagaatttggcacttgacgcggggctgcatcggttcagttcgatctccagcgaaggggtaagtcctacgttccaccagccctggtgaatctgccggctacgttggtgttgttcaaggctgcatcgcttcaatatcttagatcgctctggtttggttgatacatttgcctacctgatatctcaattctatctctagttgcattgtgtctagagatgcatcggtttagttgggactgtctcagttaggtccaatcttctgccttagccgatatatctttacaatcacaatgctgttataaatagattttttatatccatcacattagacaaatctatcggctcatcgagtattagattatcatatacaatctcgtgctgcatcggttaggttcgacctactagattgttgttgataatataagtcttgttaatccgataggttcatgctaatgttttatcagggtgctagctaataagttatctggacgttgcatcggcttacaaagattacatataagttggatttagccgattgcaataaaggtttcattgttgaatctaatcttgtggatttcatgacatcggacctccagccaatgtatatgctttaaccttcggatcagtgcttattctattatatcattgctagccgattggtttctactggattatattgtataattatattgattatcatcagccgattgtctttatatcattatctacattggacatatagccgatagctcagaaccctatcactatcggctggtatcggcatcggctggctatttgatatgttgtttacgtatcttgtcagttgcaggatcaaactgactggcacgcccgcacctcatcaacctttggacctgcactggagctaagcagatctcccaggcctgtgtgtgttttttgcatcaacactatctccacttgtacttcgaattttatttgaatacatagatctccacataaatggaggtgaatcgatggaaaataaccaaacaatcaatcgaagtccgagaagtggcagacttatggatggatgggcttacaaatccaatagaatacctgcaaatagggccaaccactgtgccactggacttaggatccatcgaccgatgcaccagagaagacacatgccaaatggttcagcccagggttcgaccgaacccccagctgcgccgttgatcctctccttccacgtggacgctcgtgatcactttgcaatgacagttgcgaggcattttccaacaattccaaccatcacaaccgtcaatggtaacctataaatggacttcacctcctccatttccaagagcactcttggtaattcttacgaccatagataaatccgcaagcgcacggaatatcgttgcagcacttcaccttcgggtgaccacaaaaggatatcgaactcagggaacgtgtgtaatctacctaaggctaagactatccagggacaacaactattggtaggctagctaggctagagaggactttatatgtgttttaattatctactctaagaaaagttaatttcctatctgttgctttgggcaccgacccctgctggtctgccaacgtagtttctgctatagctctatgatgtatcctaacgtggaggattagtaggactggataaagcgctgtcaccacctgccgtctacctctgacaaatccgtgggatacacaacaaacaaaaggtaatctctaacctatacaccacgcctaagttattaattactactctaatacttgtacatgaacttccttctttatccagagtcttagtactagagcacttagtacgaatactaaataatgaacctgcaaagatggaaatctatcttacttagactaaataattaagagaaaattcatgaaataccatcaataagcaccctaatcccagaaatgccatcgacaaaatcaacttcctaaaaatgccattgcacaagcctctttctcccaaaaatgccatcaccatcaactccacaccgttgcaaccattacttttttataatgaccattttgccctcagtgcaaaatatacccaattttcactgtcaaagaaaaagagagatgaaatgaaattcccggcggtgacaaggcggcgatccatggcggcagcgcagtggaccatagcggcggtggcgcacggcacctgccgcggagaggaggtcgcaggaggagctccggcaaggtcatgacaattgaaggacacggcggcggcggcgtaaacaacacgatgacaacgccggcttcactcagcctcccagctacaaaaaggaagtgcatgtgaagcttctgaggtcctagggatgacacctgcacggggaatcggatggtggctcaacggagaaggaggatttggcggtggtgctcagcggccggagttggggaagacggagtcgatctcccagcttgctccaccgatcttggtggttcttggggcgttttgcagagggggacgaggagaccttcacggcgtagtggcttggctcggggcggacaggttcagccgggcgacgatgacgctgaagcggcggcgaagaccggtgcgcgcctcctcctcgccggcgcctgcggaccccatgccgacgcctgcggcctcctccgcgttggcgcctgcaacctcctctccgcgccccgcgtcaccgccgacacctccttggaccaccgcgccgccaccgggcattgcggcgccaccgctgtggatcaccttctcgcagcagtcgccgaccaagagaggtgcgctgtcaccgggagagccgcctggatcgggtctagtgttagggattttcaccatttcatctcccttttcccttttaccgtgaaatactgggtatgtatatttgtgagtgagggaaatttggtctttgtaaaaaaacataacggttgtaatggtgtggaatcaacgggatgttgacggtgatggcatttttggaagaaatatgcttgtacaatggtatttttgggaagttgcacttgtcgatggcatttctaggataagggtgtttgttgatggcatttcatggattttctcattaattaaataacataagaaaggatcccgaatgcttacttaatagaagaagtttctccgaacccggagtagagtgtaccgacagctccggtactcctctagaattcctcctagaaagctacactcgtcgaggtagaagtcggagagagcaccaaacttccgggcactcatccagagcttcccctcactctacctattttctaatatacaaaagatacaatagagcctcttgatttagctcaaagttgtgtgttttgaagtgaagtgagcttctccttttatagtctccatatgacgttacaactatgggaattgtccaaaacaccctccaacgatcattgggaaaaaatcaggagtgtacacatggaggtgaacgggttcggccgaacccaaaaatccacctcccggtctctcttttggctaggaggttgcttaatgggcacccaacatcatgtactatgatttggcccaattctaagtggttttgattgacatgtgggtcctccaatccatgtaaatgtatcatgattgtccggaggtgtattttgttgcatgacagacgtgttttctccttaatatgcatgcatacttatatttcaccaacactagtggaaatgattagtaataatacctaccactaagttggataccatatattttatttcgttatatgcaagtattgatggtcagatattatgatttaaggaccgtcaacaagttagatggctttgcctctgcttttcaaaaccagctaagttttaacaaaatgctagaaactcaactagctcagatggctactcttgtccctgctaatgaatctaggaggattccagggcaacctgagccctctctagagaactttaatgataaccacaaggggaggaaaatccactcgcgaccagccacatcctaacactgcaggaacaagaaagaacaataaggaggcttcaccatctaacacaaatggagaagaagagacaattcagcgggagaaggctgcgccgcaggagtactgcgacaccaacctgctgccattcccccagcataaccggaagccatccatcgatgagcaattcgctcgctttattgaagcgatccaaaagatccacatcaacatacctattttggatgcgatgcaagtacccatgtacggttgctatctaaaggacattctcaacaacaagcgaccgatgccaaccgcggaagtggtgaaactaatggaggagtgtagcaatgctatactcctccaacttccggagaagaagaaagatctggggtgtcccacgaacaggccttgtgcgaccttgaagcaagcgtgagtgtcataaccaaggatgtcttcgacaaattgaactacacagtgttcgcaccaacactgatgcggctctagctagccgattcctcggtccgttacccagcaggtattgctgaggatgccctagtaaaaattcgggatttcttcatcctggtggactttgtggtcttagacataaactctgacaaggagacgccgctcatcttggggcgtccgttcttaagcatcgtggaagccaacattgatgtaggagctggagaaatccggctcgacctcaatggaaaggaggagaagttcgaattccgaccgagaatagaacaatgctctatggtgaagatcaagtacgggccaaatccacaaaatatccgagaggtcgaagttaaaccctcaaagacggatagcctcattgcattcatgaagaacttcctggagaaggaagcgatgggcaggcaccgtccagatccaaaggtggcatcaagaacgcaagctaaaaagcctgtgacaccagccgccaagaagccacaggatgcacccaagacgtaaaatgactagcaagtgaagaaatcgacacccactctctcacctccggagcagggtgccgcatcatcaagctaagcatgatggaggtatggtcttgctcgtcggactaaaaacgacgttgcccttgccaataggtaatttggtatgtatctcatatttgccttttgcatcaaaacatgtttattttttcaaaattttgcattaggaataaatttgagacaaatttataaaaatcaaattttgagcaaaaataaaataaaattttggccaaattgaacgtggctcccactcaacttatcgttgggagccaacggccaaaagtgggcccagttgggcctaccaggccttgttcggccaaaccggccaggcaacggtcagttgtggcactttcaggggcaacggctagtaggtcccacatgttagttctagccgttttggggcctctataaaaaggaattggctggtggaggagagttcaccccaaattcaacatagtttcactctctcacacactctctcgcgctctcaaattcatctcaaacctagaggagttggtctcaagtttatttcctgcattttgattacatttttagcatctacgagtggctttggtgcaaggctaactggcgggtagaattaatccttgttactagcttaacccccgctcgagtttgtcttgtgctcttgctcattttgtctgcaggcatgaagagacgaatcacgcacttgtttaataattggtcaagctgtcaatcaagccatcaccaagaagagtcgagtgcactttctttcatcgaggtctcgttggaggaagcagacgctttgccaagactgcttagcgactcagacctcaacctcaaaggtgagcgggaaatgcaagcctatcatatgctcaaggatcggccgtttgctcacacaagagcatacgacccagaacttctttagaaaataggtatagatgttgatttctacattgtttggaatgctttaggatgggagaaatttgctgtggtaattaagcaatggttctcgcttacttaccttgcaatttctaggtaccttgctagaagtagatgatggcattttgtcacgctcggaaaatagaacactatattccgtttgtgagtgcataaatccttgtcctatgaggcaaggtacacattacaaagttggtaaataacaaagtatataagcaaaagcataaatagagtactttattacattggcaaccaaagttccaacactaaaagataaacgataaaagccgaaagctatgttgggccaccacaggcgcttgatggcaggcacgagctagacatcaaagccatcatctccaaagtattcctctgctggaagggggaaaatggagcaaggctgagtacaccaccatactttgcaagccatgccgggaaaatgcaaatataatgcaagtgagtacaaagaattcatttataacgttattttgcagaaaactattatttcaaagcatgtaaatatttaactgtatttgaataaaacacgaacctatctctagtcaattattatcaagccgcgctccaacgcgatcttgcctttatgcaggccaaaaagtgataactccaattattcaaatttcaatagaattaaactctaactagggtacattgcttggtttgcccataaccgagggcgtggctattcaaatagattagaggtgtacatcgttacccaccaaacccgtcttcctcacatgttgccatgtgccacatgccaccgcggcatatgacataagctatgacataactcatcgtttggtaccgccctaaacaaagaggaccgacatagacttcccccaccaggtgccctaggtcaagcaaacagtctatgcccccgagcatacagccagagacgtcgaccccatcaagggcttcatccatccctatccgtgtcttccttgtttatgaccgtactagacgatgcattaagcctttcctattagacaggtggttgtacggaatatgctttgcaacagaggcccgaagactgttacttatgacggccgagatgcgactagcgaaaccaagcaccccaagcccagccgaaaacatgtttggggaattttgaaggggaaatatcatgtcaaggttaaacagccactaaaccatattaaccattatttaaaagttattcccaaagtctaattattggaaaacatctaattgtttctatttaagcgaggctaagcatatccctaaatttactagtaagcaccacatacataaagttcccactagttttattttcctagagttatcaaggatcgtaataatacaagtaataaagctaaaacaaggagaatcggtaaggctaaataaaacagtgataagcgcggaaatttaataaagtgaaatgcaataatttaaataaacataattttataaattaggacaacaatatgatcaaaatgacatgacttgccttgctcgctaccaaaatcttcaaaatcaacctcgaggtagagcatctctccggatctgcagcgtctacactgcatacgcaaagaaaaagggctaaaacataaattaaaaccatataagatgcagaaacaaagcactaaaatgggttctttactgattaagggaaaattagcaatttgaacgagtcaattccgagttcaaatagtcaatatatgaccatttgaattttagatgttgtctgaattgcattttgcgaatttgtggattgattttgtaaaggaaacctactgagtgtgcgtgctgaaacagcaaagagagaaaaacagagaagagggagagaggtggcagaggacatggcagtcggtctccaccggcggccatggcgcagcgacacgggagaggtgagggtggcggcgaggctcaccagagcagcggggacggcaatgaaacagtgatggtgacgagcttggttttttgttgatgttcgtcattgtctccgaggtcttgatgttctttttttgttgttagtttcttcttcctctttggtttcattacctggtatatctcaaacatgaggtgttagagccctgttcttcgaagaatcccaggcatctcccgctcatgacatttgcggtcatcgttgttgaaattcttggtgggaaggggtacaacctgagccgtagatagtgaagcattcatggaggatcccaaggatgcgaacactaccgaaggatagcgtgctgctcccactgagcaggagcaggacaagccactcggccatggtgaggttattgtgcactgtgaatgctcctagcaaagccaatcgtttgtgccttcggcttcttcaccatcgcctagcagtcacacgccatacggtttttctccagtctagcagctgtggacatggcgacaacagaattttggcacttagtttccctatcttcttgtctaccttttaggccatttttttagttttctaggagtggttggaataacatggtcatcaactccagcccaaagcacacttggtttgcaccggtaggtaatactagtacaaaaaaaatagaccagactgacggtccaaccggaaaaaaccagactcagagtaatcacggttcggttagataggaagaccggacatgcatttgaaccgctttagaccagatgaactgggaaaaccggcaccggtcaaaacattaggtccgatgttgggccattccaagactaacttaacgctgttgggccataaatgagagtgcccctttggtttttttttgtgcaaaaatagggaacaaaggtgctctagctaggattcaacctcaggtcactgagttggagggaaaagtcactagcctttcgactagcatggaaaatacacataatacatgtaagatacaaccacggttcaaccgtcgggtcaacggttggattggtggaccggtgaaccgagaggtcggccgggtcacccaccggtccggctttttacactatggtaggtatactcatgcttgctttatatagatatgcggaaacgacggagtggacactaccggttgacggtgtgctgctccagctgagtaggacaagccgcttagcagtgattgctcttcccatagccatcgtcgatgcattcagcttcttcgccattgcccagtagacatgaaccgtaggattttctgcaggaaagcaacggtggatgtgggtacggctcaattttggtatttatttttcccatcttcatgtcaaccttttaggcattttttattagttttctaggagcggtttgaaatgatatggtcatcaactccagcccaaagaacgcgtagtttgcagtgataggcatactcatacttgttttatatagagagatgcgaaaataatagagtggacactaccggtggatggtgtgctactcccactgagctggacaagccatgaggtcatgcaccgtgattgctcctgccatagccatcatcggtgccttcagcttcttcttcgccattgcccagcagacatgaatcgtaggattttctctaggcaagcaatggcggacgtggcaacaactaaattttggcatctaatttttgcatcttcctgtctaaaatgtatgcctttttagacaatcattcagttttataaagtgagttttaagcatactaagaaagagcaaagtggtttaaacacaaaataaaaatgtgtcttccagttttcggttgtttgtgtgacaatcataactaggcttttatttttgaaaatatttggtaatagctacaaaataaagaactgctcattcgttgatccttcacacagcaataggacaaagctaagagtacatcctttttagaagagagtggtcgctgatatccaaattccgtaatgaacttgatgaaatttcttgcacatgaatcaaacaatctatcactagtagattttacaaacaagcatgtgttgttcaataaatcaaataccatcacatctagagaaacaattgtaagcttcatatttttctactacatggctcgagatcacgagaaagaatactgcaagcacaagcacatggtcacaacctgcttgagctacgccgtacaaattattcaaagttatatggaggtccctctgttctctatgtctatgtctctgtctttgtcattgtccccgagttattgatgttcttttttgttgttagtttcttcttcctctttggtttcatcacgtggtagatctcaaacatgaggtgggagagccctgttcttcgatgaatcccgagcatctcccgctcatggctttcccgatcatcgttgctgaaattcttggtaggaaggggcacgacctgagccgtagatagtgaggcgttcatggaggagcccaaggatgcgaaaacgacggagtggacactatgggaggatggcgtgctgctcccactgagcaggaggaggacaagccacttggccgtggtgaggttattgtgcactacgaatgctcctagcacaaccaattgtttgtggcttcagcttcatcgccatcgcctagcaggcacgcgctgtatggttttctccaagctagcagctgtggacatgcgatgacggaatgctggcacttagttttcccatcttcttatctaccttttaggcccattattttttagctttctaggagtgcttagaaatggcatggtcatcagctccaacccaaaggacacttggtttgcaccggtagatatactcatacttgctttatatagagatgcggaaacgacggagtggacactaccggtcgatggcgtgctgctcccgctgagtaggacaagccactttgcagtggcaaggtcgtgcaccgtgattgatcctgcgatagccatcgtcggtgcattcatcttcttcttcgccattgcccagcagacatgaatcgtaggattttctccaggcaaacaacggtggatatggaaacaactaaattttggcatttatttttgccatgttcctatctaccatttaggccttatttttcgtatttctctagccgtgcttaccaacgacatggtgatccactccagaccaaagaaagtttggtttgcatagggtggtatactcatactttctttgtatagaggcgtcttggcaaagaaaaatgtgtatgaaaggttgctgttaatgactaaacaaatccattcagttttataaagtgaggtttaagcatactaggggagagcaaagtggtttcaacacaaaataaaaaatgtttcttccagttttcggttgcttgtgtgagaatcataactaggcttttatctttgaaaatatttggtaatagctacaaaataaagaactgctcattcattgatccttgacacagcaataggacaaagctaagagtacatccttttagaagagagtggtcgctgatatccaaattccataatgaacttgatgaaatttcttgcacatgaatcanacaatgtatcactactagatcctacaaacaagcatgtgttgttcaataaatcaaataccatcacatctagagaaacaattgtaagctccatatttttctactacatggctcgagatcacgagaaagaatactgcaagcacaagcacatggtcacaacctgcttgagctacgccgtacaaattattcaaagttacatggaggtccctctgttctctatgtctatgtctctgtctttgtcattgtccccgagttcttgatgttcttttttgttgttagtttcttcttcctctttggtttcatcacgtggtagatctcaaacatgaggtgtgagagccctgttcttcgatgaatcccgagcatctcccgctcatgactttcccaatcatcgttgctgaaattcttggtaggaaggggcacgacctgagccgtagatagtgaggtgttcatggaggagcccaaggatgcgaaaacgacggagtggacactatgggaggatggcgtgctgctcccactgagcaggaggaggacaagccacttggccgtcgtgaggttattgcacactacgaatgctcctagcacagccaatcatttgtgccttcggcttcgccgccagcgcctagcaggcatgaatcgtaggattttctccaggcaaacaatggtggctgtggcgatggctattttttggcatttatttttcccatcttcttgtctaccttttagggattttttattagttttctaggagctgttcgaaacggtatggtcatcaactccagcccaaagaacgcatggtttgcagcgataggcatactcatacttgttttatatagagatacgaaaataacaaagtggacactacaggtcgatggcgtgatactcccactgagctagacaagctgtgaggtcatgcaccgtgattgctcctgccaaagacatcgtcggtgccttcagcttcttcgccattgcccaacagacatgaactgtaggattttctccagacaagcaacggtggacatggaaacaactaaattttggcatttatttttgccatgttcctatctaccatttaggccttatttttcgtatttttctagcagtgcttaccaacgacatggtgatccactccagaccaaagaaagtttggtttgcacagggcggtatactcatactttctttgtatagaggcgtcttggcaaagaaaaatgtgtatgaaaggttgctcttaatgactaaacaaatccattcagttttataaagtgaggtttaagcatactagaggagagcaaagtggtttcaacacaaaataaaaatgtgtcttccagttttcggttgcttgtgtgagaatcataacagaagagaagtgtgctataaatttatagctaattgtagcacagattccaagacgctgtgtatacgagaggtgagactagatattaatggtgtaatatacatgaatttataggtaagaaggaaacatatcctatgcacacaaagcttcccgtgcacaccaactagcaaatatcacagaaaattctacaaaaaaattggacattccctcctaatagtattacacgttcgtgtgaaatcttattttcaaattcattatattttagctgtaacaaaaaaagataaaattctgacagatttttacccttaaaactgtcatatttttttacttttttgttacagctaaaatataatgaatttgaatacggtactttacagatatatgtaatactattaggagggaatgtccaactttttgtagaattttttatgacatttgttagttggtgtgcattgagtatgcacgagaggcttgtgtgcataggatatattcccaggcaagaataggccattagattagctatagatcacta

SEQ ID NO: 67981 - DNA, 6124 bp, Oryza sativa
ccctcccccccccccccccggtcgcccgaggcggaggattatcgatttttagatgtttccctcttgtctttctctatttacaggaacagtaacccaacaaccagttcaatataagcgtgcatcaccacgacggtacataccattcctcacacaccgaccataccgcgatcttgtgtgatctcccattctcccccgtactacaatattgctcaacataaccgggcaattgctcatttgacgtatttcgaagtgtaactaccaatttaatcccattttttcggtttgattatttgaccctattttttaaaatcgaagatgaacactgaccctactccattaaagcgagttaacggtgttaactaaggggtaaatagtccattttgcccttgctttataacaaatttataacgaatttgatttatcttttacatttgagacaagtttgaaaaatttagcttcaatattttaatttgaaaattttggatcggtttaacaaatttatctttcattcgacggtttttcacaaaataaggcaaataaaatttggcagaaattttttaaaaaattgacagaatattgtcttaattttgtgaatcccaaattacatacaatgaagcaaaaacataaattatggtcaaatccaacagagaaaatatcaaatagcaactgccaccgcgcgtcggttgcccgctgcctccctccgcgcgcccgcgcaccagcagcggcgcaccaccgccccctcctcccttcacacgccggacgctccggcctccctcctcgtgccgctccccaccgctcctctctgcgtgctccggcgcccctgccgccgcctctctccacgcaccggcgctgtcgccgtgcctcctccccgcgccgacgttgtctcctgctcgctctccgcgtcggcgtcggtgccaccgctgccatcgcctcctccttccctgtgttgccactaccgagatgtgaacaagagagggtgtcgaaccctctaccaccgccacccccgacggcgcgcgtcttcccaccacggcgcgcaagagctggggatcaaccaccgcaccagctggggagccgctgccgcaccagctagggatccactgtgatgaccacgtgccggcgcggatccccccgtcccaccaccaccacgcatgcagagcaccgccaccacgcacggagagcaccactgccaccctccacgagcagacgtcggcgcggggttctgcttcacgccgccgccgccccctcagtgccgccgccgcaactcacacaagaacgagagagagaaatgtgtggatagggttcggtggatggatagggtttcctatgggtattctgggtattacgaatattagttatatttcttttttattttaaatcaaaacttaacagggtcagacgggagcttcattttcgaaaaggatggtcaaataagtaaactctaaaaagtagagtcaaattggtagttaagcttcaaaacggggtcaaataagcaattgtccctaaatgaaatgtagaccccgattttggaaatcgaaaatcttctgtgtttatccgtaccaatccctggatcagtagttggtatacacatacatagttggatcacaacatatcacgaatgaattcaggctaaaagaattaaatacttacattagggccaggtaggccaacaactatcagagaacaacagcggaagacaaaataatataagggcccggttaacatgccacaggtagtcgactggggaacgagacctagaacaagaccgcactccgatcatcttgtgagatacgcaagcgtaccgacaagggcttctcttcaacactctcctaaaagatatataaatagcaagggtgagtaccaaccgtacccagcaagccaccacaacaacaatgcatatgatagagggtttttcaaggaatggcttcaggttcttttgcataaagctagttttgtaattcttttcacaagcctaagacctagcatagactgatcaaattttaataccagttttcacattaaacaacgacggttctatccaccatccattatgatcccaaggatagcttcccgccattgaatcgtcatggttttctgaggacgtccaccttcccgcctctcaggaagtggctccaacagcataaaatcatcatgcaatatcccatcccacacaagttaagaactttgagtctagccaagtgtaatacatgtcccggtgctcaataaccgcgagcacggctattcgaatagatttggtttactcacactgcagtggatgcacactttacccgcactccgtgactgcccaacacatgagcctcgtcccaacacatgagatgcgtcacggcaaagcttttcgatgacctcgcattggcagtacccgctccataaacttaaatcctcatgcactctaggcgtccatgtttctagcagtgagaggagttctggcgctcccgggaaagagaagtctcacacatatattaaattatggttcaagttaagttctctctctcacacactcatggcagtcctaccaatggcgacaccgatgtagggcacgcctctcggccctacctcaacggctgttccaccgtagcgcacctgcctcactcaggggtgaaccatctatgcagggatactgcctccgctcggctatctaatccgctaggtctatacccatatgagaagtgcggttgtacgggggtcgtttcatgcttaacttcatggctcggtccttaattgaccggggacggtactagccttttccagataccacccaaatcctccgtccgccccaggcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctggaaattgctgacgttgcctcacgactaaccgatacacaaagtctataatacgcgagaaaaaccaatattcaaacaacaatcaaatatgcacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctaatttgtggtttagtctagctaatggctatggaaggattatggctacacatgcatctatctaaataaaatggtcgtatactagaggttctgttgtcgggtggatttaggatcaatcaaataattacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatcctaatttacagttgaactataattataattatatgaggtcaagatttataactagtatttatctgatatacatgtttgtcatacactccctcttaatttcatatatgcaacacgcaaattaatattataccgtaccactataatgggatgtatagtatatgtgtaagcaacaatatcttattattggatcatatatttgagtagtttcttttactgtaagctatacaatacatgttgattttaagatggctctatttggttaactaatggatatcaactgactctatatatatatattctacttcacatgacattgtatcaactaattttttttaagtggtccaaatacaactagctctgtgattactctcctaaacaagttaaagattcatctatgtgtgtttatattttagttacataatcataaggctatacttgatttaaataacctataagccatggatttaattatatggccatcgaatattaaataagtactagtattttcctatacatccattcatttgagacatcacataaaattagtttgtgtggttgttacagtggcaagacatgttagagacaaaacttattacatccactctactgtacaatactaattttatttattagcatatttttaagttgactattatgcatcatcttgatattaattatttaatatttataaatatattttatcaaatagtgaattatatatcattggaaagcttatgaatttagatgaatttaggttcaagtttcactcaaatcggagctgaaatgaataagttatgctagtgtaaagattcaaatttgaattaattctaataattgtgaaatggtactgttcctaattcatttatttataatacaaccttatccacaagctatagtgactgacaggtggggtcaaggtcttgattttcttttctacagaattatttttctaagggaaattggatggaattaatgacaggtggggcccactctaacctctctcctccattctcttttctctctctcctctgttttctcctctctctcacggcctcggctagaaccggcgggcggcacggcgcgatggcaagtggtgggggagggggaggctcaccggttcggcggcggggtcgacggagacgcggcggcgaggtcgacggcggagcacggcgcggcgacgaggcacatcgcggcggcggggcacattggctcagcggcggcggcggcggcttccaacgaggcggcaacgccggggatgggaaagagagggaaaagggaggggaggtggtgggggtagtgtggggagcaatgggcagccggggaggggcttatataggcgcggggaggggtggccggctttaaacgacgacgggacggcgcggcggcgtggggctcggggcgaatgcaacgcgcggcggcgggacggcgcggcgcaacggcgacagtgcgcggcgcgggcggggctcgaggcgctgatggcgacggcggtgacgagaaggcgtggtagcggcacggggctcgaggcgcggcagcggctcagggcgacggcgacgggacggccgatcggtggggcgcaggcgcgaggcagcgagagtacgggcgtgcggcggctcggggtgcgaggccgacggttacggctcgcggcgcatggcgatggcgacgcgacgggcgacgcgacggcggcaacgggagtggcgcggggctcggcgccgcgcccccgacggtgacaggcgatcatgacgatgcgacggcgatgacgacggcgcgcggcgcggtgatgatggcaacgtgacggcgacggcgacggcgcgcggggcgcgaggcggcgcgacggcgtgcggcggcaacggcggagcgaggcgacgacgacggcgacggcggcgcggggcgcgaggcggcgcgcagcagtgggcggcagcggcgcggcgcggcgcgtgcaggggcacggggcgcgagggggagcgcgccagtggagggggggaagggctagggaaccacatcaaacacctaggccataatgaacagtgactttttcctaattatccacttttgaggcatatttcctattaaaacttgtcccataatttctagatttcacacaattagagttttacccaatatatgttttattttagatgaaagttgaccaaaatttaatattacccatattttatatattttcctattgtattatttaaatgaggtttaaatctaaaattaacctagataattttggaggctttgagggttctaaaattaatttaaaatatcctaatgtggcaattattattacaatagcacattgaatgaacttatttgtataacaatgcattttacgtgggtctactcatt

SEQ ID NO: 67982 - DNA, 2157 bp, Oryza sativa
tggttggatcgaatcgattcattgcgctccaatttttaagtaattaattcttccagttcgtcccgatttgcggcttcttgttgcctgtgtggccgcagtgttgatgtgtgttactggcagtttgtttccacggaaatttgagccctcccacgttagatccgcacctgcatagatctagacacgaaatttcttctcaagtgaggggatgggtgtagtgtagatcaaccacagctcctcctttcaagaggagtataatgatgtgcttgtttatggaatgtgcactgtcggtttgggtgcaagtctcagaggcgtaggtctacagccagatgaaagatttgttttgtttcttatctcttctcaatttaccagtttaatttgattgcattgctaattagctatctccgttttactaattatcgtatatctcctagttcatgagtcggcaccttgttgtttttgttttgttataaaggttgctagtgtttataggagataaattaattaatgagaagtatcacaaagggcttttcagccacactctagcattagctgatcggccgatcagagccgcccgacaacatgcagggatgagccctcctcagcttgagggttgttttctctgttcctactaatgttccctcttcccccacaagatatttggcctgttcttgacagacgcaggcttccgtgtatcatgttagtccagcacttctagtataattactgtgctatatgcccttctattaacagtctacagtttaatgttgaaaatagggaagaacataatgagaggatgctcaataaaaattactgaaatgtagagtattccacataattatcctgaaacctagttagtgcaaatatgattccacacttcttgccttaagataggtctatgactctggtagattatttgtctattgcatgaccatttgttatgccaaacaaattacagggtattcaggaaaggcattatactgtttttgttgagcattctcttgttttgaggttctccattatgagcattaatgcttagattgcaacagaacaaaaaaagagcattaatgtgaatcttttacctgtgctcaaattcattagttattgcatgcctttgaatttcagaaggtccgaaatttcagatccagaaaaaatcaaacagtactattacagtatttgagaaattaagaaccgcagaacatgaaattatagtaacacaattgcaaaatccacaagttggaatgtgacgttgcaaaaggcgttagattaacaaaatatcattctgttagttgttacattcacttgatggttggtcccacctgatagccacctctctctttcctcttctccaaatctgaatctctctctctctctctctccctcgcccattcattactgaaaacagtgaacttgtaatgtaaatttctcagcactaacagagccacagagaacacatgaactaaacggtggtgttattttcataattttgatctgatctttataggatgatagttgataaagatcttcttttgtggcaatatttccctaatttcatgtccctgctatggtagaaaaatagttttctcaatatattttagggttagtgactagtgactcgtattgatttcacttgttttttctatgtgcatttatatatgcttatattattaaactcatgtcttaattaaaatatgtttctaatgtagattgtgatactccaaaatccaaattggattagattctacatgacaagagaacatggcacctggaagcaaggcaagagaaaagcagcattagatgctggagcttggatgttcaacattgtgacatctgttggtatcatcatggtcaacaaggccttaatggctacacatggttttagttttggtacgataaattgataatgctttattatttactcatatgtgtgatcacttggaaagatgaatctgtaacaaactcagctactgaacacatgcttgtactaatatgggggtgctattgcttgtacagctacaacattgactggactgcattttgcaaccacgactttgatgacattagtaatgaaatggctgggatatattcaaccgtcctacttaccagtgccagaactaataaaatttgtcttttttgcaaacctatcaattgttgggatga

SEQ ID NO: 67983 - DNA, 3548 bp, Oryza sativa
ctcggatgcactcctcgcacaaagttgatttttcggacaagtttgatacatcgattcggatttaggagcacgtcacgtagcgagaaaatttcgatcgaaataataatccctaaaactttcatagaaaaacaaaagattattttgtgcttcaactcaggcatataatcgctttgtgcttgtctgcttagccacctgtatttagtcagattggcagcagcttaatccgtcggctaaattagtaccagcgaaacttgctggtcatattgttgacggcctgaatctgcagctccaggtcacggatctgcctgcgcttcgccgccgcgagcacgagctcctcggcgcgcgcgtccttctcctcctccgccgcgagcagccgcgcctcggcgtcgtcggcccgggcctcggcatcccgcctccgcgcctccaccgccgcccgctccgccacggccacggccagcgcgcgctccagggtgcccacctcctcctccaggttcgccgccgcctcccccaccagcagcctccgccgcagcagcgccgccgtgccctcctcgccggcgtcgtcctccgccgccgccgccgccgacgccgcgccgcccctgagcgaggccagcaccgacgagaagcatgacagcggcatgtttttgagtcgcgttgagaaaacgaaaatccaaagacggcggcacgtagagaaattaattacgttgggaaaaagtgatgagcccatgggcttttgataggccgattattacgaaggaatacgagtccgattacgatgggaagtaagacgaggtgtcccggtctgaatcgaattacaccggtctgaatcgaatacgttgtttatacgcccgaacaaagtgagcgaaagtggttccgagtcggatagtatcgcggagaaaaaaagagttccgctatacatacgattattttttatacgatgtttgtacgatgaaacgtctctcctaacatttgtagtgacgaaacagatccctccttcactgcaaagcccatatccaaagcccaggctcctcctgacgacctggcctgctttctcgttggtctggttgcacatccaaccaaagcaatcttctttctaatcatatcttaagcaatattcttcctaataatatgttatatagtaattgtactcagcactcatttatcatgtggcaggttaagcaaattactcatacatatatgttccttgcaccttgcactatcaaatagaattcccttctttggttcttgtaacatagcttcctctgttgattgctcatttgaaacaaacttctcaatttcttggtcatctgattcattttggacctcctcaataataaaatcatctttgtctgatatggcaatatcatcttctacttcattggtagataaattggtctccattactgaaacatgtaaattgaaacaatggcatgttttgcaaagcaaaaattcagattcattctataataaaaaagaagcatttcatggccatggacattacccaggaccaaaaaagaaagagagggagactagtgtaccaaaaaagatgattgcgaagctaaaggaattcaggcaaataagatggcatacctatgtcttcgtatgccgtatgctctctggattaaatgcagaattgcagatgcgctgataacatggaatagggaaagtcaggtttagggtttaacaaaggaagatgtaaagttagatgcaaagaggctaattgggctttagggcccatgacgctcttgactgccgtgtgcgcatgcgccgtgcgcttgagttaggttccctgccgtcggcgttgttacgtttgatggtaccaatatcgtacaaaaaattcgtatgcgtagcattttccagaaaaaaattgaaaatattttttagtttggacgcggataggcgcggctgccatgcttgggccgggcggctgggccgagagggaaagagggagggaggcccgggagagagagaggagaggaagaagagagggagggaagagagacttgggccgcgggccgagggagaggagggggactttgggccggactgggcccaaaggaggaaggagggtttatttttagtttttctttttaataaactctaataattgttttttttcttaataactattttccgtgctctgaaaatacaagtaaaatttgagggcaccttttagaccaaggaggatttaacggaaattctccgggcaacacgaatttttcttgtatgtattttagtgtttgtcaatttcttttcgaattttaattaattctattattccttttagagaatgatttttaattcgggatgaatttatcaggacgtgacattggtgataaggtggaggagagaagttaggagagagagagaatgagccacccccttatggcatagcttgtgtgcttcaattgtgcatattgatatgacagaagaaagtgatagttttagatggaactttcatcaaaatggtcaattcacagtttgatctatgtatttagctttaataataatggttatattgagaggaataagattaattggaaacttaagatgcctctcaagattaagatttttacgtggtatctacttaaaggaattgtgttaactaaggataatttggctaggaggaattgaaatggtagtttaagatgtttttttataaaaaatgaaaccatctaccatctattcttcgattgctatttttcgagatttctttggagttactttggtttacatcctccacaaagtatatctcatatgtttgggaattggcttgttggtgttgataaaaaaattaagaatcttattcttgttggagcatccgctttatgttgggttctttggcttagtaggaatgacatggtttttgatatatcaccatcaaaattttatttgcaggtacttttcagggcaacgtaattgctccattgttgggcttaattataaaggtgtgaagaagatatcagcttaattaatgatggcatgtcgtaaacttgagtcaacgattatgcaactctttgttaactttggatggaggttctcaaatagaattaaatagttgtgggatctttatcttgtgtcagtatatattagttgtgcttgtttgaaattttcattggactcactatgtgagtttgctattgtgtgaactatgtaataattggttgtagctcgtttgagcaaatgccgggatattttattccattatcaaaaaaagggggcaatctctatataatctctaagaaaagtgcaatatgttgcacttgctatcttttaattaatgagaagatgacatgacttaaattagatgtggtatttacatctactacaaaacttgtcctaagtactgcacatgaaccaacccggggtattgaagtaataaaatttattgttttgcagacaggtggtaggcattgatggtaggcaagaaggtagaagttggtttattttgggacaaacttcaatctctataagttgttttatttcgggatagagggagtagcaccgtacaagatgacctgggtatgcagacttattaattaacaaagtaa

SEQ ID NO: 67984 - DNA, 2113 bp, Oryza sativa
gccacgggcctcacggcctccaccctgtacgcctgcctcggcgtcggcgtcaacgtgctgatcacctccgtggacacggcgtggacgtcgcgggtgccgaggctggacgcgacgaactcgaccatggactcgagcgacgtggcgcagtagtgcttgtgcttggtcgtctcgccggcgagccgcgcggcctcgcactcggcgagcgtggaccacatggcgtcggcggtcggcgagacggccgggatggagagctgggagaggatctccgggagcctttcggaggcgaacgggacggactcggcgcggccgcgggggagcagcgcggcgccggcggtggcgcgggtgaagtggagcgtcatcttggagcccgggaagaggtccttctcgaggaagaacacgttgcccaccgtgtcctccttcgaagctgagcccactgagctcgctgggctgatgaggtcgcgaatggcgccgggcatcggcgaggtcgggagcgcgatcttccagtacatctccgccggcgacgcggcatggctggctcccgcggcggcgacctaaattgcagtcagaaacaagttgaattgaaaacaatcagagccaaaagttgcaactagaataagtaaaaattgtattatgttcaatctctaaataatatatctctctctcccaacttaatttatctctgttctagctcaaaactactaaaccatacaaagagcgatatatatgtgcttctgctcaccaaaaggagtaggacagcagcgagtgacctagccatgctaattaacgagctatcaaggacacaagtatatgatctaattcactgataagagtgaaactgagcacaagcagttcatagcttttgggagctatttatggagggatgctggaagaatacgaacaaataatacattgcattggccccactggattatgcagaacaaaacaaatatgtcatgtaggaaagatgctatatcgcattcacgatcatgccggatacctctattattgagcaactaagaagttagcccgcatgcatcctaggctgcatttgagacatttataagtaataggttgattgtgttaaaatgtcgtatttgttactatatagcaaaatataggtatatggattttatatcatcggtttgattataaacagagcaatagttagattagaaatcagacctggagcttataattgtaaactatttctcttttagtaatacaaaatagcaacggaagaggaatgaaaagcgtagagctcgagccaaagagggaaggagtaggtgtgtagtgatgggcacaggtgagggtaatgtggaggggattttttctttgtaatttttccaagtgattgaagtgaaagacaattattagatgctattttcctaggatttgtaagattttttttaaagatgtgatacaaatcctagaaaagtaacatctaataattggttttcacttaaatcacttagaaaaattacaaaaaatgaatcccctccacatcacgctcgcatgcgtctatcactacacaccggcctactccttcatttcctctctagctcgcgagctctacgcttctcatttctctccccttcctattttatactccctccatcccataatataaggcatggtcaaacttggcacagtctttaaaagattaaatctttgacttaaatttctcatatactataaggtttattgcaacaaaattataaccatcttaaagtaaatttaaatatcaatctaatgatattaatttcaacaaacaaaacttaatttatattgtaatagttgttggtcaaatgtttttaaagttgaatattggaatgtgtgcatgccttatattatgggatagagggagtataactaaaagaaaaataatctatattataagctccatgtctgatttttaatctaactattgctctgtttataatcaaatcaacgatataagatacatatgtctatattttgctatataacaaatacaaaatttaacacaatcttttcgggagtattgtgtacagccgtgcaacatcgtcgtagtttatatatttcaccggacaagatgcatggatgaatcttacatgcagacttattaacatgctgc

SEQ ID NO: 67985 - DNA, 2845 bp, Oryza sativa
cctcggcgtcggccctgccctgtcgacctccgtggacacggcgtgcacgtcgcgggtgccgaggctggacgcggcgaactccaccatggactcgagcgacgtcgcgcagcgcttggcctcaccggcctgcggcgcggcctcgcactcggcgagggtggacctcatggcgtcggcggccggggagccggcggggacggagagctgggagaggatctccgggagcttttcggaggcgaacgggacggagtcggcgcggccgcggggcaacagcgcggcgccggcggtggcgcgggtgaagtggagcgtcatcttggagcccgggaagaggtccttctcgaggaagaacacgttgttcaccgtgtcctccttcgaagctgaggccgctgagctcactgggttgatgaggtcgcgaatggcgccgggcatcggcaaggtcgggagcgcgatcttccagtacagctccgccggcgacgcggcatgtcggatgcctcatgcctctattattgagcagaggctgatagtgtaacaacaataatcatagtgtggcctggggttacccgactccctatcggtattctttgaatgatccaacatgcatgtctatttctagtaaatttatggattcgccaatagagcaattttagtttggctcagttctatcgatggatgagtccatgagaagttagttttttttacaagctgttcaaatagttatgaatgttttttttttcaaaaaattacagaagtatgttattaattgtatcgcatgtttattgaaaaacacgcatgatcaaattcaatatatgcatggtgtaaaaaaaacaaatcaaatagtaaaagttaccatatatagttccacaattcaatttttttctcgatatagatattgaatttgaacttgtattaaaagacatatataacaggctgccataggcaacaaattaaatgaatcacaaggaacactcgacgaatacaatccctgtcagtatttgttatggccacagataaatccgcaagcacacaaaccgatatagcatttcatctcagagtattgcaagtgtattgaatcacaggaaacgtatgtttataatccaacaaatatgatttttctaaggacaacaattaaatgataggcttaagagagataggatttgatgaggacatcccagctacacttgacgtaaacaagggtgatggtttacgtcatacatcacattaagaaaatgaagatgacataaaccaagttgatagattacgtctcagcaagaatgatcaagcttatcatgatctaattacgcacagccgtgctaggaaaatacaacaagaggtgaactcgctctttgctcaacttaacccaaattttagtgagaattttatactacctaaatgctctacctttgtattgctaaggtttacacccgaggacatcatcactacaccaaggaagatgggttacgttgaggacgacaaggattacgccgaggaggattcagcccattcccaaccagcagctttttacaccaacaagaagatggtttacgctgcaacggctcaacttccaaggcttatgcgacccagccaatcaagagacgggaagcatggaatacatgattggaaagagggacaagtatagtttcgaacgcatcaaaccccacctcaatatcattctccaatcaaaagttatggcatttttactgaaggctgcgcaggagctgtagggctgtgtgcaaacccgagaaaactctttgcattctcatttttgttagccttgaccaccagaacgtggcttcttatgttcacaccttagctaggagggatgttcctagtataaatacccctctactccatccattagacaacttttgttcaattgaaaacctcatatatgagagattcctgaagactgcataagtgtcttacccctttgttcttgtgagttcttttggacttgcgagaaggctcctctggtgccccctagttcgtgctctacggcttctagttcagctgcaccatattgtgtggattagtcccggattgtggttctgtgattgctcggtttgacgggtcggagtccagggggcttcggatcattctcaccctcaccacttggtcgcatccaaccttggtaggtataaagctagttattccggatcgtggttctatgattgctcggtgtgacggatcggagtccgggaggcttcggattgttctcaccctcaccacttcatcgcatccgaccttggtaggtataaagatagttatcctcttgctgctcgtagctagttaccctcttgtgtttcggtttacgccggcactctgtcttgaacctactgctgtgaagatcgggccacccctcgcgagtgtgttcgtatcaggattcctatatgtaaataatcttagttaagttaaggtaaaactctattagtttcttcgagcaacggttcactcctggtctaccaagggactccagcatgtatctctatgatgtacccgaacgtgaaggattaagaaagacggacatgattgtcaccacatgttggctgttgcctacgtttgcattccatggagcacacaataaatgaaggtaacttctaacctagacaacacctctacaacattgattacaactcggccaagaactttcttctttatctacaatcttagtactagagcacttagtataaatactaagcgatgaacctgtcgcaaagataaaaatatatcatacttaaataagaaaagtaaataccaaagaaaatcatgaatacttacttatataaaagacaaaatcgtcgaggtacaagataggagagagtgccgacatctccggcaatcctccagtaca

SEQ ID NO: 67986 - DNA, 12078 bp, Oryza sativa
  unsure (1)..(12078): unsure at all n locations
tgtcccgataatcaatccacgtttagatcttgtatttgtatactacccattttagcattgttgatatacgacaccgacagttggcgcgccaggtaggggttgcattgagtttttcagtgacaatcatgatgaaatcatcttcaggagttgtcaaattcgtcttccctccaaggcaaacattttgttttggcggtttcatctttctcaccgacaacttctgcaagcatttgttgacggttgttagcgatcagtttcaaccgtcaatattaccataatagacgagaactagttatgcttgcaatgcatatttaagttagaataataatattccaccagtattaggtttactaaccttttgcagagaataacaataaagtggagaagaatcgacatcaaatcagacgatcagtcaatcggatgatgtcgagaatcagacttatgtatgaatgggccaagaactcagaaatgacacgatgaattgggccaaagttcacaagtctacaacagggatcaagagaggaggccgccaaccgaactgtgggctggttgggccaacccctggttcgaccgaacccccctctccgccgtttgatccagggattggagggacggctgagatgagtccccaatgacggttggtgggtattaccgacctttccaaccgtcataaccgtcagtctcaagctatataaacccctcactctctccatttcttcagacacttcaagcaagagctctctcatattctctcaagttagtttagtattatcaagctagtggagtaggaatagaatagaaatcagagtccggaagtctttggaagtgttcgggtatggctctagtagctctcctttcctcttttgtaagccttgtactttatttagaatattcttatttatacatttctggtaatgaaatacgttccaagtctatgaatgccaactttattttatattcatgttatactgattatactgctagcttatctgggagatgcataggtacgggtataatgtttgcttatgcaattactctatgtcaggatgataatattagagtagtatctggtagtttaagcgtggtgtctagattattgggtatcattatttggggttatatactgcggataagaggtgggccgctgatggtgatagcttgttaacgactaaatttggtaatttaggtatcggagatgaagataaaattgaagcggaatccaagatggagatcattccggaaacagagcaagaatcggctaaagtccgaatcggctacgatcaagatcgacagagttcgagtcggagaaggttggccaattaagccgattccgacaatgtgactcggtacacattgtcgggttgagttaatgtgcttcatgaggattgccatgcatggattgagtcctgaaaaggcaattgtatctattaattagggtatttcttgtaatttccttagagataagtttgggcaaaagtctgccgcaaagacttatggtatcttagagtttgttagagatgagagtcgtgtccgacatggacatattttgtaatctcgggtataaatagaccccgagccccatgtaatacaaaaacacacgttcaatacaatctcggcgcatcaccacccttttactttcattntgttttgacgagttcttgctttcgggttgagctgcatcagttgcgatcttcaactagaggtaaaacttgttatggcggcttgcgttctcgggattagtgcttccatcgttatgatactcaaatcttgcttatgtaatttgtcgagttatcatatttcctatataatatttgacaatattgctatttaaccttcaatcggctaacatctattattagaaggcagccgattaggttaaataccaatgttggctcagattatatagggtatctaccactctatgaaacaaccagcggcttgattgtctatatattgtccttcttttcatacttatagctgcatcagttgagtttgaccttataagtcgtgattagaatcttaatctctagcctgttttctggttgcggattatggtagcgtcagggtttcagccgatcttacctaatttagctttatactttatgtgcttaactgatatgctagatctgccctttatattacgatcttattacagcaaagtatgttaagcttctgtttgatatattttgcttgctctaatatcttaacatagagttgtatcggagtattagccgatatgtgctagatctatctgatcggctatgctatgaacatctataatctcattattaatatatacttcgatctaagtgattcatactgtctcggcatgacgtccgatctatcctaatcacttgatttaagtatatatcaacataaggattatataccattaatatctacagccgatcgaatagatttagttctttcttacttattcatgattgccgatcgattcaaatatgacatcggctcaaagttaaatgatatgtcatcggcgcctggccgatcggttatcatttatggatttaaccatggtttctttgtctttatttcttgttgattgcaggatcaaatcaactggcacgctcacgaacctaaagacaagctttttggacctgcactggagttaagcagatctcccaggcctcatgttttctcttcaacatagctcagtacgggtattcctgcgcgcgtgtatatagtcctaagttaattttctggggagggtactcctccgtatttagccccggttgtatggtcatgacgggctatcgtaaggaactcggcagtcaggggtggcttctcgaagtactaggagggcatcagaaagagggtattagctagttaatcatataactagaatgtatgtatactatgtatactagaagtataggaatagattcttttctattttctttccacttagcttagataatttagtatgagaatgagtagttctatgcttgtgtgtcattctaccctatgtattatactaactcctgcttagactatgattattacaagtaatatataaattattagtacggttctctctactataatcttcccacggaattaaacaaatacgatacccttggaatactctcgggtgaaatgctacaattgtatatatgtgcgcttgcggataaactctgtaaccataatatacctggagtatttctgcaccattgccgagaattatatttctagtaatttcgttaagaaataccaataagcatttctggcgctgttgccggggattatatttctaataatgtcattaagaaataccaacagcatccaattggcggggttcgagacttcctcggtcccttttgatctctcaaatacagttgtggcctactccaggtcggatttccatggcttggcctcaaactggtctggggagtcaacgccacctgcttacctagacagcatctccaacaacgcggaaaactaccccaaaattctgatgcaactccctccgcttctcgctgcgacggttcaggacccactccatcctcgtgaattcaatctaggcatgattcgaccatgtccagacatgggcccaggaaggtgggcatcttgattcgttcgctcgatgactcctgcaacatcacggagatggtctatgacctcaaccactcggaagactatgccagattcagcatggaaacaatctacagctccaagtactccaacgattataccctactcagggaagtctttctagttggagcgccaaaagaggacgagcaggcccgcatccactaggaagcggaggaggagcacctacgtaaagaggagaaagaccgcttgcggaaacaatgtaacctaatgcatcgaggatgcacgacacatgacagcatcatccagactgcagcagaatagcgttgttgttgtaacgctacttgacaccctaatcgatgccttagacaatgccatgactccgacgctcgacaagatcgatgccatgatggtcactacggtcgcacaacaggaaaaggagctagaggcactcagcgaccaagccaaccaccagaggagtctattaccaacacaccaagactccatcgggcaaccgaccaagcaaatggccatctcttcacctttcaagggaccgccggtcagccgagagcagtcggggccacacagcctcaaatcttcaacactgcgagcagaataacggaacaaatcctttcgtcgaaaaccgtgataacaatcatcgtgaagacgaccaccatgaaagtgaccatagacaggaagacgaccacgggcatcgggaaggcaaagacctcaggattgaacaacaccgtcgtcgccgagagagaagaccaggatcgctgcagttcaccactccccccccccggtcgacccatataacctgattatgctgatgaaggaatagcaacttttacccgagacctacgtcgagtggactggccggccgacttcaatccagctggtatcgagaagtacgatggcaaaaccggccctgagtcatgtctcaccatttacaccttggccattcgcgcaacaggaggagatatcaaagccatggtgaactacttgcatgtggcacttactgattcagtaagaagttggcttttggggcttcggtatcggtttgttgcaaattttcaaggcacctacgtgaggcccgggatacagttagatgtttaccatgtcatacaacagaaaaatgaattattaaaggactacatcctatcgacggtggatacctgtagactagataaatggggtactggggtatgttggtacaaggatctacacaatacgacatcaaaatagacaagagacaaggattatactggttcaggccactcgtaaggtaatagccctaattcaatttatatggaattgatatggaagaccacagaatacaaagagaactgatgaacttgttaatacagacgagatccttatcgagattattcgacgagacctcccggcggcttcggcttgagtccttcggcttcgtagactatggtgggtgtgttggcgctatgattcgatgattctgaacccctctaggggtatgctttttataccgcgagttgttttagtctccaagtagaactcagagataacgaaccctgcacgatatagaatattattcccacgagtaggactccgataatctccagcccgtgaggatattttccatgctatctcgtatatttccttatcgcatacagaaacatatcgtaggatacgggtatgccaatcttgtatatttggtaaatcgtaggatagtaggtatgccttatccgtaaccctgacacatctgacgtttctttgagacaagcaacaagattccagaagacacggacaatgtcatcatcgctacttttcaaaaaggaatctgtgacgaaaatctcatcggcaagttcacccgcaaaccgccacttaccgtcatgaagctcttcaaaacagccaattcatacgccaattcagccgaagccatcaatgttgtgcgggaggacaagcaatcaagtactccacatctggtgaataataataatgagtattacaagaaggatcgcaatcgaacacctgaaaacttggtggccgcaacgtcttattttcagtcacattgtcggcgtgctagaaaattacaaccgaatcttgaacgggccctgtccaaatcacccaaattccaaacactctgctaaggactgtttcacattcaagaaatttgttgaagacaatgctaagcagttgaagctaacagctggaaaaggaacttcaggacagaacaaggacaatactggtgaagctaatccggatggtttccaagacccagagttgagctaaaccacatctttggtcgccctttagcttataagttcaagagaaagaagctgatcgatcattatcaacgtaatacactcagcaaatatcaattcccaaaatagtagtagggcattacctctcatattgagagcttaaacttgtctaaacttttgtccctacagtccatcaacttttagatctcacgtgcttcccctttaaagtatcgcctatatagaacgtcgacggtttatcaatttttcgaattcaccaatgccagtgccgtgccatccaaaaccactacaaatattctcgaggttgaaaattaaattctataattgaaattatggttagagagtctgtctaaataaagtctagtgttgatctagagtattggacctccataaatgtttacgattggaacacaatatttgtcctagtcaataggtgggaagtaattcggcaagtaggtactggtattagatatataaagagtttatgaggatgtttgtccatccaatcaacatatatcgtagtttttccaaacacacatgaatcttgtatgaatttatgttatatattattattactctatttttattatataatggctatatgttattaatataaatattaaatctatgctacttaaaaattaaaaaataagagttgctttcatcgtccttaaaaaaaccaggcgaaaaaaacggacaaaaaaaaccaaatctgtcctatccaaataaatgggtgaaaaaaaccgggcgaaaaaaaagaaaaaccaaacctgtctgataaaaaaaggcgaaaataagaaaataaaaaaatttctgtcaacgcggtaaaaaaaggtgaaaaaaatataaaaagaatatgtctgattccaaagaaaaagaaattacatgtgacgcggtaaaaaaatcaaatcctattatatgtggcacggttaaaaaaatgcgacgcggtaaaaaaaacaaatcgaatccgattctatcgatgcagtaaaagaaaaatcaagcataaaaaaaatgaatatgtccgattccacaaaaataggaaacaatctcccatccgtttccactacttctatctatctactctaacaatctcccatcatccgtgcaaaataaatcgggcgaaaaaaatcatccgaaaacaaaatcgggcggaaaaagacggacgaaaaaaaagggtgaaaaaaatcctattctgtgtaaagaaaagggcgaaaaaaaaataaaagaaccaatctgtccgattaaaaaaagaattaggcaaaaaaaacccagcgaaaaaaatcaggtgaaaaaaaaccgggcaaaaaaacaacgacgattccgtgtaaagaaaggcgaaaaaaaatcaatctgtccgattaaaaaaaaggaatggaaaaaaaaccgggcgaaaaaaaatcaatctgtccgattaaaaaaaagagtcgggaaagaaactgagcgaaaaaatcaggtgaaaaaacagggaaaaaacgaatccgattccgtgaacgcagtaaaaaaaggtgaaaaaaaataaaaaaacgaattctgtccaattaaaaaaaataattatatgtgacgcggtaaaaaaattcgaatcctattatacgtaacacggtattatatatctatatcttctctatctctatctatgctacttaaaaattgaaacgtttccatcgttcgtaataacgaaaaaagggcgaaaaaaaatattaaaacaaaaaagaaagtccgattcaatttactttcgttgtccctgaaaatcttatcttatcttaaaaggtccaggccgctcggtgctcatcgttgtttgcacgcccacctagccggaccaccgatgtcgtggcacagctttgcgccgcccttgggtgcaccctcagcaggcgaagcaggagccgctcgttggtcaacaccgcacgcacgcactagctcaccggactgctatcgccgccttcgtcgtcgttccgctcgttcgtcaccggagagaagagatttgggagctagggttttgcccctctcttccggtcggcacttcatccatcatggggacaatcggagccgtccattagatcgaacggctcagatttgcccagcgttgggcctctaccgctgctgattacgctacgcccaatgggccgccgaagtacatcgaaccatccccgcatatgtgggccgcgctcagctgctcggcttgcgggctgtcgaattgactcagctcgccgaagatgggccagcccaagtttgggttggctaggaagacctgggccgaaagcaaatttgatcaaacaatgtggctcatattttttaaatcaaagtccgtcggataagctcctaagtaggctcgaaaaataaatataagactaaatcataaattctatgctaattcatcaaattagactcggttctacctatttgttaatatatcaaattagacttagatttttaccgatttgaggttttcaaggtgtcacactatcaaatggtgttttacccgttgcaacgcatggacactattgctagttaaacttaaaatataaaatttcatgatatcccgatactacgatacgatcctacaatccgatactactttaagaaaaatgatactatctagaatcccgatgctaacaaccttgtgtgtagatagcattgggattttacgcgtgacatgtttaaaaatttcattctagcaatattttctcttaatgcataaatctcgagatgatccgatggtcacaaatctgaaagttttagggacagtaaacttatgaatgttttctagcaaatttggaaaaaaaaggtataataacaacaaaaatcaaccaaaaaagatttagcactcctcacacatagttgattttttggacaagtttgatacatcgattcggatttaggagcacatcacgtagcgagaaaatttcgatcgaaatagtaatcccatagaaaaacaaaagattattttgtgcttcaactcaggcatataatcgctttgggcttgtctgcttagccacctgtatttagtcagattggcagcagcttaatccgtcggctaaattagtaatttagtaccagcgaaacttgctggtcatattgttgacggcctgaatctgcaactcgaggacgcggatctgcctgcgcttcgccgccgcctccgccgccgcgatcacgagctcctcgacgcgcgcatccttctcctccgccgccgcgagcacccgcgcctcggcgtcgtcggcgcgggcctcggcgtccagcctccgcgcctccaccgccgcccgctccgccacggccacggccagcgcgcgctccagggcgcccacctcctcctccaggttcgccgccacctcccccaccagcagcctccgccgcagcagcgccgccgtcccctcctcgccggcgtcgtcctccgccgccgcagcagcgccgcctctgagcgaggccagcaccgacgagaagcatgacaacggcatgttaatccaaagacggcggcacgtagagaaattagtcaaattatggaaagtgatgagcccacgggcttttgataggccgattattatgaaggaatccgagtccaattacgctgcgaagtaggccgtggtgtcccggtctgaaatagattacgtttatacgcccagcccaaacaagggagcgaaaatggttccgactgtggctcggatagtatcgcggatgtaacagaaaacctagacaatggtatcccgttgaaacaagatactcttttatgagacagtaaatgatacctgttgtggtacagttgcatggtacccgatacctgtgatacctgttactcggtacctttgatacctaggacctgatacctgtgatacccgtacaagacaatagttaatatgtctattccgttgcaacgggatcctgttttgtagcagccctccggatgcaaatatggaatattgtaccacttaccgatggagagagactacagaacgggatcccgttagaatggaaaattttaagtgacttattccctgtcttccagtgagcttccacatgcgttcccctgacacctggtaccttgggtatcagagtatctgatacctggtaccgactggtacctaggtatcacagactttggtatctgggtatcaggactgatacctggtagagaagataccgggactggggtgccgggatcgccggcttcttttgcttctgcggtggtggtggtggcggtggagccacctgcgctcattgtagctccctcatcctcctctggcgcagcggtagccaccacagctctgcacccacgcacccactagctcctacttggttcttgcggcaggagtcctcggtgacgcacggtggaggcagagcaggggtgaccagcggcggctgttccctatccctgacgatggcgatagcctagcgtgggcgccatgcccatccgatgagaagaccgacgagggcggggagccagagcggtgcagcaagggaggcgatcttgagggtgacctcgccgaggccgtgccatcgtcatcctccttggccgccatagacgacgacccctttctaccgtccggcttcatctccaccttcttggccttctcccaaaagagagagagtggaggggagatggagacagaggggagtgagggattcggattatcccgtggagaacgggatccagtgctatagatttttctcattattcatcaatggataggtaagaaaactgtcgacatattttcttttagaaatgtgtcacatttttttatccattagcctttaggcagtggcggaggggttgcctcacttaatcatgtgtccataccaatggagtcatatagaattttcatgtaatattgtactaaataattgcgcctcccatcaattattaaaagagataaatcaatatgtgatgtcaattgtatcaaaagaggagtacaacgattaaaagtactaaccaatatgagtgaatccattataccagcctagtagcacctgttcggcttggtggtctgcaatgcacgcgttgggctttacatcttcgtagcttaattctccatctaggggtacacatacatgagccaggggtgcccacatggtaattaatcactaattttactttcctacccgggttcttaggaacccctcgggactgcatagcttcgctccagctttaggcactgctctctctatcctgcagaaaaccaatctagtattcaatggaacgtttcttatttaaatttattgtattagaatatttcatttaaagtatgttgttttttagatggaggaagtagtgttgtagcagcgttattgtgacatactccctccgtcgtaaaaaagataatttaagattagatgtgacatattctaatactttttatataaagtcgttgtattaagatatgttatatttattcccaggtttattttgtgtttgacggaaggagtatcgttttcaagaaagtgctaaagcggttacgatagccaatcaatccactcccaacctggactcgctattccaccttttggctaaacgtgcccatgcactcattacaaacgaacaagtctcgacacgtaggctctattcagattcaaacttttttttaaagaaattttaacttttccgtcactacgtacctcttttccttctctcggtgacaactgactacagcaatgacgcaacgtcgcctggacatactagcctcgccacaacttcaaatgccccacgacatccacacacatgcaatccatcgagtacactccactgcgcacatccagccgagctagctcgcgcgcgcgacacagctctcctcggcgagacggcgacgtcgtcgtcgccgtcgttcggtcctacgtcggcgggcatgggaggtggccgtggtggagctccggcgacggcgagcgcgcgtgcgcggcggcctcatcagcctcgcgtgctgctgctgtgcagcccgtgcttgggccacctcatcccgttcgccgagctcgcgcgccgcctcgtcgccgaccacggcctcgccgccacgctgctcttcgcctccgcgaggtctcccccctcggagcagtacctcgccgtggcggcgtccgtcctggccgagggcgtcgacctcgtcgcgctgccagcgccggcgcccgcggacgcgctcccgggtgacgcctcggtgcgcgagcgcgccgcgcatgcggtcgcccgcagcgtcccgcgcgtccgcgacgtcgcccggtcgctcgccgcgacggcgcccctcgccgcgctcgtggtggacatgatcgggctgcaggaatt

SEQ ID NO: 67987 - DNA, 7641 bp, Oryza sativa
agctcggggtgccgttctacatgttcttcacctcgccgtggatgctgctgtcgctcttcctgcacctcccgtcgctcgacgccgacgcggcgcgcgccggcggcgagcaccgcgacgcgacggagccgatccgcctgcccggctgcgtgccgatccacgcgcacgatctgcccagctcgatgctcgccgaccggagcagcgcaacgtacgccgggctcctggccatggccagggacgccgcgagggccgatggcgtcctcgtgaacacgttccgcgagctcgagccggccatcggcgacggcgcggacggcgtcaagctgccgccggttcacgcggtcggaccgctgatctggaccagaccggtcgccatggaacgggaccatgagtgcctgagctggctgaaccagcagccacgtggatccgtggtctacgtgtcgtttgggagcggtggcacgcttacgtggcagcagacagctgagctggcgctcggattggagcttagtcagcacaggttcatttgggctatcaagaggcccgaccaagatacatcgagtggagcattctttggaacagctaatagtagaggtgaagaagaaggaatggattttttgcccgagggattcattgagaggactagaggggtggggcttctggtgccgtcgtgggccccgcagacatcgatactcgggcatgcatcaattgggtgtttcttgacgcactgcggatggaactctacgctagagagtgtttccaatggagtcccgatgatcgcatggccactctatgcggagcaaaagatgaatgcagcaatgatggaggttcaagcaaaggtagccatccggattaatgtcggaaatgaaaggtttataatgaatgaagagattgcaaatacgataaaacgagtgatgaaaggggaggaggcagaaatgttgaagatgcggattggtgaactcaatgataaagcagtgtatgcattgagcagaggttgttcaatcctcgcacaagtcacacatgtgtggaaatctacggttggttaaaaatgaaatgatcagtggaaatcattttgtactgtgtttttcatattgcaaatttgctttggttgaccttgtgaaatttaatgcagactatttgcactacatccggatcaatcaaatatataaccaatagatgattatatacttggtctcgagggcagggacaaggctaaaatagtttaggacacttcgattgtcttaaatcaccttgaaaattttagagaaaattcataattcattagttcagctccagccgagccctaagtattaagtaatttctagtccgccctgtttggtctggttcatatatagacaggtaaagtctacattattaacgtctcaataagttgttttagaaaaatgcgtttctcattcgcaaaacatggtatttgattgagcaaaggttgttcaatccttgcacaagtcacatgtgtggaaatctaccgtgtgacttgcacattggcaaaacaaaggtaattgatataaagtcaacattaaagtctccagtgtgactttcgctgttgcaaaacatggtattttattgagtaaacttaacattaaagtcgacattttacagtttccatcggttgtcttagaatcgtgcgctttcgcaaaacatggtaaaaaaaaaagtctgaaaaggcatgttaagaaatgccagtaatttttatctgttaaatatatgataaatatgcctatcgtataggcatgaaaatagagcggatacggacgcataatgcccatatcatatttggtttcattttttttgccggatatggaaacgaatacggatagctcaaatacggaaacaaatacggattatctcgaatacgaataagaatgaaatatgatcggatacgaatacggaaacaaatatttctcagaacatgaaaagcaacccaacttctaatagaaacaaatatcaacatatataattagctcatattatataaactgtagtataatttataaatattttttaaaaattaaataatattaatagtgtggactagtgttaagagatgaatcactattaaattttaaaaaaggtatattaaaggttatagagttataaagaaatatggtatgtctaatggcttctacatgtatctgaattattatccgtatctgacggaaatcccgatatcatattcgtattcaggagaaaatatccgtattcgtatctgcatccaaactaaccgagaattatccgatccaaaagtatccgtattcgtttttcttcgtagcggacggaaactatccgttccgttttcatcctactctcgtaacctccaaaatttgtttgttctttatgagtgacggtgattttcttcttaacttcactggcgagtagagagcagagactgtatgcacggtagtggtactacgtatttcagatgatcactcgcaagagacgatgaacctccagccatatattcgcggccaaccaattcgttagttgtaattgttctaaaaaaatcgttgtaattggtcggtgtgccagtttttttttttttgtgtgtgtacaatgaatttgaaagctcactagtcaactctgattaattgccttgatggaattcatagattatataatatactagatcctagagattcacaactttttcaaagcacatgtatctcttcctcgtaggagcaattttcttattttggtgataacactgtatagttgactacaacattgtttttcaattcatagtactgtactgcagtaaaaaatagttgtcagattttacattaagatgtctaaggtttgactgacaatatgtttaatcaatcaatttttttagatttttaatcagatgtactttactaatatataatatattacctttaaaactactcactttttgttgttgctttaacaaatagagtaaattttaccatactataagttttatgtccaagttacacaaaatcacatgggttttggtatatgatgtataaccctgggtattacagttcaaaaggattacaaaactacaccattatctaatttaacttgttattgtagcaaaataaaaatgctagtatgcgacgagtcaaagaagttgtaaatttgatatataattttaaactcctaaataatggtggatcaaagaatactttgtcaaattaattaatgtgtggttttataaaactatattatgggttatgtagcatgtgccatgaaccatgtggttttatgtaagttggatcataatacttgtgattttataaaatttacttaaaaataactattaaaattcaccagttctgggtcaaaactaaaaggttattcaaaattcaatcgtatatatatatagtaacaagtgtaaactggtactattataaccactggataacacatgctaacatcgcaggctgccaccgaccttgtccctctcttgctaccttcttctaatccccaccttgccttatccttcagcgtaaagattcctttgtagaaatactttatgactttcgttgagaagtgaattttagtatatgacgccgttgactttttgtccaacgtttgaccattcgtcttattcaaaaaatttaagtaattatcatttattttattgtgacttgattcgtcatcaaatgttctttaaacatgacataaatattttcatatttgcacaaaaaatttaaataaaataaaaggtcaaacgttagttgaaaagtcaacgacatcgtacattaaaatatggagggagtatttatttgttgaaaatgattgcttaaacatgtgtgcacaagataaaagtgccaagtgaacataaacagagggtacacagtctttggtctactaatttagaacgtcatttgcactgtttactgcattatattttgggtaatgaaatgaaactagtactatatatggagtatgtggtaatgtcgcggtgtcatctgatattaaaaggaaacaaccaaaagaggttaggttaatatatattttggcgataaaacatagaataagatagttcttggtcagctcgttaatgtattctttcaagaactacatcacaccactattaaacttagtgtaaaataacaagagtcggtagcagggtgatatatacataagatcgaaacatatggtcatcgaggtcagcttgtcgtgaacaagtgcctcccatgatgtagcacataccggtatgcagcaaaggatgacggccgggcacgacagtgcggtagaggatgacgaaaatgtggtgtgatggtccagatgcgacggcagcgataggggaatgggtgtgacggtgaggacaaccgatggatgcgttgtgtgaagtaaaggacgagggtgttgagtgatgaaaagggtgtgtgatttgcgggattcatggggaatgacatggggatggaaaggacgtgttcaggggacgccagctacatacgaggtgggattgtggaaagtgaagacaatcggagacgctttagatggaccgtccaatgcaagtctaaatattggatgacaccccttatcctcttgagcacactttttcccactctttctctctctttcccatatctctatgtcatttatacgactctaccatatctcatctagagcagcggcgactcttaagctcagtggtggctcagcgtgaccagcttggcctcaacggcacgacgaactcaacctcaacatttttggggcagtgaggttggcctcggcttcctctgatagtgcaccatgacggcgatgacctctactacctctccttcctcgatggtggtgcggtcagcgtcgtcttaattctcaacggcagcacggtacaacggcaacaaggttggccttgacttcctcgatggtggtacggttggcctcaactttcaccatgggccgttagcagcacaaaagacacctccagtgcttatccctgcaatggccaaccactcacggtataggaggaatgacgatcgcctactttttttttacgatttttttatgcttcagtccacatttttttggtgtttcattttgtgggatcaaaatgtctaggtgggtattatggtggtgtttcacatatttctgtctttgtgtgtgtaatccgtggatgtctcaataaataaaatgtaacaccccaggtagccacatacctagagtgtcacaccaaactacactcaaaaaccactaactcccaaaattattagaaatttcagcagagtcacctaaaaatacagacatccacgacaggtagttataaaataactcaataacgataaaaaccacacaatccaacccatcctagctctacaaattccacgtaaaaataaggaccagaactttaaatgaccttcataagttctacgcaaaacttatctaagtagaaacataatctaaaactaaattttaatagtgtgcaataataatgtgtagttcaagggtgctactcccgtcccgtgccgatcaatatcattaggtacctaaaaaccaaattaaacacaagagtgagtaaaaatactccgcaagtataatattgaactagtaaaacatacacaggtttaatgcaataagaaaaccaatatgaaacatttgtcttcctttaatttaaaacgaaggaggcaaaaagtagtagttccctcccgggcaggtgtgaatatcctcttagcattaccgataagccgagcaagtgtgatcagctcttctcaaggatcatgaatgaagatccaaattgcattcccatgactacgcatggtacttgaataatgtaaacaaaaacttccgccagaagaatgaaacatgaataacgttgtgaacttgaacatgaagtgaaatatgaatacgtagcataataccaaaaccacataattgataatagaaaactttgaataataattggataaatgaaaccaaacaaagtaacacagtttatccatcacacaagtccatcttatacttgccttaactccttcaataatccgactcaactcctccaacattggaaccctccacacctgtggagcaaaactacgcataaactactatatctaactaataatagttacaaggatatttgctaaaatcgaaacccagttcatataaatttttgcccatttgtattaaatagcctatagctcttccattactgttttatgcgtaactcacaaaccgtctaatggaacctagcaaataatacaacttcggacatctagaaaaaattgtctaccactttcatgttgagcacaaaatcagattatgcctctgaaaatcccagattaaggaaaacgaattgctgtcctgatttccggacccggtcggcagtactgtttttgttgtttatcccaaactgtttgtcggaattgagtgaaaccagcggcgttagaaagatatcgacgatgactacaaactttatttaggacaactaacctgaatcacgatggtttaataccagatttgaaaatactattgttagcccataatcaacaactaagaaaacactcaaccggcaattaatcgatttccacgtgaaaattgtatttctatggactaagaggagttacctcttacccttacagaggagaaatcgaatttgagatcaatttgtgaaaacccagaaaatccccaacttttgcctctcttccctttttccttcttttctcctcctgctttccccgcttcctgaaactcctgttctctgttcgttccagaagcacagcaacagaccagcatcagtagcagcagcggggaacgttaacagaaacagaaacgtcaccaaggagtcgagcaggagtggcgctggacggcgatggctaaacctgtggcgacggcgcagcagcgattggggtgatggcggctagggtttgtagcggctgcagggttatcgatctcttccccttttctcctttttttctttttttttcagttggttaaatagatatcctgatgaagatcgaatggcccaaattaatttaatcaccagtacttcgttcggactccgattattataaactcatagtctattttgcactactcggcgagctctacgcatccacggttcctgatcgcctattcgaacaacggtttaaaaattaaacttttgcgcgtttatgctaatattccccgaaatatactattttgaaactcggggcattacatgaaacctaaagtttcaaacgctacactaaaatgtttcacggcgcgagtcaattgggtttcattgtttctatttgccgaaatatttctgtttgagaacagaaatattttcatttatgaaatgacacatttttttcctgattgatgaaacatttgaaacattttgttcatcaagtagtgtaacatgtgaaacatttcgtaacaatattgtgcaacaacatccgatgttttgcataatatcggacgtccgatttgtagcgctccccgaagacaattttaagcgttgggtttcacacaaataatctaaaagtgttgagtgatgaatgaagaatgaaagaatgtaaaaatgataaatgagttagtgatttattggatagatattaaatactagttgtagttattcggggacatccggtgaaaacgagctaagtattggaaaccggtaaaaatcatacttaaaagtttcataaattcatgaaaaaaaatactagatctaggtgt

SEQ ID NO: 67988 - DNA, 2055 bp, Oryza sativa
caaaatcctttatattatgggacggagggagtacttttttaaatcctccactctcatgttatctaatcctattggatacatgcattatatttattaggatgatccaaactacaagatgataatctttggattaatggtggttgtgtcttatattttggaatggagggacttatattttggaattgagggagtacatgagagttaagaaaagacaaagtctcaatcataagaccatagtaaggactgcggcccagtggaaacggatatccgcaggtaaaatgccatttttcatggctggaactgagaaggatatccattctactccagaagtccagaatcgaataagtaaaagacaaaatcaaaaattcagaccaaaaaaaaaatcagagaaatgaaaagaggctgagcaacaactcacctcacggcggcaatgggcctcctcgtccacctccccaacctcgccggcgcccgccgcccatcgccgtgcggcggccaccggagggcccgcggcggcgcgcggttctcggtgtccgccgcggcgcccggcgggggcgtcaaggaggaagaggaagaggaagaggaggaggaggagaaggggacgagggggaaggagagaatagtgattcgggtgtcggacccggtgcgggagaggcggctcccgccgccgctcttctcgtccccggacgccccctcgccggcggcggggcggcggcggaggaagggggaggacgaggacgacggggaggaccggcggcggcggtaccacgtcaacgtcggggacgccatccgggcgctgcgggaggagctccccgccgcgttctaccgggagcccagcttccatatctacaggttcgtgaatcgtgagtcgtcgacctagattcccatgctttcccttgtcgggggatgatgatgattgttgatttgcgttgacggtgaaactgtggcgtagatttgacccttttctcagcgcacgagtggcactctaatgtgctctcttaagtcaaaaattggggagagaaaaatggtgatttctagtatactttatgaggtgttcttaggccgaattggagagatgatttgcaaaatttttgatgttttagtcgtgtcgtggccatagctaaaggattgttatcaggacttagataacatagtcaagtgcgatagagtctttctcagtggtttagtggtgtggttagaaaggctatgagttataaaaagtcaatcactcattatcttgttggtaaaagtactggcctcattatttttaattattaatttaaactaggaaggtagcccgcgcagatgcgcgggcaccttatttagtgatatttgaaattttgtaacgaatgtttatatataggattgtttttaaaaaatattttttactcttctaaatctatgtttatcaatatttttttggattgttttgaaagtcggtttcaatcactggatgtacggacacgcgttaagaaggtacatgctcctggacatttgtctatatgcttatgtgactatggaggtaaggtggaccaacatggacgtcgggtcctttaagggggtttatgtgacatcctagtgcaattaggatgtggtctatgttttttttatttaaaggatatgatctgtgttgtccataagcattgtgtgcacttgtgtccataagaatgaaagtgtaagtgatgtgatagcgtaagtgagcgtgccagttggatgcatgctgagctgccttgttttgaaggacgggttgttacaaattgtaaacaaattaaatcacttaaatttataagaaaaatgtctcaacaatagagttggttcatatgaaactatcattttatactactgtgtttttttaatttaaacttttaagtaatattttttccttgtatactaaacatgtctttgtagattttaggacaataatttaagaaattttctattaaaaatatgataatatgacttctttatctaattaaagacatactcacgtacttatatttacttctactacctacatccataaatcgaaggattcaaatttatcctaaaatataagag

SEQ ID NO: 67989 - DNA, 4961 bp, Oryza sativa
tgatatataagcacatatcggttagaaaatctactcatcacagtaatagaattaggatagtacttgatatcgaacaacttgcttgtatgtcatgcacactgcatattggcgttcatgtatgaagaaatcaaggagtggccactcatgcatgctagtgggtatgtggaataccagatcagctcagcattaaaattctttgtgaagtcttatgcaacataaaacaaattcttgctagttgtattcaagcaaacttacaaatatcaagacctcaaggttgatttttagcagaatttagctatgtaccagaacaaattttatctatcatggtatattcatttctgaaagaagatgcaatccttgttagttcctaacctgctgtgatactgcctccagagatgatattgtcttcaaagatcctatcaataatttcacgggtattgataactacaaaaggatattctgggctctacggtttactgggcaaattttcttcaaagcactatggatcgacattatcagcatatggcagcctgtcgaggatgtaatcatgatccgctggattgtccatggcattcctagagttctctcggatggccctggcagatttgaaggcacctcagagtataagtttgacaagaatgggaagatctatgagcataaggttgataatgttgccaagaacacaccaacgaaatttaaggtcttgccagtcgtagagctcatcagatcacttggatgcccatctactccaaaaccaacatattttgagacgtcgtccctacagctaatatcgctcttgccattctggttcaaattgacttggatgagatgctacttgtcattgtaccttatcctagcaaatttatcaaaaggatgaggatcgatggttgaggtccaacccaatgcctctaaattttgcccttccattgtatggtagtgtatacctttgagcagctcgccaatacctacatgtaaacgattttgtttgtgtacagctcaaagtttctgtctaggaatgtaggcatagctgaagttattccaagatcttggctgagttttgtaagctgtatattgccccctacctgggtatgtaatcaacagacgaggcaagtaaggaaatcttacatgcttgcacgttgcctgatactgaactttttgctatcgaattgcaaaaggttttataccaaaccaattaagtgcttgggctgtgttcctgtgaatgatctgaagatattttgggtattatgatcaatgagcagtgaagttcagttacagatctaagatgtcactgtcctttttttggtctcaaggaaggggtcaaggaaagcctgcctttccatcactgtctgtcactggcggagagtatagaaagtcgtcagcggttgcattatccataactatgatcttgtctaatgtctatgtcagccaggaagactggtttgtaatttgttacttatctcttgaagctttgcatgcaaaactgggttgtacttgaaacttctgatattacaactgaaccttgcaatctttattagtagcagatatggatctgaatcatacaaactagcatcaaatcaattagcacatgatgaagctgactatgaactcaactgaacacctctttcaaaacatgtgccatactgccattccacatgtagtacctttccaattcttgtttttcataatttggaagctactaaccccgataaccctgcctccaaaatccatactgctattagtgatgtagtaccttccatttcttgtttttcctaatgttttctcatgtaataattcgtgatatttgggttaatttgagacaggcttttggttggtgtgtctatgtccataaaataaatcattaatcataagcttttctaagaagaattggcagacctgaattacaagatcagtagaacttgatcagcatgatctcttacaaccttatacttaagagtgaaaagaaacaaacaaatgaacatgatgaacatatatcatatatatggatcatagctcacagcaacacaaccaaactagacaagacaagtacgtagtaaagtatgctttgcaaagccctgtttgaaacgcgagaatttcagagagatttcaccgagaatagtttgaattccgacgcgatccaaacaaaaattcttgcgtccaaatacaggagcctagcctagttgtactcgatcagaagcaggggaatcccccgctgatgaccgccgccgacatgccggactccctgcagaggcagtccagcttccaccctggcagctcgccgccgccgccggagcccggcctcttctcgctcgacgcggcggtggacaacggcaagccaccggacgatggcgtcctgcccgcctcgcaggaggccgcagcgccgccgctcgccgacgccgggacgacggcgtcgtgggtgggctgagatgatgatctctccggcttgctgctcttgttggcctccatggatggctaatggctttcgcctccttcttcctcggttttcttggtttggttggtttgcttgcgaattgcgagatcgcgtgcttcgctagcgagcgactgtgtgcttggttggtgcgatggaggagagggtggtgctattacaagggtgtagactgtagagaggataaggatgtgcatgaataccatcaacgagatacacggtttcgccgccacgtcaataataaatggtagtaggttggagaaagaaactagtattgtactccctccctccgtttcacaatgtaagtcattctattctaatattttccatattcatattgatgctatatacattcattaacatcattacgttgtgaaacagaggaagtagtagtaacatggtgaagatcaaagttagaatatactagaaaacaagaaaaccattagcataatatataataattaattgagtttaaattattacataatttgaaaattaaattatctgatattttatataaaaagttttcgtacgaaatacaccatttaatattttaaaatgtgtgctaatgaaaaccaaggtgaaattttatatctttataaaaaggaacatggttataagtgaaaattttcttcttcacgttataattaatttctttgaaaggcgagacttgtttttaaaataaaaaaaaaactagatatcaggtggtgggagggcctatacgagattctgttttttcctctagtgccttcgctttttttccatatgcacatatttcaccgttactattttcgttgaagctcaattcatctcatctaagttcaaagttgcatcctatgaaaactatccaaatttgaatatcacattcaaaatgttacatttcctacgtaaagctgtgggtggggtacaaagttttatggtttctaaatgaaaattttccactctatagttttttttttgagaactccactctatagtttgatatgtattctctaatcaaaatggttctcgtatttactagaaattttcaatcagttttctacttttcttttttattttacaaacctctctcaagtagttatcaagtgagtttagcaaagaaaccgtcagtactgagatacaaactattctattcgtcttaaaataatatagctaccatatagttatattatggagtatatattagctaccagatagttatatatattttagaatggagtaagtacgatacacgatgtatatagagtacacgtggtcttctacgatggtctgactcaaaccattggcgccgagggagagctcgtgcgtgcttgcgaattggacttggccgcccatcgctgtagtgtgggaggagaagctaattcttataaaaaaaaatcacacctatttagtatcaattagagtgacgttgaatgctgcaagaaatgcactccagttgaatggggtaaggtgatgatgtgctgctgatgtgcagatggcttgtctttgtatcgacagaagggtctggacatagaggatcaagtcaattatgtcagctcttactagattaataaagagacgatgttgatatatacttggcagatggactgtactcagtgtgacaatctgctcatgttgtgtgcagtctgaagggagaagcagatagagaatagcagccacaaaagatattggtttacagttagtaaaataattttcgacctcctaacgaggggaaaaccatttgcttgcctaagaggaaccaatcctttgtatcaaagctcttcatgaggattcagtactgtttacatatagtgccccaaatacgaatgctcatatcttgttttctgaatgaagactcagttaatgtcagtgctaccaagacaacacaagggggagagtcatttgtacttttaccccatgcaggtggtgcacataaaaactttaggaacacaagttacacagcactgctcttgcagttaaagaaatattaaaattcaaattaacatctagttactttttgttgacatatacgccgcaaaagtatagccaggacagtttgcccaggtaccctctttctgctatagcctacaaattctatagaagcatctaaaaaacgtgtaaaaagaataaatcagatcatggtcctcaagatgttcaataaaacactagtcatcaacattgtatttcagaccttctggtcaagctcagactgtgatgacagtatattgtgtttctgtgttttctcgctgggtgctgagtaaacctggcgctctttgcctcctggtttcgatgaagcattcccataccaaatcatgccaataacagcaaggatcatgccaatcgcaacatggaagttaaggccctcttttccaaagaaaagaaagcccaaggtcaacacaagaaccgtcttcatgtggcctagaacttggaacgagactgctgtaaatcttccgatgcatatgaattggctaaggttggtcccaacagcaattatgcacgacagtatgatgaagaactacaatgcaggggctgcaggaat

SEQ ID NO: 67990 - DNA, 1292 bp, Oryza sativa
aacaagtacttcagaaaacacatttcttaaaagaacaggttaaaggtaactgtaaccttataccaaacattatttatcatagtcctcattgctttcaagcctacttgaaattcttgaaccaaaccaagggcctcatcgtttgccctatggcttataagccaaagccaaaatttgaattttaaaacttgattttgaatttgactttgattcttttttaacgtagtttttttttcaactttggcttttcaatcactaagaacatatatacaaaagttttactcacatatcattttttaatcgctaataagccgttatggcttataataaggccctattcttttcttgttgtcttttctccaacaagagttggatgaagattaagattttcgtggcacgcttttcaaactgctaaacggtgtgtttcgtgcgaaaactttttatatgaaagttgctctaaaatatcatattaatatatttttcaagtttataataattaaaactcaatcaatcatacgttaatgacacctcgttttgcgtaaaaaacttaatcttcatcttcatcttcatttttaggacaaaagaacaccacctaagactagaccgaccgatgggaacccaagcagaaaaatgtttcaagttccaggatatactaccatatttcatggtaattaatatttacctggtgaaattatcagtagagctatatgggtttctaatgatcagtttataacaagataaacagagaatcaccgcataccgtaactattgctgtgtaattgaaagtatcaactcttttgttggtcagccagaagtccacgaaaggccccagtactagtaaagatgctgcctgagctggagcagtatgacccaagaggttgaatgagccaagcgagtacttcctttgaaggtgatgaacatactgcagcacagaagcaaagaaacaaaacaagtaatagtgttaagaaaatttgccatgaaagtgcgtagaaaagggacaagacttctattagcagacaaacgagcaatatccaaatatttgaagatcttttactaactaaacatttcttttctacacgattaatcagaacagtagttagatggaagctaatacattctttagctcaccaaacctacaacaaaggggacaaaattcaggtttataggatgaggcaaaatacacatgagttcacattaatggcttggaaattctgtagaagggaacaccacatactattttttttcaggtttgaatattaccaacttgggagcaaaagtatcagggctgcaggaat

SEQ ID NO: 67991 - DNA, 995 bp, Oryza sativa
gcccaagaccccgccggcctctccctgccgtcgcgccagcctcttgccgcctgccaccgctcgacgaccgtgcgcctcctcttgccaccgtcaccacgaggtccgccgtcgttggggtcgcccagacccgatctgaccgcagggaggctagatttggcgccgggaaaggcggatccgcatccggtgtgggcggatccgctgcgccgaccgtccggccgccacctcctatgatccgccactgctgagaagcctccggtgtcccccgccgctgggcaacctcgtgaggggagcgtcgcgccgccgccgtccttgtggccgtccggctttgccgacgagccgctcaggcggcggcgagtcgaaggggaggaccagggaggggatcctgtgtgtgctcattcaacagaaaatgatttacggcattcgcaattttcctaaatgccaacaccgactgtacaactacgaaggtaatgagttcaggtcggctggcccttccattgattgctaaagaaacgcaacaagtaagttgaaaacaaagcatgctgcaaaaagatccgaagtttgcaatcatacattgtccaatgctccaaaggtacagtatacaggtagcaacatatatgcaacttacagaaatacagcacatagacattttttagataatgggttaaaccagcctctacatccggatatacacaaccaacagaacatagacatgaacttacagaaaaatggatgtacataggcaacacaacatatacatgaacttacagaaaaaaccacttactgcatatcaatcataaatcccaatgccagcagcaacaaaccgcaaatgacgacagagggaaaatgtgagatacttcaagacatcgagcaactagatctggttacgttgttgctaggaaaacacatcggaagatacttccttacatctgggggaaaaaaattccagatacatgcagttgaaaaccgaaaaaaaattcaagggaagagcacagcga

SEQ ID NO: 67992 - DNA, 1916 bp, Oryza sativa
attcctgcagccctgaattgcccgtgcacgtgctcgtgtgataggtcccttatacgcattggagattgttggatcgggagtggcagttgtagaagaatgtgaggagctaggtaggtcctcatcacacaatgggataattacaatattagacctcttagtatcatgatgagctgcatgctcgggacatccggccatgtttcattggtcgtaattatccaactaaaatacaactgagtggtgggctgtgggtgtatggttttgctagttgcgcccatggcaatttaaggaccggttcgtgggaaaccctagaagacatacaacgttaccagaagcgggaatgggtaactgcttgatctgtagtatagctttcctccggctgatgcatccaggcaagggtgagcgtgatggagttcggatgggccctgcgatggcctttgcggctcgttgattcgcctagacacgagaaggggctgcccgctgcctgttgaggagtgagggcgaaacctgaagtgtggtgtgcttggtcagagggagttatatgaatggtcttgtcacaatcactcgacattgtgatatgtccggccgggcgcggtgacatgccggtggattgtgtcttatgggtacagttgtgcacctctggccagagtaaaactattcgaatagtcgtgcccgcggttatgagcgatcgatcagattcaccgtgattagtcttacccctaataaatcgactcaatgcactggttagtttaggtgggatggttgggcctattcaacgtggtgtagcgttgtttagtggagatataatattaccttaactaatcaacagttttactgttttgctcaataaatgctttacaaccgcctttatgcaaatagccacaacccttcttgtatccccttgtacgtctgcatcattggtgtggcttgctgaatatggtggttgtactcagccttgctattattcccccttttcaaaagtgtagtgcttctgagccgaagacgatgttagaggaccaagactcagaccccagttgagttttgcctatggagtggagctgaagccccgctaggattgcctttttccgctgccgctacttttgtttcggtgtgaggactaagtgcctcttctgtaagtattttactctttatttacgtttggatctgtatattaatttgtcgttttgtgtaccctggctaattcctggacagagatttaatacacaaaatagtctgaaaatttgggctaaattcctggacgtgacattatcctatcatattattatttatcgattggtttctattggattatattattattatattttattatcatcggtcaattgtctttatataattatctgcattggacatatagccgattgctcaaaaccttatcgacatcagctaatatcagctatcagctggaattactccatcggcttgtcagccgatcggctgttttatttgctgtttacatatcttgtcagttgcagtatcaaactgactggcacgcccgcatctcatcaacatcttggacctgcactggagctaaccagatctctgtcatgccttgaaaatcgcctaatttaataattcaattattaatgcatttttagaaattatttttttaaaagcctacaagttgaactctaataatctagggaaaatttcaacataaaattgagctagataaaatttcattaaatactttgcttgtttatctgttttctagatttttctgggaattatttgaacaaggaaggtatttttaataaatgaaacatcatttcacgaattattttaattgaaaaagtctttaaaaccctcccctaggccgttgggccgtttccggcccaactcttctcttcgcgcgcagctgtgcggcccacgccggcccaagccgagccgccgcccca

SEQ ID NO: 67993 - DNA, 1222 bp, Oryza sativa
tgtattagttgaaaatcgattaaacttcggaaattcataactaaatcatcgtaactcggattcgagtggttcaagttgctaaattcatctaaaatcgagatctacatgtcaaaaatatccaaatgtactgtttatgcttgtttttgtactgttttgttgattttgttcatttgctttagtttccgacattccggaggagagcgtttacgttgaggaaggttcagaagcgtttgaagaagctcaaggaaagtcacatagatcccaaacaaccctttgagtatgttgaacccgtttaaagctaatgttttatttcaacttatgcattattttcgaatgtcatcgggtggtgagccttttccaattaattaatggccgaagatgactttattttcctatgggtaataaattgattagcttggaccttatatattggattggttcagctaaatgctctatatataattgcttagccatgcttaggaatattagctcattaatgggatgaatcatactacattattaattatggttatatttaatggtagctcacgatggttaactgtgttatgataattaattgataattaaaacctgattaaaggtgggttgtgagcatatggttttgatggtcatgctcatgacaattaaggaccggttcgcgagctactgttgtgaaacatttaccatgccaaccacaagccagcgtgggcaatggctttaccttttgtatagcatgattcattatggggtgccagactgagaagcggcgagaagtccgtgggggtcgctggggagtccattgcctctggttttgagggggagattatgatccaggaacagtgcactgtggtgagttgtgttgtgtgagaaatattgtcacagttcctttccaaggtactgtggtggtactgaggcgcatggtgacatgttgtggagttgtgtcttgtgggtacagtggtacatctctggctagagtaaaactattcgaatagccgtgcttgcggttatgggtgggtttaacaatgtttttcgtgattagtcccacactactcactattaatgataatactgtgataattaaattgactcctggtttggaatggtatattcctggtatggaggtttgatttgtacaaccggggttggttgttcagatgaggttgggcctatgcaacacgggtgtgttgtatagtgtttatttaatattgcttaattacttaac

SEQ ID NO: 67994 - DNA, 1892 bp, Oryza sativa
cttcgtagtcctaggatgggtctaatcccatcctaggttgtaatatattgggatggagggagtaagaaagtttttcttagcaatcagggtgtatgattcactacattcgcttaagaaatattgtgagatatttcaaaatccatggaatttagatggtagtgaatttattcttgaattttttccattgttgcgtacaagtattacttatattgacctatttccattcagtcgcacttttattcgtcgttttattcttgttgtacgtcaatagtcttgctttccaaatgattggcctgtaatatagctcttggagttgaaagtgtttatcgagtgtgtccagaaaattggtagcttgattcctctattgtgggtaagaaaatttgccatatacgctttatgctctttttatccagatataccactggtataaattcaaactccttgcacttgtcggaagtacaaatctctagctctagtcatgaatctccaaatttttatggtcatgaatgtcaggatggggagtttcagagtaggaaatggagatcaaatattcagacatgcagagaagttcagataagcagagaagaagcagagttcaggacatatcgtttcgctgagaacgtaagtgaagatggacggccggatgaaggaaattaaactttaccgcaggatccaaaggtgtagaaggagttatcttgtactattcactatttagtatttgtcgttgcctgcgagcacgatttttactctgattatgtcagcagcgctgtaattttgaacatgtgggtgaaaatgcgactgggagtatataacccagcgccgtaaggagaagaaggcatgaaaaagcaaattaatttgtcctagagtaacttagaaccctagtttttctcctgttcttgtcttgcggcggccacatcgtgagagagtgggagtccatttcaggtctgaatacgctggatctgacaatgaataccctggatagatcttgttcaaggtatattttcaaccaataattttgtgtcctctaattattttctccttgttgattcataaacttcgatgctgattctcctagtgtagagaaaattgggaattcaatctttaaagaaaatttgtcgtagatggctcgcaccctttttatccaaatacattgtcaatatccgatcaaactcttggcacttgccaaaattgtaaacttcttccttcagtcatacgtcttcgagtagtagcatggtttgtcatgccttgaagggatcttgtatatttctaacatatatttttgtatcatttaatttcttcatatattttctcctagtctgatatacccatttatatttttaggataaatgagtacaatatgtttctttagtactactatcttgaataattgttggttcacatccatttctccagatcaaggtcttgaataaaatatctctattattcagacatttgtagttggtcatccttggtcttctttgtctcaacctgagtttgtagccttcaaattatgaatagttgtgcctatgtgttgtagttaatatggcacataagtcatcattctaccttcttgtgtaaaccttcattttattctctctatacaatgccgtcttataactcaggttcatccatttagactccttttgtaggtcttcattccgttcactcgcggttttagcttaatagatataactattgttggcggtatgtcatgagacccttcgaccagacttgccgaaaccatgcacccagcgaggattcagactcgagacgtcaagattcatcggggcgaagcctcgtggcgaagactatggggcaaaggcggcgaagggtgaagagtcgcgttgggaccccgcaagtccaaatgcgtcctgggcgaagactaaatggcg

SEQ ID NO: 67995 - DNA, 3484 bp, Oryza sativa
attccctgttttcaggattggatccgtcaagtgtttattgatctgatgatcgagttgtggttatgttcttggggcttcctaccattcttatacaggttcaaagacaaggttaaaaggagaaaaaccctgctggacacggcacgagtttccttttctatttacataatcgtatccaattaggactattagctatgccttaggtaacaagacaatataatttctaagtcctaatctattacataatatgtgaacctggcccaccagtcggataaagcgatcgtgtgggtaacaatatgtgattgtacccggtacatagctcgtttaaaattcaggctagtggccttgtaattaacttcagtgcaaaatagattagtagtccatcgactggttgtctggttgccactacatattagctgcctacatggcagccactacatattagctgcctaacggccatgtacaaatctcactccaccgttaacgcgcaaaaccgaaattgtacaacagagttctgtaacataagagaaaaactatcgtcgaatatgggtataaagttagtttgccggtttgaaattgtaacagtgtagtataaagttagagtcaaactatcctaaggctgagtttggcactttagtttcccaactcactctctttctttttcacgcgcacgcttttcaaattactaaacggtccgtattttaaaatttttctatacgaaagttactttaaaaatcatattgatccattttttttaaaaaaaaattagctaatacttaattaatcatgtgttaatggtgaaccgccccgttttgcatgcaggaggggatttgttcccaaccacagctgccgaacgcagcctaagttctctctatgtacatagagagacatactagttatataactacaagacgatagtaatataggtgtgggtttgactagttagtggcctagtcgatcgagggttatgaatgcctagatacactgtaatatgctagattaaagagaagtggatgtaatcatgtctctttaaaaaatatcgagccccgatatcgtcaccagtttagatcttttcgcgatgttattctgtgttgagtttccaaagtaatatcatggctggtttaacgagaccactttggactcaagtgtcgctccccgcatgggcaaccaggtggcgaaaaacctagccgccgctcacccccgactcaggcggcgggaagaacactccggcagcgctctcgacggtgcgggcatatagcggcgagttgccagggcagcggacaatgccgacgcgacgagctggccatggaggagtggcaatgacggttgcgcatcatgggaggccgcggtagcgcggatccggccagcgcggctgagctgagacgtcgaaccagcaaaacttacaactgaaccaccaaatccggcatggtggcggggggggccttttaaaaggcggcaaatgcgggaaaaggaacgcccggtgcaaggagaacaacgggtccggcccaaggagacaaccgtgtggagcgagggcccaaaccatggttaaatttggcgcctggcaactccgtggttggctctggctggcaccgagcatctaacatggtggggcaagggcatagtggccaaggtggggcggtcggcatcggtggtaggtcgcgcacggaaggaggttggcgggaggctgacctagcgcgggttggcatggtaggagcgtaggaagtaggcatgatgatggcggtgggagcggcgtggtgcgagtaagaggagccgtggctggctggtgtggcacaagcggggtctgctgcggtcggcgctccggttggagtctcggtggaggcatgggcattaggacgaggcgacggtgatgcgggcaagcggcctaaggcatgcgagtagtttgactgaggcagcgatgacggtcgtgccgtgaggtgggtgagtaggcctgcgatgggcttctatccagacgctagtcctcctgtggtggcaccttgccgccacaaggtggccacatttggtccattattctctctcaccctctccctttctaacccatccgcgtggatgggtttggagtgcgccaaaggttgaggtcctacttgatggctagccagcggcaaggcgctagcgcggtggctacgtgttgaaggtgcacagttgatagtggttatgtttccagcaggcaacaacacgggcgaacaaagagattacaggcgaagcccagcccctccagggcagcaatggtgatgcttgagagcgccgttttcccttggggcattgttgagtgatcttctctgctcaccctgatggatttcttcaagtgaaaaccacgttgagggttcaaggtcggcgacgatgacacttttagtgtcgtatccttcctaaaggtgtcgtttagaatattcatttccttagggatgttgtgttcctgcttcttttttccttagggatgtagcgggatctggttatagacacacggtgtggttgttattttttctttttcctactatatcgccttctagggttgcagacttgtaatttattttcctgctctatcaatacgaaacatcgcattgtcatgtgcggattgtttaaacaaaagtactcccttcgtcctaaaatataagcattttcaatacagtaataagtcaaatatttttagctttgaccattactaaaaaaataaaaaagataatcatataaaattgatgttaatagatttatcattaaataaattattaaaatatgctatactttttatttaaaaaatcttacttttatatatattgttacttaaaatagtatctcaaaaatcatgttagaattaaaaatatttataatctaggacgaaggaagtagactccagtcacaaacatcacagagtcagccagtcaagtgaggtggtccacccttgcagatgctgtcgtcctcactagtcagtaccccctccgtcccaaaaaaagtccaatcctagctacgaacctggacacacatgtgtccaggttcatagccagagtttggctttttttgggacagactagtactcagtagtcagtagtcactagtcactactcactcactcccctgctgctttgcgttagccatccggagtgacttccattccggtctcacagaagtcaaccaaccccttccaggggctggatctggccggcgagcggcagggacagcagagctgcgcgtccctcctgcttcaggccaagaggaggcggcggatctggggcgggcgggccttccttgctgtctacgacaggcttgttcccgacccccagtttgcaagcatggagctggcgacgggggcgatgaggagcctgctgcccaagctgcttcagctgctcgagaaagagtacggcctgcaaacgggcgtgagggagaagatcaagtctctcacgggagctcgatgtcgtgcacgccgtcctccgcaagatcggcgatgtgccatcggagcaggtgggctgcaggaatt

SEQ ID NO: 67996 - DNA, 2517 bp, Oryza sativa
cgtcgacacattcttggtgcacgacgatggccctgaccccaccgatccacacatgctcctgcgcctgcggaagaagttaggcaagctgttcaagaagagcaaggctcgccgtaagatctctaacctgatccaagacattaacaagaagttcgagcaggtgaaagcaaggcatgtcaagtacacagtcgacagcgttgtcctcaagtctctagcggcaacgaccatcgatcctcgtctccagaatctgtacaaaagggcaacagagcttgttggcattgacgggccaagggacgatctcataaacaagctatccctggggggtgatgttgatgtgtccgacaagaagatgaaagtcatctctgtcgttggatttggaggactcggcaagaccactcttgccaaagctgtctatgaccacttcaaaccgcatttcaagtgcagggcttctgttccagtcgaccagaatcctgacatgaataaagcattcgatgaccaggttgaaccgcatttcgaatgcggagcttttgttccagtgggtcggaatcctgacatgaagaaagtctttagagacattctcattgatcttgacaaggaaaagtacacgaatccgaatatgatggtgttggatgaaaagcagctcatggacgaactcaaggaattcgtcaaggagaagaggtatgagtgtaatcaccaatccaatgactcactgcttacgttgtgactttgaattccagtatctgtacaattccttccttatatctatttactttattaaataaaggatgaaaggagcacattttacatctcaagtctagaaaatagtacaacgctaatcgatgcagattgatttaatacagtcatgcataaaaatgtaaatgtgttttcagcaagcaaaaacagttgtataatattcagatatattttctcatacaaatgagtattattaatttattatctagccacgcaatcgcaagaaaatcatgctagtcatattattcaaacaaatttaaacatatcaagctcatttgctcccaagagttgcaaaaaacaaccacattaatgagaaaagagagacattcatcatgtcgattttggtaggcccaagctatataataaattaatgatgtaggttaactggttatttgttagagctactgcaaattatatttatataacaacatgcagttgtattttagcactaagcacaagacatacatcacatacaaacattggagatgtaagtacatgtcagttatcctgcaaaaatataagtgcatgattcaattcatgatgtacaaccagctaatatagccaagcccaattcaaaccgactccaatactaactgaattgtagtctgaacaaacttcaaagaacttagccaaatcagattcaaactctaaactcaattttaactgaatttgattctgacccctaactctgactgaaccaagattaactttgaactgcactggttttcctcctgctctgatacttctatccaatcatgacataggtgtttcattgttattgatgatatatgggacaaggagtcatggaaattaatcagatgtgctctgcaagaaagtgattgtggaagtagacttgtcataactactcgtatttctgaagttgccacacatgctggtgaagcttacaaaattcagccactttctcgtgataactctgaaaaattattgtatgcaagaatagttgatggtgaatggaagtatttcgataatccatcagctaaggcatgtgaaaaaattttgaagaaatgtggtggtgtaccattagctatcattacaatagctagtttgttggccagtaaaccaggggaggactggtctgaggtctacaactctgtcggttttgggcatgaagacaatgatgatgtaggtaatactagaaggatattgtcttttagctactatgatctgtcttcacatttaaaagattgcttattgtatctatgtgtatttcccgaagatcatgtgatagagaaaaatagtttgatatggaagtggatagctgaaggtttcatccatgaggaactagcagcagggttaggattatttgagctcggggagaggtgcttcaatgagttgataaatagaagcatgatccagccagtggagacaaaacatgaagggtatgtagatggttgctgcgttcatgatatggttcttgatatgatccactcattatcgagtgaagaaaattttgtcactgtattgaatggtgatgagcgacagaaacttccggggagcattgctcgcaggttagccctgcagcgtgttctagtgcacaaggatggtcagctagctaatatcactctgaagaatgtgagatcccttattgccagtcagtgcttcggttcattatgcctacacactccggttttacgtgtattagatgtgataaactgtgcagaaagtgagacgcctaatgttttggaagatagggacaaaactatgccaagccatcttgggagtttacttcacctgaggggctgcagg

SEQ ID NO: 67997 - DNA, 704 bp, Oryza sativa
aagaccagtgaaccattagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtcttccccttcagtatatacttctggtacagatctcccttgaagctctgaaactgttctgccattttcttcagagtccaccttttcactttgtcctctgtacccgcaggaagggtgaatgtctcgagcattgtggtccacaacatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgaatacggatctctttcacaaggtgacgggctgcaggaat

SEQ ID NO: 67998 - DNA, 1554 bp, Oryza sativa
aaaggacaccaatgtgtgaatggggagattgttgaatagtcgcacattggttgtggaagaaaaaaggatctaagatataagtgggggagcccctcatctcattggctagctttttgggtgggaaagactctttacgatctaaaaaaccaatcaagctcattacagcttgaaatgcgttacttgttctgttgttcccacacaggctaaatagccagctaaatataacactttcggtaatgtcacgcccggaaattctatagtaatttccgaacttatttgtgcattaaatcctcgtccaggaatcagccgaggtacacaaactgacaatttaatatacagattcatcaaattaactaaaacgataaatacttacttatgaggcacttagtcctcaccatgaagaaaactacagcggaaaaaataaaatctagcgaagctccggctccactcccacaggcagctcaactggggtataagccaaacgtcttctccttctggatcctttttcttcaactgaggttgattgattattgcaaggtgagcatataacatactcagcaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccattctgaacaaccatacccggctgaacagatctaactccaaaccaggagctaagcaaattattaccaggtataacatccatagttatgggagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatatttcacaacagtagctcgcgaaccggtccttaattgtcatgagcacgactctcaaaaccatgtgctcacaacccaccatcatcaagttttagttggcaaataattaattaaccaatcacgattgaccatcgtgaactatcattaagccatcattaaataataatgagtcataaattatcccaatagtgtgctaatgtttctaagcatggctaagcaattatatctaatatctagttgaaccaatatatatataaagctcaactagtccaattataataacccaaggtaacaaggaataaagtaatcaagaacaaaagggccataacaaagaataggttaattccacccaatgacatt

SEQ ID NO: 67999 - DNA, 2754 bp, Oryza sativa
ttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattaaattatgacgcatttatatggattttaattaaattatgacgcaataatgaattatttttgaaaaggaaaagagaattattgcgtcagcggctagggtttcggtggaccgggcgcacgggcgacggttcacgcgaacggacggccgagatcaatccatccaaaacggacggccgagatcgatcggtccacgaccggctcacggggaacggcaacgatgacgtcagcgacgacgtcacctccggcggcggcggctcggcggctcggacggcgcacgctcgccggcgaacggcggcgcttcgacacgaacggaaggcaccaacggatagaggacaacgcggcgaactcaccggtgaccaaaaccacggcggaagagcaacggacggcgccggcgacgaggaagaagcggcggcaaccttcgggtcgacggcggcaacggcgctccggcggtcttcggcggcggtgaagcggcagacggggacggcgacgaccttgcgaacccgatggtggcgacggcgatcgacgacggcggctgcaacggcggcgcgacgcggctgaaccaacggcaacgacggcggcgactagggctacgcggaggcggcgctagacgcgacggcaggctaaagcaaaggtggcggcggatagaggagagctcgggggtccttttataggtgcaagaaggcggcggcgaaggcccacggcgaccggtgacgagaaggaaagatcgggttcgggagagagagaggaatccgattcgatctcgaatccaacactttccaagccgatttagccgatgtttccaaaggggaaaaggaagaggagatcgaggagattgtttcccctctatcgattcggccggagaaggaaaggagcggccggatttggaaggagacggcggcggcttgcgctagggtttcgggcggcggcggcggcgcgaggaggaagacaggcctgacagacgggccccacctgtcagcggctgagagagagaggagagcggcggctcggcggattgggccggactgggccgagggaaagagagagagagagggttttgggccggctttcggcccaaagccaaaagaagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttctaggcttttaaaatcatttctaataattccttttaaacaacaatttataatttaaggatttttaaacaagaaaagctcttaacaattataattagatcattaatgatcaaataattactgaactgttctttgtatcatttaggaattgagctctgaaaaatccgagaaaatttcagagagttgacttaatcatggagaatttaataaaaattaaatccatccatgctttagatttaggaaattttatttcccacattttacttcacttgtaaattaaagaacatttaacataaattctattattaatttattaaattatttataaatcctgaaacaaaaatcaggatgtgacaggtaagctccaataacatgtgtcttaggctcttagacacatctattacacccgtgcggctcttagacacgtctattacacccgtgcggcgcagcgcgcgagacctttctagtactattcttatgcccaagaggaatcaagccatatgaattaaattagtagctaaatcaaaaggaggaatttggaatatttggaaggagaactaaggatagctttaatatcaagagacgggtcaacaattaattccaataaaattggaattgcaaggatttggtttggaggattttcttggaccataattcataaaagggtttcaaataatttgaataaaggatttttaataaaaaaagtttaatattcaaaattagatttcaatcaagaaattcctcaatttaacaaaatatatttttaaataaaaaccacaaaagagattgaataccaaggagaggttttatgcaagttagttttaggaggtctctctaattatttttttctaggtttagaaggttattagaaatataagaatcggcatgacacatgactagaaaatagttaatttttaggatgttacaaacctaccccattaaataatctcatcctcgagatttctgaagagtccaggtagtagtgtgggaattttattctttctttggtccttcccaaaattccggatatccgactgattaatctgctggtagataacttgtattcttggaatattcttggatgtatgcattgggtaataaaaagctgtagattacttgatttaacttcatgtggttcaaagtttgaaaatccgacacttgacagcctttccaaatagagacatgtcatagggtatttctgcataggattcgatctttcgagcatatatatatatatacacttattgaggaggtcagactttttt

SEQ ID NO: 68000 - DNA, 770 bp, Oryza sativa
aattcctgcagccctaataacaaaacaaattacataatccgcatgtaaactgtgagacaaatttattaatcctaattaatccataattagtaaatatttactgtagcaccatattgtcagatcataacacaattaggattaaaagattcgtctcgtaactcatacgcaaactgtgtaattatttttgggaattatatattttttaaaaatatttacgtgtgtttcgatgtgacgggacaaaaaaaattaccggttcgtttcctttgtttatgtagcctatagtggcaacgcatgctgacgttacggtgtaccgccgtcgaaaaccaccctcgctatctctccgcgttgtcagacgcacgcctcccaccccaccccaccccaccccaaaccaacaaacgccgtgacaaaccgattccacgcacagcacggaggtgggagaggacgacaccccgtcccccccgtgtccagccaccaccaccgcgtcgtcgtcgtcgacccagccatccatcccacccacacgtcaccacccgcgcatcctccccccgtgctgcggcggcggcggcggccggcggccatggacatggacagcgtggagtgcctctccctcccggactcgtccatggacgtggacgacgtcgacggcggcggctcggtgcaccaccaccaccaccaccaccacgccctcccgcctcacctccccgcgggggtcgccgtcggggtcggccccggggggcgcgcgttccccaaggcgaatgtcgctggggttggtg

SEQ ID NO: 68001 - DNA, 13112 bp, Oryza sativa
gttcttatgttgttcatgcttagagatgatcagaattaggactatgatcatgcaaaattataatgatggacagtacatcaaccagccatctactaaacatctagggcctatttggtagcccatgctgctgcagccctgcaggtgcactgcaacagccatagcactaaggtacagcgctggtatactagttactgttggtatagctgcagccacagccccatcaagctatgctgaacagccctctagtctgaatatccaaatactacattaagtcgaatggtacacatcatccaatatatgcatatacagttgtgtcaactcagcttatttgcctcatttacctgcatatatttacatctgctagctacagtcttattagttccctcgaacctataaaaatgattatatatgtatgcaacaatttatctggcaaatgatcattattgtctttcctcacaatagattgatatggtagtactcacagagtcacatattgttctcttacacggtattgtatgatctttattctacaatagctgtgctaggcacataccagagatgaattcaccattctttatgtttaaatcctgttgctgcgtacactcctttcttttcttttctttttctaaattatatgtactttttatgtatcgaattttggaaaactacattccaaaggacaagttccaatctattgtgctgctgtcgaagcatcttttacagaaaaatcgataacgattatgttgcactagaaatattgggcctcatctaatatgtactactggcatagttttgttacttggttgtcactaattttatttttttacagtgccaaaatggacacactttatgttcaacatgcaaggctagagtccacaaccggtgccctacctgcagacaagagctcggtgatattaggtgcttggcactggagaaagtagcagagtcactcgagcttccttgcaagtattgttctttaggttgcccagaaatttttccatactacagcaagataaagcatgaagcacagtgcagctttaggccatataactgcccttatgctggttctgaatgtgctgtggctggtgatattcctttccttgttgcacatttgagggacgaccacaaagttgatatgcacagtggctgcacattcaaccacagatatgtcaaatctaatccacgcgaggttgagaatgcgacctggatgctaacagtaagtactataatagctcatagtattcatttttggatacctatttacaaacactgttcttatgatctttcctctcaatcaggtgttccattgtttcgggcagtatttctgcctgcatttcgaggcgttccagcttggaatggcaccagtttatatggccttcctccgtttcatgggggatgagaatgaagcgaggaactacacctacagcctagaggttggtggtaatggcaggaagatggtgtgggaaggcacccctaggagcatccgcgacagccaccggaaggtgcgggacagccatgacggcctcatcatccagaggaacatggcactcttcttctccggcggtgacaggaaggagctgaagctgagggtgaccggccgtatctggaaagaacagacgaacccggatggggcctgcataccgaacctttgtagctgatgagcaaagcgtacgacagatgaaacgatttgttgctatttggctggcttgttatttttatccattgccatgtcctgttttcgatagtccagtgatcgtgccagtgctgttgtatgttaagaagcaaattttagaggtgtaaaacattactgtaaagtaatattgtgtatatcgaattcaagaaaatcccacaagttggccaataaacgtctgtcatccatctgttcttatgctgtttacatcctgcctcgtattcttgctttcttgaggtagaaaacaggacagttttgcaaggagactgaagttctggataatctctggtgtttatcttgcaagattggtctaaaataaccatgtacgtagaataacatttattggtatgtaaggaatttttgtcttctggaactctaaaatactcctaggaacaaagcatggccatgtggcctgtatctaaacttctgaagtcccaatccgtggtagctgaactgctacggcaaggcgctacagtgtattggagtagcaattgagcactcagattaaaaccctaaaaacaaacggttcagatcagccaggtactgtagcatcaatacttcacttttcagcttgtactgtcacatttatattgtagaggttgatcatatccctaggattgtgaagggatggtgcagatttctcataatttaatttactacctgtgccttttgtactctaatacagaggatcccaatccgtggtggcttttgagggttcgcatcttctgctaagagcaaccacaatgtggcatagaggctggtagtaagcaataaaataaccttactatttaggaacaaacattgtgaaagctagcaatagcaattactaggtagtatggctactaccagcaataagaaactaaactatattattagtacagtgaatagtgtaggtgcagggtgtgggaggctagggattggtctttttttctattgcggggcataccttatgttcaccttttgcattcacacattgtggcatatgtattagctactaccactgattcttgggcccaccttattaccaagtttagcaataagcatttctttttgcctctagggaagaatggcaaaggcgcacttatgaaatgtgaggagagttacatgctatgccataggtacagtgataaatattgtttgattaattttttgaggctgttgtaacgattgatctcgtgcatccaaacttgatacaactgctgtaaatagataatgacatggggcactgtagctctccgccattccaactcagggcatctacaatataaggcacgggtagtagtagccttacgtaggctatactgtctaaagccacatataggaaactctacccccaataaaggatactctcaaatggttctacaaaatctgagggtactagtatcccacaatacgtgtctcagcccacaaagccacagagttattttcctcttctatcctttttctatttagccttttcttcttttgttttctccacctccttgcctttttcctttcgtcaccgtctctctttctctttcatcgccgcctctctccctctctctcgttgccgcgcgtctctgccgttctcgtggccgcccgtctcctccgcttccgccgccgcccgtctctgcgtggtggccaacggagagccgcgcgcagacgcgttggtcgacggcgagcggcgcgaggggtggggtggccgacagcgagtagcgggtgactgacggcgcgagaatgcaggagcgggtggaagacagtgtcgaagcttctcttcactgcctctctcccagatctgtcatgccggcagccggatctggcatgccagcggtcggatctagccgacgtcgcctctctctctcctgctgcccgtcaccatccaccactccgacgagggcgcggggcctactccgactccgcccaccgttggctccgcttcaccatgcagaggtgagaggggcaagaagggaaaaagtatggggaggaggcgggggacggggcaccgagatcgcccaacggtagcatcgattcgtggctcaagaaaagaagattggaggaggtagaggcacccgttcccctcgtgaggatcgcacctccctccagtggcacggctagtggacgggagatgaacggcatgagcaaggatacgagttcaagctacgcattgaacatggcctcatgggatacgatcccggcttttgaacactgtgcagacagaaactgcacagtaagttccaaatacaatacccagcacaatcttcaccaagatctatggatagatgcattcctgcagtagaacatagtgctttacgctagagatgaaaatggccagaaatgaatattacttatatgaaagcagctgtcgggaatttactatatctataaatttaattatttattaacgtaaatttgacgttgacagtaattagaaaattaaagtttatatgtaactattactaaccaaaagatagaaacgatatatattttatattatgttttaaaaaaaccgtcttacatgaattttcgtactaactccatccccaaacatagtaattttaaatttatacccttgccctgtgcagccaaagattcgatgcactggaggcacttcagagttcagagttgcagtcattgtcctctactgagctgctccgccgttgactgcagcggtgacacaacgcagttacaggttcggacggcatgtcggcacatcaccacaagagctacaaccacaacaggtactcctccactacggacagtaggtacaagtacgtagtattgccttgtaagaaaaggttacacgcacacgaatactagcagtattcgtacaagccgtacaggtacagctcggtgtaaggttcgtttgccagtgcccactgcctagcggtgggcagcagacatgcgcaggtggatggatggctttttgttgttttgctctcatcagtgccagggaacctcacacgttcgcctcaacattgcaagcctcttggactctaatgtctcgtgccttatactagtaattactccctccgtcccataatataaagtattttgagttttcttttttactgtttgaccactcgccttattcaaaaattttaaaattattatttatttttttgacctattttattatccaaagtattttaagcacaactttacattttttatatttacacaaattttttaaataaaacgagtggtcaaacagtgcaagaaaaaactcaaaatcacttatattatgggacggagggagtactactctccccgtctcattttagtgtagctatgagctttagtaacaccaattattttataattagttttttcattgttattagatgataaagtataaatagtactttacgtatgatttattttgaaaaacattttaaataagatgtacggtcaaatgttgaacacgaaatctacaactacatttaaaatgggatgggggagaccccatcctagtatggactagataaggacggttcatttcatcaccaaaataaacccgattaaattttagctttactaaatatttgataaggtattaacaatctaaactttgttcgtattagcctccactactaaagtttgataattctatagcctttctcgcagaaaattgataaaagtagcaagccaaacataacttaaatatctcaacattattaaatattgacactggtaaaatttatcattgctgaaatttagtaggaataaatcatgcatgaaagtgagcaaccccatataataatagtaattgagcgtatgcaatgccgtagtatgccgacgttcaaatggtctgtccaatatttgtgacacttccaagtggaaaatgactcacatgtctcacatgtgaggaatctctttgactatggttgtgtttggatccagggactttgttcctatcatatcggatgaatttagagtattaaatatagactacttataaaactaattacataaatgagagctaattcgcgtgataaattttttaagcctaattaattcataattagcgcatgtttactctagcatcacataggctaatcatggattaattaggctcaatagattcgtctcgcgaattagttcagtgttatagaatgagttttattaatagtctacgtttaatatttataattaatgtccaaacatccgatatgatagagactccctatctaaatagggtctatggcaccataacgaagtagtcatttattaaaaaaaatgggattaacagcactatgtacatattaaaagttgagtaaattgagaaaagatgaaaattttcattttacagctatgtacttttgtgaaaaatctgaaaaccaatactgaacttcaaaaccaaataatatttatttagcctgtgtttacaatactttttcccctagcccaaaaattaactggttttgaatggtattgtgctaacatggctacgtgttcactactagtggtaaaatcaaaagaaaaaaaatgaaataatttcacatgagaaggaagaaaaaaaaattctccattgcaaaggcagcatgaatgttactactactccatccaaaaatacaagaggctttatgggtaaaatccctaatcttttagataagagatattaccatccaaatatcgtacctcttgtcaccgtatgatttaatcaacaagtttgatcattgggtaggattattattaccagagtaaatgaagatgagaaacgattggccgcactcgcacgtgctccatggttgacactatagtgagtgtagtgatcacccaagtgagtgaccagcaatgcactaaccactcccctcgtctgtatcctatcattgtctgatctctcaagatccaacaattatgctcaccaaacaattcaggctactaaagtaaattacagcaaactgccgcgagacacggttaaatgtccaatcatgtccactaaatatcagctcaatctggcgaatatgcgagaataacattttcaacttgcatttctgagaatatttcaacttgcatccaaagtcataagcatctaactggaactgattccgatgcaaaaatgtcacaattattctgcaagaatggataagattacaagtccaaaacataattttgataatacattgtaattataagctttaatttcctcactatggttgcttagcaaaacaaattgtccaactgaacatctcaagaaccaaatctttctttggcctggactctgaaaacacctagaaaatctattaaaattacaacaagaaggctgcagaaatctaccaaagatgagaagattcaagagaaaaatacacactcagaaaatcatcacagaaagaagaagaattctaagttacaaatcaaactaacttatcttacaaatttgacacgaattcactgaagagattgacaggggacaccaccgattaaccccaaaatgggcaaatggaggagagtcagatcttggcctggtcttggtcagcaccggaatccgagcacgcggccgtccgccggcgagacgccgatgcggcacaccttggcggcgacgacgtggtgggtgaacacccggaggatggtcaccttccctttcaccaccagcagcgagtccacctccatcaccggcagcgccgccacctgctgctgctgcggcggcggctgttcttgctgcagcgccaccgcgcccaccgccgccggtgaggggccggaggcggggacggtgattgtctgcgccggggaggaggaagcggcggcggtggcggaggaggtgacggcgaaggccgggacggtgaagctggtggccatgtactgcgtgcgccccccgtcgatctggccggcggggatgtacatcgagccgacctcgccgccggcgtaggcgacgcggagcgagctgtcgtagtgcgcgagcggggagcggttggggttgcggacggaggcgagctgctggaacgtgaaggcgacggtgccgttgcgggaggcgaaggaggggagctgcacggccgtcacggcgatggccggcgcctgcggccggtagagcaggaacagcgcagccgcggcgccgcccgcggcgagcaggatgaacagcgccgccacgacgcaggacgccgccacggaggagaagggcgaggggcggtggtagcccgcggcggcgtagtagcgcggcggctccggcgatctggccatggcgaatcttgcggtggttcttggccggcgaggcgaggaagggaagcgagctgagagagtgggagggtagtcgctagtcaggagtcggctaaagttcaccgcttcacacgacacgagcggaaaagcgatggaagcgaggttggtgtgttttgatggtgtttttagatggttttgggtggctgaaaaggtttgttttagtggtaccagtaatactgtagccgagcactttgactcgagttgacttgaattgacgctttaccaggttgctataactatatgttccttcttttcccttttccttcatttgtcttctacaaatcgaatgttcgatattaagagtgtgtttgattgtatctgtttagtctggctcatctttctcatccagattgagctcgtcctagttaaggggatacacatccaattgtttggttgtttgtattagtctagcctggcttgtatgagatattgtttggttgtctgcacgagagatacggttcagaggagaatttgtttggttggttgtatgatacgcatgtatgatgatccagaacttaacttttcatatatcaatcttcttattgttagtaaaacaattcatcaattgagctaatgtagtggcgaaccacgggtggtgttcttttctcctgaagatgaagataaagatgaagattaaatgttttacacaaaacaaggtggtattaacatataattaattgagttttaattattacaaacttgaaaaatatattaatttgatatttttagagcaactttcatatagaaagtttttgcacgaaacacaccgtttagcagtttgaaaaacgtaccacgagtatccaatttttgttggagaaaagaacgaggtttatattagtgactaattacgggcttagagaatgagaacggtagaaaaaaaagaaaaagcgctctcgcgtcccgtcgcactccttgccaccgagcatgacccccactggcagcctgctctggcgagcccgattgctcaccatcgtcgtaatcaccgcatccatcacttcctgccgctcgctgcacgtcttgctccactactctctagtcgcgccgacacgtcgctccctgtcatcgtcgtggtggcgatgattgccgctgttgctcgccgccgtcgtggtggtcgcgatggttgttgctgtgctcgccccgtcgccgtcgtggcaaccagatctgacgggaaatgctggaggtgtcagatgcgaaagggattatgtggcaatagcgcggacaccaaggaatggatgggggaagacatcggtgatcgcgagacaaggtcgattgtgagcttccaaatctagaatcctctcctagtcttctccttcctcccgcccatctccttcctctcgaatctagctgaggtcgagcccggcgatgagcaatgcagcagcaacaaaacctagccttttcgttttcggggagaaatgagaaaggggcaaggtggtgaccagtgaccccttcgcaccgcttgcacacgcggctgcaatacgtgcacgtgcgggtgcagcgttgctgcacgcgttgggccaggacaagcaacgaagctcaattcgcccgttcctacttagcatatctgagggggcacttttgcatctactcgtcctggctccaagacatttacaggcaaccaaataggctgcaagttgcgatgagggtgagattgcaatttgtgcaatctcactatgtggagaaagtcttagccagctcatactccttacgatattagtgtactattaaggaaaaacaaagaatagcatgggattaactgagatactgtaacgtcccgcctctcctaggccgggcccgcttacatctggcagctttcataggtcatagattgccctcacagaccaacacatgtcttttctgcacactttgtcctcactcgggaagaatttcccggtcaccctcacagaccaacacatgtcttttctgcacactttgtcctcactcgggaagaatttcccggtcagtcacccatcctaaattgcttcaggccaagcatgcttaaccctggagttctttgaaaatcggcttctggaaaagaagttacaacttgttgatatgagtattctattaatcctattaagccctgtgccggaatgttgcagatactcccaaatcattggttcattaatgtatttggctagtgcaacgaggcctcacatctcatttgctacgagcaagatgagccggttttatttcaaatccgggagatgatcactggcaatactctggaaaaggtaatgcgctatcttaaaagcacagtgggctatggaattcactatactaggtacccaaaagtactagagggttattgtgattcaaacttgacatatggtgctgatgagaaaaaccacaagtggatatgtgttcacacttggagttggcgttgttttctgtaagtcttgcaagcagaccatcttaacgaggttaacaatggaagcagaactcacaatattagacaccgccacgattgaggccgagtggctttcttgagctcctgatggatttgccggtggttgaaaaaccagtaccagctatcctgataaactgtgataatcaaacattgattattaaggtgaacagttcgaaggacaatatgaagtcatttaggcatttaaaaagaagactgaaatctgtcagcaagcagaaaaactcaggagtgatagcgttagactatgtccagatagctaaaaattggcagaccagtttagggactatcacgtaatgtgatagataatacatcgagggagatggacttaagacccacttgagttacacaatagtgataacctatcttatgtgatcggatatcctgtgaattaggatgacaaaacaaactattgagtgactgcgaggagagaccctgaaatgggtccatctctatgatgtacttctatccttttctgtacggcaggatggtgtataccttaatgtcatccgtgtggttttcttaggcagagatattgtcctacaaaacatcttacaagcaacacaactatataagttcgactgctagtcacagtctatgatgtttgcgtgatctccagagaaaggcttggaatttgaacataggggacgcaaatggtagcctagtatcagttaaggagttgagtaaagcctgactacacaagactaataattcaaggtatagcccattgttcagttgcggtctggtgtatctccttttctaggtagaagttcaacttaacagtctccaccgaaacactggtataacaaataagtgcagaactgagaacatttcctgtgagccctgaaaatttagtagggattgttggaataaataggctaagcccaatttatttccagtaaatttcattggctcacaattaatgttatagcattaataccaccttagaaattcaagtgaaaaaatctcaacttaaatacggagttattagagagcccatattgaccaattgaggtggtggtaggactgctacacgtgcacgcgcgtgccgatccgggtcggccggggcgaggacgaggcttggcttgcgtggccgctctctcgttttgcaacggctgattaattctgtactaacaagcgacttgatttcgctattaaccatataattgaatcggattgattttgagattactcctgaacgttactcgttggtgcgcagtataaaaatgcccaccaggacagatagaagggctcatcccattctgctcagttcatctcttgcttgattctcctcgaactcttccttctctgtacatgtgtagccaccacgtccccggttctgatcacctgcacgtattggtgctcatgacgagcaggtgcctccagaactccgtccgcttgcatacctgcacgggtaggtgggcgatcaagtttttaggagtgtctgggcatgactgctcctattcccgatctgcttctacttcctcgactacattgcaacctcttcgtcggcctcttcttcctctacatcaacatgccgaacactggtactggtgctattggtggaagcataggaaacgacagtggcattgctggaagagacggcactgagaacgacaacaccaatggagacaatacaattgctttgtcatccactggagcgttctccaagtatttctcaattcttctattggtgctgaacatgttgttagaagcttttctctctttagcattttcatgtttatcaccatgatcgctttcttatatgaatgtcatgattattactcaaattttctagattaaaaataccaatttatgaccatattttcaacacagtattgatctacaacaggtagtatgtgtgtttatagatcttcagtgagttcaacatagaaaggcaggagtattggagtaagaagaggataagaaaaaaggaagatgaatcaggagaaaagaagttaacgggatgactggtgaccagtggcggaggacggcaaaaaatctaggtatggtggtgtgcccatgaactagcacgaaaattagatcatgacaagaagaaagggaaaaaaacaatcccaatgcacgaaattatatgacgcaatctcaattctcaagcatggcaataagcactagtcataagttcataattcatcacccatttgtaaaaagtgtaaatagaagaggcactcataaatacctcaagattgcagttgtcaacaatacatcacatgtaagaacgaactagtgaggatagatagacatgtagtgatgtagaaactgcaaaatactagtaaatagcaaagattgattagtatactatagtctcctctgcctgcctcactgcctggatgcctgctggctgctgcccttctgccgtgctgtgcagctcagcctgcgctggccgcctgcgggctgcggcctgcctcccgcggccgccgcaccgctgcccagtgcggccgcgggagatcaaggtatggcgagcgccatacctcgccataccgactcctccgccactgctggtgacgtttagtcttcgttaaacctccgttacatgataattacgtgcggttaccttgctacgtgcggtgcggtgccctgcacggctgcacctgagccgaactggtactacaagaggtcgacgcgacgcgctgtgcagaggaggcgccaaggagagccgcgtcgcgtcagggcgtgcaacaccggaaccaggacgaaggcgaggaaacgcggttcccttccctttctttggatggactggacggaggagagttgggcttatgggcaggatttcaacagtgaggacgtattggg

SEQ ID NO: 68002 - DNA, 3361 bp, Oryza sativa
tggatgatgatgtggtacaattgcatcttgagctttaaaagttagtggatatcaattttatagtaagataggatgtggctgcacagaaaagagagagtcggtattgtatcagttagtgagaagttgtatagatatatagaattcctcattacataaccgcctgggaaaaccgtgtggccttattaaaaatcatgaccccgttcgtttcaggataaatttttggattaaaatgatacgctttttaaactgctaaacggtgtattttgtgtgaaaattttctatatgaaagttgttctaaaatatcagattaatcctttttcaagtttgtaataattaaagctcaattaatcacacgttattatcacatcgttttacgctaaacacttaatttttatcttcaccttcagaagattcaagaaccactccaagtgtccacgttcactatacagctctcttgcttgtctgttctctctctccacacttcctctctccctcaactcctcttcgcctctcgctttcctgatcttttcctgcattgaccttgattctggtgacgagatagcggcaccaaaggggaggttcatataggcggcgtaggggaggggcacccgtgtccaaggagagggccgacagtggtggaggaacaggactgtggcagcatgagagttccagcacccgaccactcctgctcgttggtttcgtcggtgacgatatggcttgggcccgacggtggggacgatgagagttcttgttttttttttttgtggattttttatttgtggattgtggcttccctcgttgtgattgtggctctttttgttggatttgtggatttgctagaaattgatgtactgatctagaaatcgatttgcatatggatttttttgatttggcgggaattctcaggtttggtatgaattttattatttgttcggcaaaaagaactttgcacatcggttctcttaaccaagccgtttgaaaaaaaatcaatctattaggtgttcctttcaaagaatcacatttaaaaatttaaatcgatttttaaatacggtttgttattaagagggctgtgtgaaaaaaaaatcaatttccaaatgcaggtgtcgaaccgccggtgaaaatattgatttctaaagtcgttggctcattgcagagggggacggtaaaacccgcctcaacaaatcggttttgcccacccaaagaaatcacatttgtagtgtaggattgataaaaaccaaataaacctaccagaggaggagggggtgaatggtagggaaacaaaaacccaaaatcttttgcgaaataaaatatttatctcaaacggagtagatgacgaagtcctgtcaccgccagtcatactgcccactacccaccgatcagatcatcgttgtatgactggtcagaccgtgcgcacacctgcggtcagaccgccgcactctcgccggtcaaatcgctaccttgcctgctgttaaaccgtcggaaactagaaaaaactggtagatgataaactcaaagatgtagattgaatcttgactttattgcattaactagtgtttacaaagtgcaccaacagtagtcctcactaaaatctcgaactaaactcgaaatcctaactttctctcaactcaagtctctccaaaaccgatactggaaggctacaccctcactatctatttatacacgaggtaggttgtgcaaagcccacgaatctaacacaacttaggactcccaaccacgtgggaaaccctctcttgcaagtatacaacttatccctttacttatctccatcaatcttcccaaatttagactcccttccaaattcgactcctctttctatacacacacaatccctcttatataccatatggattcttcatcaccacgtgcattgttctccagccttttagcatcccgcatgatctcttgatctctagacgtctacttctcccaagtcaactctaatctatcaccgacaacactctcccaaggcctcaagcaacacctgcacatacaacaaccaagaacccaacttaactgacattagtataacaatattatccatatgcataggaaccatctataagtcaaatccctgaaggaaacatccaaaaccgataagacaacctgaaaccgacaatgaacaggaatctgccggttaggccgtcaggctggccagtctgaccggcggcaccacccggggtcaacaacaacatcacttcacaaaagcaatcatctatataactctgaaatatcatcgcaagaaaccaatctttcacacatgaaacattaaaaccaccaatgctttcatcacacaaaatctaaatcaactccttgattttacatatagtagggcatgtcgatagcacctgctgttacggtagatgtcatgcgtccatccgctgtcaacgtgtttagggtgtgtttggaaaatgggttaggagaggtgggattgggaaatggaaatgaatagagacatagtatgaaatagggtgagaagaataaatggcttaccctttaagggatgggaaatcatatcccaaagtcccaaacccatgtcccaaagacaaccttacagcttagtgaccaacagtaaaagaagacaccaaggacaagcccatgttggatggctataaagaaggaaacttgattatcttccgatacgaggagcaaagcgaaagtttagaatctaacaaaaaaaaatctaagcaagcaagtttagaatcgaacagatcaccaccaaagcatgcattggatccatgcatggcataaggtacttgcttgcagcatgcaactcatgtcggcctactgagcacaatatattatactatatattttttcaaaaggaaaagcagcctccaactctttttcttccttcttcctctacgttgtcgtagtgtcatcgatatgatgtttgggccaccgccgtccgccggtgatagcattaatatccccgacatgccaaccattcgtaccattttccctttcaagtaaccccacttacggccttacgggcatctggagccgaacaagctattgtgcgcattattcgtgaagcatttgaagtcgtacatatcatatccttggtttgaatctgtctttcctcttggttccattccattcggcatgcacattggtctcagtgattctctggctgcttaatttgttgcaggcggcggaatgaataatcgcaggagcgagctgggaggatcggcgatgcagagcgtaccgcggacatggagtcatcagcggtctgattcgaccatcaacgatgtcgcgataacccaggcagtgatcgggaagctcgtcaccggtgtgggctacctgtcgctgacgtggtcgacggtggtcctcctcggcggct

SEQ ID NO: 68003 - DNA, 6479 bp, Oryza sativa
atcaagatgggttttgtaaaattaaaccagctagcggagcttcttagttgggatagggataaccactcgtctcatgggcaaacggaatattttttgaacaaacctacgaacgggtaatcacactctcgtgacaaggacggacggctttcaacataaaccgatgaagatggatgaaaactagactagaactaagtaaaaagtagatgtgataatgaaaaatgattcaattggctaattgtgttaaaattagattggtgtctcaattgaatgggccttggcccttataaagaggttggtcttgtctcctacaagacctcctccatgttaaaatcaaggtagagaccaattagaacttagaaagtactttcccaagcaagaaaaaccaagacccgatgatattctagtcggagtaagactcagccggtcttattggccagatgccgctggtcagaccgaccacatacctgcggtctgactagcctcaaggcaatgggcagatcggcctcccgtggtggaaaccgggtacttccaaatctggccatgttttcctatttcgtgtttaggtgtcaaatttgggcgttaacacttccatcgagtgttagatgagaggcacacgagcggatgtcacgcccagaaattcattatccgaatttcaagcagaatatgtattaaaatctctgtccaggaccagccagagtacataaacgacaaattaataaacagatccacatcttacaaaaatagtaaataatgcttacaaactcagcagaaataaagaaataatctagacttaatcttcacgaccaaaagcgttgcatcctccataaaaccacaggcatcctcaatgtccggaacaagctcaatcctcatagaactcaccatgtgaaccattctctgtctctgtattaggaaaaataaagcaagactgagtaccaaccaccgtactcaacaagtcataccaacgggaaggtatgatgcaagatattcacaaaggaatggccataagatatttgtaataaaagcagcatttataaatcataatttgaatacagtaaaacaatatataattaagcaatattaaaatatcactgcccaacgctaaaccacattgcaataggcccaaccaaaccacctaaactacaccagttcattaagtcatattattaagaatgagactaatcacggtgagctggttgaccgcccaataaccggcacgactattcgaatagttttaactctgatcagaggtgtacaattttatccacaagacacgattccacacatgttaccatgcgctgaagactaccgcgatactgcaaagggagaaaccgtgacaaaacccttcatataactctccctaaccgaacatacccacctcagctttcaccccctcctttttagccaagtcgggcagtcccctctcgtgcctaggtaaattcggaaacaacagagaccagagctaggtctgaacttcaccatcgcctctacccttgccatggtatgtcagctaggttaagttatactctagatttagcttggagcccacgctagcctgtgataagtacggttatatcttccagggattcccgagaaccaatccttaattgtcatggcacgacttccaaaaccatacacccacaacccaccattaaagcatatttttgtttaattaaaccttaaccatggtggtacatcatcatatagttaaggactaattatagtgaatctcattatgaactaattgatctaagcatggctaagcattcctaaaccaatcatctagtcaattatatcccaagctatcaatggcataagatatcaacaggctgagtacgataggcatccatcccacatgacattctaaaataatgcaatttaatagaaagcatgggattttataaaataggttcaacatgatcaatgttgtatgtatgacttgcattgctcttgagctgacggaaccgcagcaaccacttcaaaataaactggagcgtcggaactgtcggaatctaaacgacaaacaaagcatacaataatacatcaaataagtctgtggtggatattttaatgaattcactgcaactttaatggattaaaacggagctcagattatttagatatgaattttagaatatgagatgtgtatttactattaaccgaaaaaccttagtccattattacacattaagagaaataagtcaatgagtcaacaccagtaagcaagcctcacgggatatcaactcaatgagtcaacccaccgtgacatgggaccactcaaacggtcaactgaaccgacgaacggaactgatggcttagaacgactctaaaactaaagaacgactcgggacgaccgaacgaacgaggctttggactatacttcatgcgaacgaacgattaacgactagcgaatggctgcggcaagaccggtagacttaactcggtttgcggcaacgacccggtacggcaaacggtaggccggtagcgactcgggttgacgactgcggctaggcaactcggctaccgagcgacaagtggcggtgtcacgatctagcagcgatacgactatggcaaacggtgataaccggcggcagcggtggcagcgcgggacagcggcgacgctcagcggctggcacgacagtgggcggcagcggcgcacggtggtggcactcggcagcgggtggctgcggctagtggttgcggcagcacagcacagcggcggcgcgactgcggctagcggctgcggtggcacggcacagcggcggcggcttgacagtggtgcagcagcggcggcggcacaattaggattagacccactacgcaaataggaaattaaaaacctaaactaggagatcacggttaggaacctcaccaaacctagatgatcggggaggaggagatggcaacgatgatccggcggcacacacggagatgacagcgacgctagacaatgagggattaggttagattaaaccctaggaacctcacacaatgacaaaccataccggcgggagaggaggacggctcaccagcgacgcaatgacgacgacggcgggaggcagctagcggtggcgacacagcgacggtggtggctagggcgtaggggaggcgatggctagggttttgcggtgaaggaaaatagaaaaaaacggaggggtatgggaacttaaataagaggatgcggaattagagtaggtttagattaggtgggcccggcggcgcgcaaggggagggggaaggcggcagccggccgagactgggaggggagacgcgcacgtttagtaagagggggagagggactcagctagggaaaggggatgggatttggatacgaataagaggggaccaaaaaaggaaaggaaaggaaaaccaatgcggtgccattttgggaaaggaaaaggaaacaggaccggaaaaagaatatgactcggttcaacatacaaaacgaaaccgtggcggcaacggggttggtggatactgtcgacgagtgatactcgcagaccggaggaatagggtattggggtacgttggaacagggatctacgtagtatgatatcaaaacagacaaaagacaaggattatactggttcaggccccttatcaggtaatagccctagtccagtttatatgggattgatgatgatgagaacagattacaattcaaagagagtaaccgaacaggtgataccgatgagatcgtagtcgagggattcgacgagatctcctggtgagttggctctgtggactccggcttcgtaaactttggtgggtgtgttggcgatgagatgcgatgcccatagcctatccctaggggtcccttttataccgtgggataccttgaccctcaagtaagacttggagattatgtaaaccgacacgatatactagagattttaccccttccgagtaagatttcagcaattccttaactcgtagagatatttccgataatttgaggtaaatttctaacggcatatccggaaaccaaccgtatacgtgagggtataccttattggtatattccgtaagtcgtaggacagagggtatgccttatccttaacactgacagatacagcataccacaaacggggagagtgaactggggacggttcacaaccaaagaagagtggggaaagaattattaattcaactcctaacattttaaattaacttcattaattcctttgctctgaatattctgttgaacatcctgttagtgatttaaagcaaagaaaattcgaaaaaaaatctccgtgacaattctgattattaaacacattgttatttagagtttcctcctggttaagaaagtaatttctatagatgatttagcaatgatttagcaaatacggaaaaggggaaaactccgggtgtgacagcggtcgccctgaccaacgcaacaatgcttgtccgcttggggccgacttacaatagactcattagcgtcaactaacaagatgttatatatctatcaagatttcttgttaaactttttatgtacccaaggttaccctatcatgggtgatattagttagtgatattggtgaactacttttctagctagttccgcccagggttcccctaaccgttttcggggtggttaccaacccccccctatgagggatgttcggttccgatcttccgataggtattaataaacagtcgatttgggcggagtcgtgacacaactcgatccggcttctgaacgaacacgctactgagccccgcaatcgcagcaccacgtctcttctggttatcaaccatgtcgaaacctggttgacctcgccgagaaggctaatccctgcaagcgaatcgaagaacacaaccaagaacaggatagattgcaaccaaattgcatatgaatgattaagcactcgaatttggggttccacaaaccgatctagcggcgaaattgttcttgacagaataatctaagcaaaactcaactctaaacgatgacggctaccgaattaatatgattaggaacgtcctagggttgccctagggcgcacacccccttgggctaagcccacgacacaattacaaggcccaaaacccgagtcagattccgtctggatgagatacgtggcttgttttgcagattcctggcagctcggtaggtattttgacgtgggacaaaaaccatctgaaagtagactccataagctttccaacaagtactcgtgaacaccgaaattccttctagatcagcggctatgtttgtttgaagttgatgctgttaggaggcccaaatccgaatacaaaacgtgtacaacttgatctcttgtcttctatggaccaaaagtgacgtggtgaggtagaagtagacttggagaacgtcttggttttggtccccaatcaacttctttaatcatccatgcatcagttacgctcggtctcttttccttcgcccaagcaagtacctctgcaaacgaaaacacacaaaactcattgtgtagcaacgtttgttcaaatatataacaagtaaatctaatgtagaacatatgcacctttatttgattaatacataaggtagtcatggttatatccgagctagttatatcctcatcacccccctcccgcggtaaccgtgaaaaaaccgcgtaaatttcggtttcaaaaatttgaattcaaaatctgtggtagcacggttttggcacggttaccgcatggtttggagcgattaccgtggtattttcgtggtaaccgtgagatgtttggacgaaagaagaacaaaatgaaaaaaaaatgtaaaaagaattggagaaacacttaaatgtgtgtagaatttggggataataacaaaaaaaatagagagatgagagtacttggtgatattttctccacgtatgggtcttaatgggccacatgaccagtgcaagcttaggcccacttcattatttctttttcctatgtcctaattgactctttttcatgaaatttcttcaccataatacactacaaatcaagcactacattgctttttttttgatttttttcgaatttttgaatttgctcaaaatttggcaaaccctactgccggtaagggttaccgaacccccatggtaagcctggtaaccgcggttaccggcggttttgcaaaccctggttccaccaagcatttcttatctttcccaccacctgctcttattcaaatactatggactcctttggcaaataggatacggaaatgatattccactctccaaagggtaaacattttaggggcaattgcaaatttaccactactttgaattgttattgcaaaactgccactagaaaattgcaaaaatgacactagaactgtcattcgagtggcatccttacaatattgaaaaaaccggtggcaaatttgcaaatgccccatatcctagtgttgacacgaaattttccgtccgacgtgccggatgtgcatcgatcacaccaacaatgaggcatgagagatctacttagttccaatacaggtcctagatcttgatgag

SEQ ID NO: 68004 - DNA, 4235 bp, Oryza sativa
ctgaacagcacacccatgctgctcaggcccaaccaaacctgaacaaccaaccccggtcgtacagatcaaacctccaaaccaggaattatccattccaaaccaggagtcaaatttattatcacattattattattaatgagtagtgtgagactaatcacgaaaaacattgctcaacccgcccataaccgcgggcacggctattcgaatagttttactctggccagagatgtaccactgtacccacaagacatgattccacacatgttaccatgccccgaagtaccaccaaaggggggaatcgtgacagtaccttttgcacaatacaactcaccacagtgcactatttctggatcataatcactccctcaaaaaccagaggcatggactccccagcgacccccacggacttctcgccgcttctcagtctggcaccctgtaatgaactatgctataaaaaagataaagccgttgcccacgctggcttatggttagcacggtaaatgtttcacaacagtagctcgcgaaccggtccttaattgtcatgagcacaaccatcaaaaccatatgctcacaacccacctttaattaggttttaattatcaattaattaacataacacgattaaccatcgtgagctaccattaaatataaccataattaataatgtagtatgattcatcccattaatgagctaatgtttctaagcatggctaagcaattatatatatagcatttagctgaaccaaaccaatatataaggttctagctaattaaattataacccataggaaaataaagtcatcttcggccattaattaattgggaaaggctcaccacccgatgacatttgaaaataatgcataagttgaaataaaacaatagctttaaataagttcaatatgctccaagggttgtttgggatctgtgtgacttgccttgagcttcttcaaacgcttccgaaccttcctcaacgaaaacgctctcttccggaacgtcggaaactaaagcaaatgaacaaaattaacaaaacagtacaaaaacaagcataaacagtacacatagatatttttaacatgtagatcttgattttagaaaaatttagcaacttgaaccactcaaatccgagttacgatgatttagttatgaatttccaaagtttaatcgattttcatctaataaagaaaactaagaaaagggattaatgacgtcatcgctgacgtcatcgccgtccatggcacggcttccacacgaccaccggcaaaagaaggctcggttgggctaacggaggacatctacgcgtagaggacgatgacgcgaactcaccggtgcaaagaacaacgacggacgacgacgaacgacggccggcgacgaggttcgacggcggctcggctcgggtcaacaatggcgacggcgctccggctgtcttcggcggctgcgaaggggcggccggggttcctctcctccgtgcgcacccaacggcttcgacggatggcaacggcgacggctaccgcggcggcgcgacgcggctggaaggtcgccggcgacggcggcggctagggcaacgtggcggcagcgctacgggcgacgagggagctcgggacttggggcaaacggaagaggacgactaggggatgctatttataggcatgggtggaggagatcggctcaggaacggatggatttggtgaaggaagttaggatttatccgagttcacccgaataaaaacggccaaaattcgtgagatagataacgaatttgatgggggtttcttcgggattaggtagaggagatagagaggaatccgtttttgcaatcaattttggaaggggatcaacagttcggccggatcgaacggagaaggtggcgttgcaacgcacggcatcgggcagaacaggggctctggaggaagaagatgacactgttgtgagagggaggtaatgcagactttaggatgggctgaggaagggagagagaagaggaaggaatgggctgaaaagggcccaagctgaggaggaggatttttattacttttccaaattaagagttgagctccgaaaaatccgagaaaattccagagagtataattaaccatggagaatttaataaaacttaaatccagccatgctttatatttaggaaattttatttctcacatttaacttcacttgtaaattaatgaacatttaatataaattctaataataatttattaaataatttataaatcctaaaacgaaaatcaggatgtgacaatgaggtacgggcatgccagtcagtttaattctgcaactgacaagagatgtcaagtagcagcaattagctgatagattgaacgatcggttgttggagactaggagacccgggcgcggatcatgataatctcaagtgggccaaaagtgtgtgtcagccgatagcggataaatgatggtttggtgtagaatcagttgaaggatccaatgctagtacttagcactgaatgcatttggtcattgaggccagccgatgttgatgggactgaacggtcggttgtaagcttgttgcagaattggatcggttggaaatccgacacaaatagactcaaatagttagataaacaatgaagcctttgttacaatcagttagcgaacttttcattatcaaagacaatcgtaatagattagacttaaccgagacggtataagattgaagttgatatagatagatttatccaacaactaactaatccatataagccgatgtaacacttagaactagtaaccagataactcatcggttagcactccaatgaaacataagcaagaaacgtatcggcttaacaagacttagattatcaatacaatctaaaagatcagacctaaccgagacagtacaaaattgcgtgtgataatctaaactcgatgaatcgatagatctatgcaaacctgatggatataacaaatctatcttaaaatagcattatctttaaagagacgccaacttgatcagaatatcggaccgaacgaagggagtcgtaactaagtcaatgtgactctaaacaataatgcaatcaaaagtagagacgatataccagataggcaacacttgcttcggtccgaatagaatatcggacctaaccgaggaagtcctagccacgccgatgcaagcgaagatgacggaacttacttctcgccagaggtctcggactaaaccgatgcagcccatgctcgaaattaagaactcgacaggagtaaattagggtggcgatatgttgaaagttgtattgatctagagatagattagaagaaccctagatgtacatatttataacatatttataacctcgagccaatatgaatccccatcataaatgactcatgtttcctaaagataaaacacaagtcctaatcagacactaaccaaactttttaaagataaaaagaaaaaaaatactaaaccctgcataattaatagataaattaagctgccatgccatggtcttcacgactccttcttgaacttggtctcttctggacagactttccatcggttgattgtgttctttccctaaccaaatccactaaagaatcttaccatattttggcattaacacctagccatccttttttttacacctcaatcttagccatttacccatttccctttctcaatcccatgtctcataatccttttgccaaaatatgccctatatgcatctctctatgatctcttatcacgttgttgtgcctctttccccatctttacaaactcgcttcccaatctcgccatgttctctctctcctaaggtgtgtcactctctctatgtgctttttatctgctcttcagtgccttacaacctataaagtgaatattggactctatgctggtccttgggcaagcaagtaaacccctttctcattgaaaaccaaccatgtgcctttgctacaactcatgttttgcaaattacatagagtccatgtcgtttgcatctctgtcacgaatcatggcaattgctttggcatctcgccaattggtagagatttcatggggatttcatggagaaaggagaaagcaagacaaggaagctagaggcagaggtaagcggagatcggtaggggtattcaattttctcttcttcgataccatagcccgtcgagtcaataggtcttttaccatttacaactgggtttcgcccaagacaacccacgaggcccatggcccatacatcatttgaccccaacaacacaactcatgcttc

SEQ ID NO: 68005 - DNA, 10051 bp, Oryza sativa
ggtgttgaagcacttcttcaggcacgacttcagctgtagtatcaacataatttagggagatcagtaattacttgcgttccaaccttcaatgccttttttagcaaccacaaatgaacaaccagatgtatctgactacacactaggagctccaatttgtatgccacagctctcacccaatctaacactctgtaggggccatagtatttgaaactgagtttatgataggaacgtcatgctacagttatctgcatatagggttggtgtatcaagagttggtgtttcaggtatactagatcccccaattctaaccacctctcagttctgtgtttgttggcttgatgaaccaccattgttgtgccttgatcagttgatgacgtagaaccacattcaactgtgagtattcctgtagccaaacctgcacatcaggcattatgctctgccccagattcacttcaccaaaataagtgtgctttctggcaaataaaatttcatatggttattttccaagggctctatggaaatcagtgttgtatcaatgttgagcttgagagagctattgtgatcatttagtcaggcaagcatgaacatcacaccacaaaaatgcttcaacgcattgatttagcatttctgattgcccatctgtctagggatgataggatgagctcatgttcaatttcacatatgccaatttaaatagttctttttttacgggaagtttaaatagtccttgccacacctatctctattagatataataattttaggcatgtcaaagtctcataaatattggacatgaaagcttgggctacagtaagtgttgtgaaaggatgagataggggaatcaactaggcaaactttgtgaatttatcaatgaccactagaataatataaaatctgcctgacttaggtatttcccaaacttgtaggggaacatggagtggtcgtaacaaatctggagccatgccatgttcagcttttgcttgttggaaaacttcacattgttctaaacatccttcttaaaccctggccatgtaaactttgatcctttggtaagctgctgccatgatagagtggccaccaattccacttttcatgtggagacatcataacatcatgtttagcctctgtatgtgcacctagccagattttaccatggaacctaatcacccttttgaccaactgaaaccaatcctttcccacaggactcaaactcaattcaatcagcaattgttttgtcactagatccttaatgtatccttctatcacactctctagtcatttaggattcatgctttccgcgtgtcctcccctctctctctctccatcttatctcctcacacaatcacacgcacccttccctatctctctccacacaagcccgacgatgacacccctcctccggtgatggccttccagcgagtctcctcctcctccttattgcgagctccatcgttggagaaaaggaatcacagtcgagttgccttcctccttcgatgacggcggctgcaaagacctctatctagcgatccccctccttcctccctccgaaaagcttcctcaatcaaccaagtcagttccttttctcgctgtcgatcctcactatgccatcgcctggtatcaccggcgccaaaaggcatcaaaatgatggtgctgtcccgctcagctggcctcctccccccccccctccacctcgctttgcccttgccaccaacactagcctactgcccgttgccgaccccacggctccggcgatgccgctgccgccgccttgcaggccaatactctaagcccgatcccccacttacccctccctaacaaaacccttcgctcaccccaccctgaaaccctaaccctacccctacccctacccctaccctgagcttgttgtcacacagcagaaaactgtgcgcaacttgcgccccttgcgtgcacacgaattaggattcctggaacgcgactacaaactatgcatcttcctcctagaagaggggtcggaggtgatggaactatgtttttcaatcctaccgcctcgagagttcgagctacctcacgtgggtttcttcccaccatctctcgttcatgttgtggtgtgcctgttcatcaaaatacaagaattaatgaagtgcatatgttgtgcttgtcgtatcgttaaaattcaccactacaaaaacattttttctgcacaagaacccttataagttgcaggtggactgtaaataaacctgcctccagctcgggaggggcggatctagagcctggtggaggaggcaaggggcgacggcaacagcgacgggccctcccccgcgcggatctgacggtggcggtcgtcccctaagcggatccggtggtgtgcacgggagaggccaaccacgagcaggagcagcgacagtaggctcgggagcagccgaccgcaggtgggagcggctgcctccgggttcgggagggacggatcgagagcttgatggaggaggcgtggggcagcagcggtggggccctccctcatgcggccctacgtggatcctgcgatggtggcaggaggagcctgacagaggaggtgagggcgacaaagaggagcggtggtggactgttgcgacgatgtcgccggcggatagcacctagctagggtttggagttttgatttttggggatttttattttttttattttatttttacgtgcagacgacataaacacttgtacgcaaaaatagtgattttcatagacactttcgggtagacgagcggcccacccacacgcaaaaataggttttggccgtatgaaaaaaaaaacttttttagtagtgactctcattaagttaacttacgagtgttagcaaatatatatggtctgacctgtttaggaggcttatttaacatgcccccacaacttatgaagcattttggcctcactggcaaaaaaaaaaaaaaacttgcgaagcatttttcccagtcttgttatttatcagttacctggttttctttccctacatgtccggcatttcaacatacgcaaagtatagcctaaacttgcacggtttgaaaaactcttttgtttcctttgtatttttatttcctgcattgaactaaatgcgtttttatgcttattaagatcaaattgtttattcatgccggtaaggatccaccaaaatacaatctttgaattttgagctatagcatgttttgttttgtaaaaaaaagaatggcatatgattcattagtttgttggatgtcgatcaaatataacagttgaagaaaaacgattgatagctaatgatgttcctcgctaaacccaatgcaacagggtcttgaccgtccacgattacagcatcgagagtgttgaggcagtgttgaactccacaactagtatgattgaaacctttacggctttccaaaagtctgcgaaaaagcattccactgctgccttcgtgttcagttcgatgtgtggtattgtgctgatggtgctcgcgcaaatagtagtggtattcctcgcacttttaattgaagctgtgctgatcatcaatatgcttgggccgatggcatccatggtgatctcaatgacccgcctaatacggcacgattatggtgatgacaatggaaatctcagagcagccttgttcatattttactccctagctctggctcatagtgtgtgcttctactgctggttcctgcttcagtatttccttgagaagttgtccaagtcggcaagcaaagaattcggccttaacaaggactttgggggccaaaaattgctccttcaatacctccgagaaaccaaagccaagtgtgcagatgatctgagcttgcccggtggctggaacatggtcacatatgctgtcggattgctgaaatccgtgtcccgggatgatcatctggatggtttacggatgcttgatgcattcgtcgtcaacaagaggccatccataagactggagctactgtcctccagcgaatccatccagaatctgatcaaaatgcttcagtggactgacccggcactggaggaccaagagatgagagaacgcgccgcaaggatcgtggcagatgttgccacgggtgcattacacattgttcagataccaggtgccctgcagtgcatatcttctctgcttcaagtatctccactaagacaatactgccaagaggttgaaaaaggtccacagaaacaggatcaagacaaggaaggaggagaagaagaaaaagacaagaacatgaatactgcaatagatgagcagataactgacaggcttctaaggatggacagaagagcgaagaaattcttatttgggacgatggatgacaagagctccttcaagccccaaggcactagagagttgattcatcagggcctacagatacttgagaggctcgcatgtgacgaccaaaactgcagagagatctgctgcaaccaacggctgcttaccaagatcattgcgccaatcacttctcctgctttacttcacacagattatgacaatgcatgggttgatatactgagcattttgctgaagctggtgaggctgctcatcagtgctcctggagaagctggcacaagggtatgccatgatatctcggcttgtgaggacgcggtccgcaacttgttggggattcttggccaaaatgcaacttatcccatgcaacttcaggaaaatgccatggagattcttacagaaatagcaattggtagccctgcaatcatggcggaggatttcatcaggaagctgtggtgcatcttcctttccaacagaggaacaagcagattgaggagaaaagcaggagaacaacttgcaaaactgctttctgctcaaggtgcaaatgggcaggtatttgtcaaggatgtattttgtgaaaatgatacagttgttgctcaactcattgatatacttgttcaagacaaggagtgccagataagtgcggcagcaatattggagcacttatgttgccattttgttaggtacaatgaactatcagagctatgtgtggttaaactgttgagaatggtaaacttctactattttcttttactaaaaccattaacacgaattaaccaaatgcagttatatgacacttgattataagtatactgttaatatattattattcctgcagatacttgatctaattagtaaaatggaaataaaggaggaaactgtaccaggggcaggggaaagcaatagttttgacgtacataacgatgaagaaagcaagcctccaaaacaatctggtccgaagaagccctgggttccgaaaaatgatgagctatctgaagaaacgaaatttctagcagctctgatgtcccttcttgtggtgatatgcaacaaaatggttgatgcacatgtattttgttatgtcacatcagtggatgcagcactggtgaagaagctcaagaagataatcgaagcaaataacaaaaacacagctgactgtctaagaatagtgaaacttgcctgtcaggtggttatagcgataattcatctcaaacctagctgcatcaaagacttcaatggaaatcatttcgatgctgtactgtccacggctttgaagaacatgtcagacatcgataactgcatgctctttgcagtccaagattgtcagataacaaagcctgccagaactctctcttctcttgtaaaagaagcccagggactcctccagaatgcacaagatgtaacagtcctatctgattaaaatcatgtattgcatctccaagaataacagatcatcgagtgtactacttgtcatctgaagactgaagttatctattttctgaactacacgagcaaatggagtgtgctgccgtgtctattttctgtacctagtgtgcaaatggagtgtaccttctatattctgtactatgcatgtcaattgtcgaacattgtatgaatactttaaaagtgtagtatctctgaaacatttattgacataagtactgttatatgtttggaatggcaatgttattattgattgtttcaaaactatggtctgaagttcatgttgagctcaaatctaaattggtggatccagcccataattgtaagtatgccatagcagtgagtgagtcaatatgcattctgtaagatatataacagaaattcttacagacagagcggaagatcatttcatatattcaacacatgtattctctcttacggaaattcttacagttagagcactagatccatttcagtccagaaattctgtcttattcgaaacaaaagcaatagatcatttcatatattcaacacatgtacttagaatttgaaacaatttaggattaaaaatacaccgtgctaggacgtacttacagttaacgcctgctgctgcggcttcttcacctgttgcccgatgcttttgtcgacgggcacggcaagccgtccgcaaaccaccaccgcatgctacaagcctacaaaggatgataattaagggaagtacgaacataaggcaccaactgatacacattacgcagccagcgcacacactacatgcaatgtcaggtacaactctgatggcatactacagacaaagcgtacataacaacatgaaagagttaacagagttcaatacaacaaattacaccctaggaggataagctcagatcacaatcagttcataatccctgcctaaaatacacataagatgctgttgcttcacaaaaagggggaatcacggcgagcctatgctgcatccaccttgaccagcgctgtactcggtgcctccggggtagctggtaaatactgaagccagtctttggcacaaacgagcgcctccacaatttctggacgcgatgagcttctgtagtcatcaagcatgcgagttccagttccagcagagaaaatagagttgccgctgctcaccatcgacatcggaatggccaagatatcccgggccatctttgagagagtagggtacttgagagtgttgagcttccaccagttcagaatgtcaaattcctggatgcgcggagtgagggactcatccaggtactgttccagttcagattttgttggctggcttgtagctatctcagaaaggtacatatcgaagtccacaagtccatcgccggttgaaggagcagttgcttgagtactattctcgctagcaggtgcattattacctcccccttgctcaacgtaagccggcgttaaggggaggggctgtgcaacatactcgttgtagagctcatgaacagcatcatccaccaccttaacatatttcgcagcttcaacaccataaattttcgagtagctgaactcaacgagcttcatcttgaagcgcggatccatcacaacagcaatagctaacacaaggttgcaatctttccagtacttgtcaaatctctcgtgcatatccttggcaatgctgctgaaaacagggtcttcacgccctgtggcatttgacagctcgagctgaagtttccatgcctcatggaaaaagagatttgaagttggatttgctgcagccatgatgctatgtgctgagtcatacaatagcttcaagtaattgcaggcagcctcaacttttttccagtcctcagcggacggtgcctcgttgtagttatcatcacttgtctctagagtagaaaaggcctgcttataatccaaggcagccagcagcatgagataggtagtgttccactgtgtcgtaacatccagacaaagggtcttggtacttgggatctctagttgcagagcaatctctgcaaacttctcctcacagctaggagaagcttttatgaacttaatgctttcgcggatattatagatgacaccatgaattgaagcaatgacatcctgagcaactgcattcaggatatgggcataacaccttacaacaaatagttggcccttgagcatgaggttgttcttgttggagagataatccctcagattcgcactgtatatatcatgtgatgagcaatcattgtccaatgtgatggtgaatagtttgtccttcatattccagtctgaaaggcttgtactaatagcttcactaagtgcattctctgaatgaggagaagacaccatcatgaagtttagcattcttcgatgcatcttccactcagagtcaataaactgcccagcaagtgaaacatagccaagagtttggctagttgtccacaatccaatagcgaggctgatccttccaggcatagtgttgaatgcttgcatgaggttttccttttctttctggtaaacagcatacacctcccactccattgtctcaacatctacaaccctgaaacgtggctgcagactgtcaataaaggtagtgaaggctggctgttgaacaatgtgaagtggatagtcatgcaaaatgatcatcttcgccagatatgagcaactgcgttcttgatcaaaagcagcatttgcataaccagtatatctgtaacgcctcttagacgggcgctccacagtaccctcaccatcattgtcagtccctccagctggagtcagtaatagcttgtgctcttggttcttaattttaggacatgaacccaaggtaatgtgcctcttgagatggctagtgcccgcaatttttgaaccagagctgtaagcaaaagtttgcttgcacagtttgcagcacgcccgtgtagcccctccagagacagcttcaatagtgaagtgctcccacactagagacttcttcctacggcgccttgatgttggagggatactcatctcagcactgaccaattcatttccttggacctcgtcaccttgaattaagtcctccgcaaggaccaattcatcaccctgaacttcctcagctagagcttccccattgcttggaacaatctcgttgccttgaaccaccaggttgtcgttgctggtttcctcagccatgcttcttggctagtagctagaactcacaaaatctattaaatagtaacatggtaacagcagaagtcagtataacaatcatttggccaaaaaaaaattatcgaaattgacttatacacggttgtttcaataacaaaccagtgtcactacagtggcctatttaacaaaacaggaagacaaaagaaagacaacacgatttcttgataacaaattagcaaaccaggttatagcaactggagcacagatgaaacaacaaaaatatagatgtcataggaatatatggaaacttagactgggaaacatctcttctcactcctcagtaaaaatgcttaaagtacacaatttaaattaaattttatttgccaccgaaagtgcaaacttcatgagcagatacatgtgctacgttgtttccacagttgagatatattgacccaaccattaacttcacctatcaagttcataacctgagcaccacatgtgtttagcagaacacagtggctgctgataatgaattgcagtagttgaatagcactgataatgatatctcactaatgaactgcattccccaaccaacctgatgaataaactgaaacaaatcaagaccaaatatgataggaataggttcatgagtgctataaccacacagcactataaatcttttttgagtttctagtttcatgaaaacaaaaacatctagtctaagatgatgaaaaacaaaaagtaaggacaataaatttaaacctatttccaacttatttttcatacttgaaatgcatcgcttgggtaataaaacttcggatggtttctttatttataaacttgtaaaaattccaggcatgattaaaattaactcttcatttataaaaacatctcattgcaagttaaacactgaactaacaacttagagttctatgatatataccatttctgagtttttcttttctttgatcagacttttaagatcttaacttagcaacagatgaactaacatacgctctgaatagtgaaagaatcaagaaaatcactttgcagcgaacttaaccatacaagttctaacagcaggagaaaagatatccatgtacatatatggaactagacaagacattgattgaaaagtatatacagttaaaatgcagtagaaatcaagcatctcaaacagaatgtatcaagccattccaccaaagaaccccaaagaaggcatgtatggcatat

SEQ ID NO: 68006 - DNA, 2663 bp, Oryza sativa
actgtttcgactctgggcaggactgtacagcggggatgaagggaggaggcgcctgcaccgaggatggaagggaggcggcgccggcactgggaaggaaggggatgcggtgccttaggggaagcaggcggatgcggtgggaggcgctggcgccgccgccggtgcgcgacgagaggaggcgccggcgcgcgacgagacaacaaggagaggcggcgcgggagccgctcgagaagagaagacgggaggcggcccggagtggtggatttccaccggttaagttagtggatggatttctctagggtttggggtgtaatgggccggcatatccaccttccggggccgaaattttaccaggattaagttcaccggtagtacctcaacttttatattgagttgtttgacgtcccttatctccaataccagaaatcttcagccctaacatatacaataccgtgtattttgggtcgtgtagcagtatggatagctggtttcgctgacgtgatatcctagtcagcaaaataaaaatagagtaaaagttgcagtcttgtgataatttccccacgctattgttgcagcaaaccgaaatatattacatgttacagcaaactgatagttttatcactatagttgcagttttctgaaatacactcataaaaataatatgtgagtcccacatgtaagtaagtgagaagaaaaaatacggggtttgcttgtcaatcccatcatcttagagagggggaggtcggcaagcctggaagagagaagaggatagaagcggctggcgatcctggcagccatgttcactgccacacccgatgacaacaaagatgacgatgcacatgtaccattgcagcgcccacccttccagcaccagcccatgcacatgaaggcggtgtcactcagcttcatcctcgcgcgtgttgacgagaaacacggtagtctgggagatatgcttaacttcagtgcaggtccaagacttgtcttgagtgtgctaagggcgtgtcagctggtttgatcctgcaacaagcaaggaaaaaataagcaaagtgagttagccaatagccgatcagccgataggtcgatgacgtattgttgatggactcagccaatatagttagaccaaatcggctataggctaagtaggtcaaagaatataaaaccctaaatatgtcgcatcggctgtaatatcatctacttagcttgataaatagatttcaaatgatatcatgaaaatagttgatggaacaatatttagagcaagatatagttaaaaataatgtaccagctagtactctattacatacttatataaacaaatcaatctatagaattatatcaaatagagatcaattaccaggtattatgaatgaaagtgttgataacgtattatgagtcattcatttattgatcaatgtggtacaatttatagatgggaaaggggtggcaaccgtagacgcgatggttgttgccaaggagtgccaagtggggagaaggcgcggttgcgatcctatctttatatggacgagatcaccctatagctagtttcttaacacatttgaaagattatttacattaaaaacaataaaacaaaaatattttgtatagcatataatagataaattatatttttaaaaaggtaaaatgaaaaatctaaaacttatatacgaactttcatattgtgtaaggaggccatatgaaaaaatttaaacttggatatatcaattgttaagcttatatattcataaggcaattttgggttttttgaaaaaaggcccaacccaatgatgcactgtaaaacaatcttcagaaaaagctaataattgttgaactaagataaactcagttgtataagataatccactcctataatttttataagagttattctttatatgcggtaagacctatactacaattgcaacattagatatataacaaaaaaaaaactcagcctaaagttgaaccacagccaccgaaagggcgggatccatggcatagtctttgcttcattatccaacaagagaaagaactcagtgctgggtccactggaagaataaagaaaaaggaaaaaagagcattgctcttctttgtcggttcgttgcttgagcagtgagccagtgagtacatgttcctctttctcctcttcacgatctaacgccatggcacgatggcttggccttggggatggtagacggcagacctgtatccatattgaatgagggtctgtttgagggagctgagattctgagaagctagctggagattctgagaagctgacctgagcctgattggggagcttctatgggtttgctgattggtgtgctaagatgctgaattccctgaaatacccctgaagtagatgatcctgattgtttgataactatttgttgtgtagggtaaacccatgtacatacaaatttttaaaagtactgttgtgaatactgaactctcataattgtagctaataaaaaagtcattgctccaattttttaaggcaataaggagggtcaaattaatcacttaatgcaaacacatacattgtacttttccacctaaatgtgttcatcaagcacatacaaaagcctaatttgccatcgctatatatgcaaataacaaagtactaattaattaaccactaccatatatacatcaaccacatagcaaaa

SEQ ID NO: 68007 - DNA, 2329 bp, Oryza sativa
tcatatcccactagagatagccgctacatattacagctacctattcgattgcaggagaagatatatatagaagcaattagcagggggaagatcgatcaaatgagagagagcaacaacaacaacaacagtgtcatacaagggcagcatgagggaggatcatcggcggcggcgctgcaggcagggaggccggagccggacgccctcatcaacagcatcgcgataatccgggcgttcacggcgaaggtcgtcgccggcgtgggcttcctggcgctgacgtggtcgacggtcgtcctcctcggcggcttcgtctccgcgctgcccatcaaggagttttggtttctcacgtttatcagcatgattcttgcctccacgtaagtcatcgacgaaattaaccctccccttttaacatatcgacgaaattccctagcacaaaactgcttatttagcatgagtgctagccagggttcactctatcggttgagtccttttgatcgagggtcatcgaaatcccgaaatttctgaatttagttaaattaatttgaacaaatattacctaaatttataaaaaaaattgaaaaatttcagccgaagttatatcgtatcggaggtgcggaaatttcggtccgaaatttccaaccctgctgctagcacggatgccggttaattagtgagtggtctaattccatcacagttcagtcttcgctattgacatgattagatattagtacacgttagtttatcactaatcgttaaataaattgtgactacgtcataagttatcacacatgagtcgtcacagtcgatatgtttaataaaacatttttttatcactagtaatacgataaaaatgattgaagaatatctagtcactagatatatctaaaatataatggtgacaacaagataattagtcactataaagacgcttactagctagtgaggatcaatggcttcatcgcacataaagaaatcactggtaatgcaggagtggtccaagggggaggacaaaggaaaaaggagagatgctacggatacgagggagagagagagagagagagtgcatggtcacaagaagaaataaggattaggcttcagctagctcatgatgaattgtatcatttgtgatttcgcccggttcttccgtccaggaatggggccaggtgaacccgcaagggagcggcgcggtgccattcccgtcgaattgatctcctgttccatcccattaccaaccctagtccacaatatatagatcttgaattcaagaagacactatttcatccttttttgacaaattgatcttttcaaaaatttattccgaaactagactgtgaaaaaactttaaccaaaaatagatcgtcggcttaatgccaaccgccttagcgctgaggttagacaactcagcgccatgcccgttggcactgagcaacctatccacgtggcagccaagccgatccccaagtgtacatggcagcggatcagcgtcaatcggaatggcgttgagtcaataatctcagcgccactgtgattggcgtggaactctgggacttagccgcttgcgccctgtccgcccaacacagctcctgtgttgggcggcctgcatccgctgagccgtcaaacctcagagccagggtaaatggcactgacactttggaccttagcgctagctaatttggcgctgagctatgggacttagggacttagacgtcacttgcgcttgggctacccaacacagctcctatgttggagctctgttgggctctgctctagcgctgagggtcaacgccaatatctttggtgctgagtttgtttgtttgaggaggtagggccctaggcagagagatgacattctaggtctttgtccagccttcatctaaaacctcacaaacagaaatgcatgccggccaaaatcatccccaagaatcaaaagtcatttgcctatcatcaggttcatctaccatcttattctccatttgagtcacatccaagccatcatctgacaaatccttccctacgttcacatccttctcatccggtacttccgaccatacctctgcattctcctcaacctgtacttcctctcctacctccacttcttccttaattgattctaacaaagccttcctacctccacatccttctcatctggtacttctacccatacatccacatcctcctaaaccctacctccatatcttaattaattaattcttccttccgatcaaccacaaacacatcattcttcggttcatgactgtatgcgtggattttcattgaggtctgaaatttcttttttcgattcactgtggtctatctttcaagcaaacacggg

SEQ ID NO: 68008 - DNA, 8725 bp, Oryza sativa
tcgatttgagggagatttgagaagattttgggagggaggagagagggctatgtggggtacgaacgaaccctagccgggcctggaaaaataagagaggagtgcctaggccggggcgactcagccacgaggtataggccgctaggttagcgccaacgcggttggcgcggagattagtgggcttagcgccaaggcagttggcgctaaccacctcccacgccagcaggggatcggcttggccgcaacattggcaagggggtcagcgccaaccgttttggtgttaagccggctaatctcaacgccaacatccctggcgctgacctagggacctatttttagttgaagttttttaaacgggttagtttcaaaataagtttttagaaaggaccaatttgtcaaaaagaaaaaaaaatggcaagcctcgcctcactatggaacacagccttatgaatcatttattttcatattcatgtgttttattagtagctaattaatgatcttcctcgctgcatttactccatttctcaatacctgactttttttttaccttccccttaattgcccttagaccaaagtgaataaaagttttatgcttatatttagggcatacctcactttagtgtttacaaattttaaaaaaataagttgttaaagtttgaaaatatataatgtttgatgtcagttattaatgatcttaatcgcggtaacccaatgcaacagggtcttgagcgtctacgattacgttaacgagacttacgcggcacgagtgaatcctacgtttggtatgataaccgggggatacttcacgttcctctcgaagttcgaagccaacctctccgctggctgcgccgtgcgctgctggaggctgtgtgtcatgctcttggtcctgctcatcgcgatggcactgcttataggactgcttctgatcgacgccgtgttcatcgtaagcttggttgggccgatggcaacaatggcgatctcgctgacgcgcctgatacagcacgactacgatggctcagacgcgtcgagcaaaggaaagctcagggcagccctgttcatcttctactctctggctctgctccatagcctgtgcttctacttctggctcctgctgcatttgtccctcgaaatgttgccgattccggcgagcatagaggagtatgggcacggcgacggcggctactaccagatgctgcttcgtcagtacctccaggaaaccaaaaccaagtgtgcgaatgatcccaagctgccaggtgactggaacctggtgacatacgccgttgggttgctggattctgcatccccggatgatcatctggatgggctaaggatgctcgacgtcttggccatcaacaagcagcgctctgtacggcttgagctgctgtcctcgagacactctgtccagaatctcatcgagatgcttgagtgggatggtccggaccaggagatgagagagcgtgccgcgaggattgtcgccgatgtcgctgctgcgctgcgcgtagcccagatgccagcgggagctctgcactgcatatcttctctgctagaagcctcaccaagatctgacaccttgaagaagccgaaaggcggtaaggagttgattcatcggggcctgcagattcttgagaggctcgcacgcgacgagcacaactgcagggagatgtgcaaaaccaatggctgctccccaagatcacagcaccaatcacttctcccgcgttcctcgagacagaatatgacagtgaatgggttgatatcctaagcattttgttgaggctggtgatgcggcttatcagtgctcctggagaagccggcacagtgctgtgccatgaaatctcagctagcaatgatgcagtccacaacttgctggggatccttgacggccaaatcaagttttccttgcaacttcaggaaaacgccatggatgttctttcagaaatatcaataggtttatctgcagccatgaccgagaatttagttaagaagttgtaccacatcttccttgccaacagtggtatgagatgattgaggccaaaagcaggggaagcgctcgtgaaattgatttctactcaaggtgcaagtggacaggtacctgttatggagatattctgcaaaagcatgtccatggagcaaatctgtgaaagcgagtccacagatgcactggatgtgaagagatatggaacagttgttgatcaactcactgatatacttgttaaagacaaggaatgccagataagtgcagcagcaatattacagcacttatgttctcgttttacaaggagctacgaactattagagcaagatgtggttaagctgctgatgtcggtaaacctcaattgctttctctttctaacatcattagcatgaatcaaccatatgcagttatttgaataattcagttaatgtgatgcccgatcaaacaatattaaccctaaattagtagttcgctctagattgtttgtttttagaaatttgaatagtgggaggttatctatatcagatttgctatttatcaatcatctagcattcccctaaacttgcataatgcataggctaaacttatatactttagaaaagtacaactttagtctagatgcatatttatgcttacatagaccataaacgttttctccatttcagtgggggataaacagcaaattacttttttttcaatgtttaggttagaatattctttgtttgacagaataaaggaaaaatatgagttattggacattgacctagtgttggaaaaaaagtgattgatagcgatatagatacactcacatggttataacttatactaagtacattgctaatatttagttccttcgatataaattttattatttacaatacatggttataacttatactaaatatatttgctagaagtcagttcctgtgagatgaattatattattgtaactgttgcggattcttgatcttatcctatacggtaaaacggaaggagatgaggaaactgtatcagaggcaagggaaagcaataattctgaaatgcataatgatgaagaaagcaaacctccaaaaccagctggtctgaagaagtccttggtggagaaaaatgatgagctatctgaagagaggaaacatctagcagctctgctatcccttcttgtggtgatatgcgacaatttggttgatgcagatcttttttctaatgtcacatctgtgaatgatgaactggcgaagaagctcaagaagataatagaagcaaataatgaaaacacagctgactgtctgagaatagtgaaacttacctgtcaggtggttatagcgataattcatctcaaacctagctccctcaaagacttcaatgaaagtaatttcaatgatgtagtgtccacggctttcaagaacatgtcagatatcgaaaactgcatgctctttgcagtcaaagatcgtcagataacaaagcctgccaaaactctctcttctcttgtaaaagaaacccagggactcctccacaatgcacaagaaacaggtaacaattctatctgactaaaatcatgtactgtatctccaagagtaacattgtacttcttgtcatctgaaaatattttctgaaatacgcgtgcaaatggattgtgcagtcatgtctattttatgtactaagtgtgcgaatggagtgcgccttctatgttctgtactatgtgtgccgattgtcgaacattgtatgaatactttaaaagtatagtatctctgaaacatttattggcacaagtactgttatatgttaggaatggcaatgttaatatgttattattgattacttcaaaactatggtttgaagttcatgttgagctcaaatctaatttggtggatacagcccataattgtaagtatgtcatagtgagtgagtcgatatgcattctgtaagatataacagaaaatcttaaagatagagcggtagatcattacatatattcaacacatgtattctctcttaacggaaattcttacagttagagcactagatcccacaatttttgataatttgaccctttgcaaaaactaattttacaaatgaaccgccgccaaaacttttttaaaaaatgacccttttgttcagtgccaaatcgtgtggcgctgaacttagacacctcagcgccaaatagcatggcgctgaatgtacgttggcacactaactcagccttccatccgcgttggcacagcattcagcgccagttgacgtggcgctgaagtgtctaagttcagctccatagaattatttggcgttgaaaaaatggtcattttttaaataagttttggcgaaggttcatttgtaaaattagttttttcaaaaggtcaaattgtcaaaatttgtgactaggtccagtccagcccagaaattctgtcttattcgaaacaaaagcaataaatcatttcatatattcaacacatcagaaaacataatgttgggcgggtgctgctgccgctcaggcatgccacgtaggataaaaatagtgcgcgggggtggaaattttgccaaaaaaaaccctctgttttgtgtgtaatttgatgtaggttcctcctacgtggaaacccttctaaaagctgtatattccatgaaaaggagagaaagatcacgaattaggaccgcgctgtgataaatggaagcataggggcttttacgcaaaacgacacccactaaccttaacctcaccccaaaaccctagccgccgccgccacccacgtccccttctcccactcgtcctactctctctgtctccgtctcgtgccgccactgggcgccgcctccaccgttgccaagcgccttcccctcgtggcacgttgtcgtcgtcaccaccgagcgcgccacctctacctctgcctcgcgttgcctcaggccgtctccgacggccgatgtccggatccgatctccatgtggtcggggcaggcggatttgaccgtccacgtcccctcctcgcctcactctctcgctcaccttctccttctccctctgaccacccccgtccagatcccattcgttgccgctccaggtgctgcggatcaaggggcagctcaagacagcaagcttcgtggtggcacacatcggcattgacttgggcagacaacatccatgatagcatgggctattggcggcggcaaccgagctctaaatcttgtagtggcgaagtcttccttgtggcggcagcgaccgcatcttcctggcagcgacgggatcacgggatgttcctggcaacaacagcggcggcaacttctcggaagcagcggtgtgttcccggtgacagcagcggctgcatcttccctgcagcgacggtgtcttccctgcgacggcaacgtcggcgatgacatctctcctggtgcaagttcttccttcatccacaagagaaatttgcatatttaccatcgcataaaagtggcttcgctagtataacatcacttaaatagtctttgctggaataccattctcaactgggtgcggtctgacactttgcctttttcatcgtttttggctaatgaaaaagattttgctcgctttcaagttttttttttttttgccgaaactgcccttggattttgttttcctctctatccaaaccataccgttcttttttttccaagttctttcgctcgctcgcatctcctcctgtcgaccgagcggaggcggaggcgcggtcttgccggcgtcgagccacctcaccgccgccgtcctcgccttctcttgccccgtcccccatccgccccacatcccgctctctccttcctgtcgaccgagcggaagcgcggtctcgccggcgtcgccttcctgtcgccccgttctgctcccgccgccgcttcccgtcccccatctaccccaaaagcgccgccggggaacggggagaggcggcgcggcggtagctgactcggcagctagcggcggcggtgatgcctgcgaggggagcagcgggattcgggggtggtggggagagaggcggtgcagctggcggcatggtggggtaacggggagaggcggcgcgacggcggcagtggtgggcggcaccagcgtcgccgcttcactttctcctcacgcctccgtcctcaagcaaccgaagtctcgaagcagcaagaggtagagagattcagcatgttgaccccgggcccggggcataaacgtccgagaaaaagtgtaattgagaaaaaataataatttcgaaatgcaaaaaaccacaaaaatggcatcgcagcgaatacccacgacttaggagtagcattccagcaaagcccttttaagttatggtattctagcaaagccatttttatactatggtagatatgcaattttctccctccctgcatggaccaccttagcaccgtgtgacccccaactctgaggacgactagcggcggcggaggatggggtcgtcacggcagaaggccttccacatggtccggaagcgtggcaggcggcagcatgtcgatttccggtacccggcggccatgtcaatcgaggaagtctgtgatcccgacgaggaacgcgtcgtcgccgtgttccacgattgcctcgccgcgcacggcctgctcctggacaaccacgatgactaccatattatgctaaaggttcaccaaaagttgctttgctaatggtgactttgccttctcttctgatgcaggtttctgaaggttaatcgaagacgatgcaaatgtgggcagagatgctgagatggaggaaagagataggagtcgacatgatgttgaaggtgaccagataacaaagcgcatttgatttaataagttacagtgtctgaataatatttggtttgatatattgatgaactccagtgctatgttcttgtggttaggagttctgctatgttcttatggtcaggagttccgaacagggataccatgctgttgatcaggaaggccagccgatgtacatcaagaagcttggcaagatcaatcgaaacaagctgatgcagatcaccacagtggacagttacaacttacatcaattagcatgttgtagagatttaattgcaggttatttgccgattgccattaataggtttttttttggcagattttttgctacctacagttcagttgacatgctttcttacagctaatgttcagactacaaccactaccagttcaattagcctgttttttgcttcttttcataaagttacacatatctacatggattaagtgtattgtcagaatcaaaacctggtaatttttttagcctttaaaccatttatctactcctagctattttgctcatgctcgatgtattctaaaagcaagattgcaacctttgtctttgttgctattctagggtcatggtagtgaattcatggtaacacacttgatcgttaattttcaatttcgggacttactttcttaattgagtcgtcctgtcaattggtttccagggaattgatggggatttcataagtagtcaagctcgcctgcctttaattctaattattgtatccatgacgaatggtgcggctttgtgcacacattgatggccatctccagcatcattcgtgttctttgtgcatcacacatacatacccctcatcttattctgtctgcatccaaacaaattgaggtttggattgtaggtcatttctatcatcttaacaaatacaactatatttatctaaaaaagtgaattcaactatattggataggtaattctatgtgtgtattgacctcattttcaatggtttacatgcaaaggtgaacaccaattcttagtttaatacaattatgcctgtttgatgaagctactgaataataaaacagtccattttaagcgcaataaaacaagccattttcaattttctagcacatcatgcaggtataggacaagcatttcttgtgttaatcactagattatgtttacttctggtggctcggctgttttggtctttcatatcttacagcaagcagctcgctaagttttttttttcctttgcagccctatttacagaagaaagatcagagtggtgtttctaatatgactgcaaagatgagctattttatcatatggtaagagcaaagtataaggtctaatctatctagccttgcagagcacattgccgatttctactaatgtatttttcttttcgttggtggtcacagagtgtccataggagcatagttgcagtgttccttcagttatgaacaggaacatgcttatctaagctgttctattttagctctctttgtatgacttgatttcttttatctagcatgatttatttgttctaccattctttaaaacttgttttttgcctattttttggtgattgacaaataccacagacataagaccaattcaatatacaccatgctgcatacaggtaaatgttaaaggctttcttctctaatttagtttcctcttcttaagtttgagattttctaagagatactaatacattatctcctcctggccattaatacatttaggccccttaaggaatgctaagttaactctttaggggcattgatgtgttctgtttttcaagttcgctttaaaaaaaacttatgcttttgttggcattttttttcattatacagatgataaaatatgttttataacataaatatgcttgcaattctacatcacaaaccataaagcctctcaggatgtgcccttttttagctatgacacgtcaggttactgtagtagaagcacactaggattatacggtgccattaactgttgttgtgtgcttgcatgtgcagctcttgt

SEQ ID NO: 68009 - DNA, 1060 bp, Oryza sativa
aactgaagataagaaggagaaggcccaactcggactcgggtagcagtctgaggttgccatactaaaagaggcccaaatcagtcatacggactccgattgggttgtatgagcacttgttggaaagataacttcaagcccgatccagattatgctcatgggctacaagactcgaagcagtcacatcacaatcatcaaaataattcgtgcctgtaatatgtagtttccaaattgactcctagtttgtttcctagtatttgaattgtatgtaaggccttgttgtcacgccctgaagttcccctcccttgctataaattcataaaataaatcgtccgaaaaaattggttcaaattaacctagagttgaatccttaattaataaacgcaaataataatcggaatcggcatgtggaatttttcttggattctacatgtcaaaatatgctaacatgatttttagtggaattttcagagccttggaaataattttataccaattaaaaatgagcatatgctttaaaaaaatccctaaaaatccttttattttcctttttccctttttccttccttttttcccctttttttttctcctttgggccgtcggcccattccttcctcctcctcccgcgccctccctccttgttgggccggcccgcgcccctttcttcctccctagggtcgccgataggtggggcccacctgacggtcgtctcctacctccggccgttggagccggagccccaactgcccacgccgccggcgccccacctcctccactctgccatcccgcgcccactccgccacccgcctttcccgcgcccacgtcgccgtgacgccgcccttgccttcccgcccgcgccgcgcgcccacaaagggcgggattcgatttgaatccctcctaactctctccccactcccccacgtcgccggccaaatcaggggggtttcccggctgtgtccgcccctcccaagcccctataaagcttccccacaaccccctctctcgtttccctcacttgccggcctctcccgagctctccaccgttcccgcaccgtgcacccac

SEQ ID NO: 68010 - DNA, 3092 bp, Oryza sativa
ctggccattgcctgctggggacgggggcgaaccctaaggtgtggtgcgatcggttagagggggttatgcgaagggtcctgtcacggcctctttccggtatgtcgtggtggcatgtcggcgcacgaaaacgtgtcgtggggctatatcttgtgggtacagttgtacacctctgatcagagtaaaactattcgaatagccgtgcccgcggttatgggcggtcgaccagattcaccgtgattagtcccacccctagttagctaatgaactggtgtagttcaggtggttggttgggcctgttgcaacgtggtgtagcgttgaacagtgattggttaatattgattaattactgcaactgttttactgctttcaactactgcttttaaatgctagctttatgcaaaagaacctttagcctcccttggatatatcctgcatcataccttctcttccggtatgacttactgagtacagtggtagtactgtcttgctctcttttcccccacaccagagttgaagttcttctcagttggagatgtctcgaagaagttagtttcgtcgctgccgtcaaggatgcctgtggaatggaattgccgctgcaggagtcaagtcttcaggcttagctcgcttttatcttttccgctgcatttgtaatcttttatatttttgtcagacgtggatctgtatgtcaacgattgtcgtttgtgtaccctggctggtcctggacaggggtttaatacacattcagcttagaaattctggttcgtgaatttctgggcgtgacacttgtgctcgactagaaaggttagaccacatttattctaatgaaaattgcagcaaatttgctcttgttcttctcctaggttttgtgccgccgctgccaaactagagagagggattgggagttctgccatagattgttcttgcttttccttgcagggaattgagagggcaatagatccacttttgcgtggtcaagtgtatcaacctatcaaagcatgtggttttgcgaattcatggtgaaaggtgcgttgcacgggcagcgtgttgttcatccagttcgtgaggtttcacggtgtatccggatcctacgtcgagaaggtcaggctttccccatatcatcttggtatcagagcacgattgtctcggtaggatcttttaccctagctacatattttatttctatcctatacacaaaaacgctaaaaaaaatagcccatagtttgcaatctggttctagtgttttttttgttaggttttaatccattagacttgtgtttggttgctgatcttagtgttccttcatgttacacttgagcctatatcaatttatcttgtttgcttgattttgtttcttgtcgcgttctgaattttcagtgcatatttcgttcagtaaaatagtcatcaaagttgcatacagggttggaaatcagtgtttaaatactttttggaaagagcacgtggtgtcctacaaatcattatgtctggttgacatcttaattcggccattatctgcgtgtttcggacacaacaaagttagtggctgttctgagttttgtttgagtcttatttcagtttgtgtgctagtccatatatcaataatacaaaaaaaaatagtgagcctattctatcctttgcgaatacttttgaacccattgagactagctgtaggaagttgcttttgggctttgcacggttgtatttttacagtcatacccgtattgttcaatccggtgtgctgatcgtagtggcaaaaaaaaagaagtataagagttcaaaaaaaaaaagagaaagcaaaaaaaataacaagaaggattaaaaaaaaaagagaagtgctgcgtcaccacatctattgtttatttcagaagttagtctttatttgttttgtgcaaatctggtagcccaattcagattttgagcaatcagctagcgtcactccttgtacttttgaaacatgagcttttgatttcatatccattttgtgtagctctcttcttggttgcataggtcccattatcgttgcgtgtgagtgctgtacacttcatttatatcttgtgattagcaactaggcattttgttctagcttggattactacttaacaagaaaatatcttgaatttagaattgctaggaccaacacttagccctccaagctccacatatttactacttgtgcaattgctcctgaactgtgaattcgcctaaccatcacctttgagttgtctactaccatcagggtgtaatcagcccctcatctcaagaaaggaagggtaagaacatcaattggtgggtgtagttgagagattccacaattttttttctttctattcgctgctgcatataggaattttttcataactaaccatggcaagaataggagaaactgaagatgttgaagaggatggtaataacaatgaaccaatcacccgtctccaatacaatgcattaagagatgtgttgcgaagggagatgaattccaggatggacactctagaggggagaacagatgaactatcacagaagttcgaaaagactattcaagattttgaggtgcaagtgaacaacaatatggagcaattgaggcaaaatattgttcaagatcttgaacatcttctaaggcctgatgttgaggatgatagtgtccatggatccttacttgatgagacggatggtgatgctgctacttgtgagaaacgtcaagcacaacaaagacgcaatattgctgctgcacacgccatgcgtccacatgggcgtggacatggtaatggtggcaatgggaggggccgcggccgtgctggtcgtggccatgctatcggtgcacatgaagatgatgttgatgcagacttcgcgttggatcaagattgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaataagataaacggcgcagacgactccactccacaggcag

SEQ ID NO: 68011 - DNA, 1583 bp, Oryza sativa
aaataatagtgagtcataagttatcccaatagtgtgctaatgtttctaagcacggctaagcaactataaataatatctagctgaaccaatccaatatataaggtccatgctagtcaaattataacccataggaaaataaagtcatcttcggccatagttaaatgggaaaggctcaccacccaatgacattcgaaaacaatgcataagttaaaataaatcaatagctttaaacaggttcaacatgctcaaagggttgtttgggatctgtgtgacttgccttgctggccttggaactcttcaaattcttctcctgcgaaaacggactctccggaaacgtcggaatctaaagagaaaagagcaaaacaccaaaacagcacataaacaagcatgaacagtatatgtggatatttttaacatgtagatctcaattttagaaaaatttggagacttgaaccaactaaatccgagctaagatgaattagttatgaattttcaaagattaaatcggattaaatcatttatttagattttaattgaattatgacgcaataatgaattatttttgaaaaggaaaaaggggtttattgcgtcagcggctagggttcgcggtgaaccgggtgcatggcggcggctcacggaaacgaacggccgagattgatccatccaaaacggacggccaagatcgatcggtccacggccagaccacgagagacgacgacgatgacgtcagcggtgacgtcaccaccggcggcggctcgggcgcgcaaactcgccggcgaacgacggtgcgacgacgcgaacggaggacaccaacacgtagagggcgacgcggcgaactcaccggtgaccaaaacaacggcggaagatcaacggacggcgacggcatcgaggaagaagcggcggcaaccttcggcttgacgacggcgacagtcctccgcctacggcgacgacggaggggcggacgaggatggcgacgagacggcgaccacgacggtgacctccccgagcgacgacgacgacgggagcggcggcggcgcatggctggacgaacggcgacgacggcggcgctaggctacatggtgctagggctctaccggcgacgagaggcgaaggcgagggtggcggcaggtagcggcgggcttgggggtccttttataggggcaaggaggtggcggcgaaggcccacggcgaccggcgacatgaaggaaagtctagggttcggaggagagagatcgatccgaatcgaactcgaatccagggatttccaaacgattctagccgacgattccaaaagagaaaaggtagaggagatcccgaagatcatttcccctctattgatttcaccggagaaggaaaggcgcgagcaaatttggaaggagaaggcggcgcggctcggctagggttccggccgggagacggcgcgaggaggacgacgagtccgacaggtgggacccacctgtcagcggccgagcgcgcgcgcgggcggctgcgggctgactgggccgaagaggagagagagggaatgttttgggccgactttcggcccaaagccaaaagaggattttaaaaacctttttcaattt

SEQ ID NO: 68012 - DNA, 2130 bp, Oryza sativa
atgatgatgtgtttccataagaaatgccagctggtttgccaccaattcgtggtattgaacatcaaagtgacttgattcctggggcatctcttcccaaccgtccaccttatcgtaccaatccagaggaaacaaaagaaatttagcgacaagtgcaagaacttctaaacaaagggtatgtacgtgaaagccttagtccttgtgttgtccctgttattcttgttccaaagaaagatggtacatggcgcatgtgtgttgattgtagagcaattaatagcatttctgttagatatcgccatcctattcctaggcttgatgatatgctagatgaacttagtggtgctgtcatattctctaaaattgatttgcgtagtggttaccatcaaattcgaatgaaagaaggggatgaatggaaaattgcctttaaaacaaagtttggattgtatgagtggttagtaatgccttttggtttgactaatgcaccaagtacattcatgcgtctgatgaatcatgttctaagggctttcattgggaaatttgtggtagtgtactttgatgacattttgatatatagtaaaacaatggaggaacatcttgctcacattcggcaagtgctagagatgcttaggtctgaacgcttgtttgctaactttgaaaagtgcactttttgcagagaaaaggtggtgtttcttggatatgttgtttatggacagggtgtataagttgatgaatctaaggttgaatcaattaaaaattggcctacacctgtgaatgttagtcaagtgcgtagttttcatggccttgctggtttttataggcgctttgtgaaagattttagcactattgcagccccgttaaatgagttaacaaaaaaaggtgtatcttttgaatggggaaaagcacaagaggatactttttgtgagctgaaaagaggctaactgaagcaccattgcttattttacctgatttcactaaaacttttgagattgaatgtgatgcaagtggaatcggtattggtggtgttttgatgcaggaaggtaagcccattgcatattttagtgagaagcttggtagtgcacaattgaattaccctgtttatgataaagaactctatgctcttgtacgtgctttggaaacttggcaacattatctttggccgaaggagtttgttattcattctaatcatgaagctttgaaatatttaagaggccaagctaatctgaaccgtaggcatgctaagtgggttgagtttattgagtcctttccatacattgtgcgatataagaaaggaaaagagaatgtggttgctgatgctttatctcgcaagagtgtgcttttgactcaattagacgtgaaagtttcaagtttagagagtttgaaagaattgtactctaaggatagtgaattttcagatccatattctaagtgtttggatgggaaaggctgggagaagtatcatgtgcatgatgggtttttatttcgtgctgacaagctatgtgttccagaatcgtctgtgcgtttgcttttgttgtaggagtcacatgcagtaggtttgatgggacattttggaagagaaaagacctaaatgctgctatctgagaatttctattggcctaagttgaggcatgacgttgagaggtatgtgcaaaggtgtgtcactagtcataaagcaaaatcgaaattgaatccccatggtttgtacactccattacctgttcctaatgcaccttgggaggatattagtatggactttgttctaggattgcctaggacaaggagggggagggattcaatatttgtagctgttgatagattttcaaaaatggcacactttattccctgtaacaaaagcgacgacgcgtcgcatgtagctgacttgtttttcagggaggttgtacgcttgcatggagtacctcgcactattgtatcagatcgtgatgtcaagttcatgagttatttttggaagactttgtgggctaagcttgggactaagttgttgttttcaacgacttgtcactcccaaattgacggacaaatggaggtggtgaatcgaacactttctatgttgctgagaatgatgattaagaagaacttgaaagaatgggaagattgtttgccacatgtggagtttgc

SEQ ID NO: 68013 - DNA, 1936 bp, Oryza sativa
aaagtagactttgcaaggggggcgaaagggctgggccgagggagagggataggccggccggggagagggggggcatgggctgcgagagggaagggggatttgggccgaaaatggcccaaggagagtagaaggagttttaatttgttttctatttaatataattgattaaatgaactttgtgtctttaaaattacttcttgagctccgaaaattcgcaggaaattcgagagaatatattaggacgcagagaatattacaaaatattcccggccatgatttttaaaggaaattttaattccctctataatttcacttgattgaattgctttaacttttaatataatttctagaaatgatttttaatcccgaacgaaaatcagagcagtactgatccgatggttaaagcatacatcagctaaaaatccgatgtcataaaatccaatcgatttagataaacagtgaaacctttgttgcaatcagctaaatacaatttgtatgtaatctttgtaagaagatgtaacatccagataacttatcggctagcaccctgataaaacattagcatgaacctatcggcttaacaagaattatattaacaataacaatctagtaggttggatctaaccgatgcagcacgagattatatatgataatctaatactcgatgagccgatagatctgtctaatgtgatggatataataaatatatctataacaacattgtgattgtagagatatatcggctaagacagaagatcagacctaatctagacagtcccaactaaaccgatgcatctctaaacacaatgcaattagagatagaattgagatatcaggtaggcaaatatatcaagcaaaccagagcgatccaagagatcgaagcgatgcagccttgaacaacaccaatgtagccgatagattcaggaccaatggaacgtaggacttaccccttcgccggagatcaaactgaaccgatgcagccccgcgtcaggtgccaaattccaccagttgttaagtaaaacctcaaaaaagagggtggcgatgcgccgagagtagtattgatcgagagataaattacaatgaccccgggtgtacatatttataccctcgtcacctccgctgcggcatcgcctctcgctagccgccaaaccttttcatctccctcctcgccccgccgacatcctaccgacctgccggcctcctgccttctcaagcgtcgccacagtcaccgccgttgcgttgcccgtcaccggccgccgacgccctcctctcccgcctcgccccgccggccagcctgcgcaaagaagtgagagagagatagaggaggaagggagagaagaggggaaagagaggtgccgacgtggacaccctgacgtcggacaaaactggggccaaaccacctatggacctaaagcgtgagtgggcaaactaacttgggactataggtgatgactggtctaaaagctttatctacctattattttagaaacttaaacgtttgaaacctagtatttaaactaccatgtttgtataaatggctaattctttcaaacaaaacagataaaatagggcaagcattgtaggcttagcatttaagattatgcaatataaatataatcactaaatgcccaatgcatgttagctaaaataaaatgacaaagagtgatcgtttggatcatacaaattcctaatgtttaacaaaaaaaattagagtaaaaatatttaaatcatgaaaacaatcataccacactacataataatcacgcatgcagagttatttttagctatgaaattatgttcttgttaagctatatggagtctcacacactctgcacgacaatgagctctctcatactgcgaaatcaattaagactcgagaaggctttttagaaggctttttatttgaaatatatatagtgtcacatgcacccaaggc

SEQ ID NO: 68014 - DNA, 1294 bp, Oryza sativa
aagtattttatcggagtacttaacccgtaaaggtagtattgaatcgatctactctcttggctatagaaaaaaaaaagggctcattttacatcctaacaacattttattcttttaaatttatgcttctctacaagtcatatttcactttgacacatcaagagacgaaggtaaatgataattaaacgaattcacttagttccacgctttgcacgtagaagcctataaggtgtcaatacaaaatcaatagcatatcttataacaatatgattagaagtttcctactaaattacgttgtaagactaatattgactaggtagttttcttaaaaatattgtagggtcctacgtataagaagcgctatctaatatatgtatatttagggaaaaaaatacatttatgagcaatacgagtttctcaagattttttttttaaaaaaacaatgaacaatcaattaaaaagggaaatacctaacattaatttaaacttattttggtagacctgtttttaaacaaaataacaagcatgcccgcgcattcacgcgggctacctttccagtttgctttctagtttgtagtaagtacttcttcccttgatgaaatttggtctgctttcttaaccggctggcgaaaaaaataatctatcaccataggccaagcaagtattgccatccagcctgccaaccgtattgagcaccctgtccacacatcatccgctgtcaccaaaacgcccctgctgaattgaattgctgatgatatcatcgggtgtgtccaacggctccagcacatgaactgcaccatcgctcatgccgactgcaaactggttaggcttccagggatgcgcagcgacaaccatgggatacacaatttcaccaccgctggagttgataagatgaaacaagagggcagcattaacaggtcaccagcattaaaattaccagactcgaaacaaaaacagaattaaactgttggagttggacactgcatatacctagaaactgaagatggtatataggcagaaggtgcaatcctgcactgtaacatgagagattccacttgaaatattccaattgcaccatcacagaatccagcgtagatcaataagccatccgatgagtatactgcactcgaaactggagcagagagtggatcacttgggaaccactgcacattgtcaatcaatgaaaggttaaatatcagtgatgattacaatatattgtgaaggttaggagcatcataaatatttatctcactgctagcatgatgtaacatgtttactcaagaccgaatcaagactg

SEQ ID NO: 68015 - DNA, 3893 bp, Oryza sativa
cgattaagataagtcaatattttgtcatgttgctgccaaatataaacaaacggtaattagtatattaagtataggactccacataggaagaaccgaacaatcaattaccattgttgggaaaattgactctcggcatgaaaactttgaggcaattgcgcactgccgttttccacccattgccgcgtgattaacatgttttaactcatgattattaccataattatgcaatcacgtgcattgattggtagcgcccaaaaccttatgtttttggaaagcccccgattcccctcagtgcaaaataaaatgggaggccgaccctagaggaaggtgacaactttttctctcggtctcaaatctcaccaacacaaaaataacgtaatcccgatcaagctaaaccgctggaggggaaacatggtacagtccaggccgatgcaggtggaggccggaggacgctgccagcctgccacatcatctctgcttaaactactacgccgccaacgaacaccagagcagttcaagagactccatcctcttctttcactccggttccaagagaggaaatcgcaacaagtgcaatggcttcaaacaatggttagcgcccctaatattccgcattaggtgatcttttaggcttagcatattatgaatcttaagtagattatgaaatctacaatcattatgacttcccatatcttcaaatgtcgagctgacaatatatgaggtttttgggtcatactgggtaccactttcttcatactgttgccaagagataccacaaaatagctatagaatgcgtgtaccttgtggtatctcctcaaagaccataaaaggctcacaatttattatgtaaaaaagaacatatgtaaaacaacatttagaatctcaccagatcctgatacataagtaaaagatgaggagatatatagtctgaaacgagaacatattatttcacaatgggtactgcacttccagtgggaatcatagatagtgagttttgccaatacttttgagatttatgcaaacaggggacaagagatgcacggctaacactcacctcgtcaacacggatattgtagagtagaatcgaagagtcatccgttccaatagctatgatgttattgtcatgcgggtggaatgcgaggaaagttgcagagggtggaggtgctatgaaagtagtcatggtctgtgagtgattccacaaaatcagttaagtaaaagaaaggccatgatcgatgcaactatgaaataaaaaatattttccggaagtagtcatgacctgtgagagatcaatcatgaaattaccagattattgtgttacatgactgaagaagacataccttgaaatttaacatgttgaacaacgaaactttgccaccagatgcagaaattagatagcagtcatttttggatagtagactgcaggcagctgcttcttcagggttgccattagcagtgtcattcattagaatgtcactttccggttgccacacttgaggtgggacagatgtggtggactaacaaaaagtagtgatggttttaagaaaacaaccaaacagaactgcgctgttgaaatcaaaataatttagttctcctgtctaaccatgccagcaggattcttgtcattgctctcccatttccacagcttatgaacagcatttgagctgagagctaaaagtcccttcccactttttctataaagcagacagataacctataaagaaaagaaataaaacacaatgcttatcagaattgtataccgatctgaatattctagtgaactgccagaattgtataccgctctgaatacagcttataagttataccactatcgctttgaattctagtgtgctacatcacaaaaatgagaaatcacatccaatgtcaatatcaacaaatatagacgcttgtgaaatatttacatgcaaatatcaacagatactgtgatcttccttgcattaaatagaatgtaaggtcctatgtttcaggttgataacttgatatttcatggtcaacgtactaatacgaaaagatgcacgtgcaaacatcgctgaacatactttgcttgaagatgcttctgtaactggcatacgcagtgctcgaatacggccagagctaacaatgttcgccttccaggcctcatttaccaactccggggttctgctcacatgcatatatgcctgcattttcaatacaattagcaaataatattgaacagcaaacgaacaagaaagtgcagcaaactcagctggccactcatgagttcctggctataactacagtacacacattccaaatggaaccaagggcattcacaatcaggggctgcatggtaaaaaaaacagtggttatttttcctctttctcccagtttcttcatccaacggccaaccaagctcaacagcagcaacggtcttcctgtggcaggacacggcagtagatgggtgtcgaagcatctccacgtcatgaagaaatctgcagtgaaatgaattggcacagaggacagtgatggtggggagacgtcaaccagtactagagaacacagtcaagccagagatactcagagttttcaatttcggaaattgttattctgtgggagagaacaataactgaggcatcagccaagttagaaacatttgcatggtggtgtatctctgaggaatcggcccggcacccactgacagtttaaaccgatggagtcactaccaggtcaccagtgcacacttgctactgcaggctaaagtagcatacctccggtttgctcgctcatgtgtatattgattcacgagaacgtgaactcaaatcaagaaggaataagtttaaggaccattggtaacttaactcgaatataaacatggtgcaactagtagcataggccctcaagaggcctgtacctcataaagatattgtaatcaaattgaaggccaaacatgcatctaggtacgttttttgcaatatcaaatgatagacaggacatgaatttttctactcgtataaaagaagggaaaggaatggatataggactaattaaaagaagagaaactagaagtggctagattcgactcctagtttgtgaggcataatataggggaagtaattacctttactacaaaaagcaacatgggaatgaattaataagatgaaccaacgttggtctatcaatgtgcatgcatgatcagttcctacctcttggtagggtgagagcacagcttgttcgtcttgccatttggtttgaacagttgggtgtttgggatggaccgcagctgagttcatcaatgcagcagccacttcctccacctctgacagacgggcatctccacatttcagtactatggtgactttctggagcgaacttcttccaagcttctcgaagctaagcagcttgtcaaaaccaagctgggttgcatctttcaggaaccgcatatggacagcaaactcgaggaattcaagacttggcatgataatagatgctaagcttctattgtctgtgatgttgcacttgctgccgtgcagatcaaaccagatagatgtaccaagtatccttaagattctcaacttccgaaagtagccaacatcttcagtatgaatctttatgctaaccaattcggtctcatgcaaacgcagcacaaggcagcggagctctggcaacctcgcaagggtttccatgtcctgctctttcacaattagcacaaccacatccagacaggagaggttcggagcaagcgatgatttaatccatgctggcagtccagagaacacaaagcaattcagacacaggtatcggagatgcaggcaggagacagatcttgcactgcttgtcactctccttgtcactaggggtgggccctcaatgtgcaggtcccggatattgtgcagcttgcttagggctgcaggaat

SEQ ID NO: 68016 - DNA, 795 bp, Oryza sativa
gtactgatttgtacggccatcatgttgcgccgcacgatcatattgccacggcctaccaagcagcaagtgacacaccgtcattggcaccacatcacactccacagtgtcacaatagtccccaatctgaaatgttacttgcaccatgaattgtatcttcacttccccacaatcactaaaccattgtacatgatacggatgaggatgacgcaccagattcaaaccaagcttgttgcatatctccttactagctaggctatgacaactaccaccatcaatgattactttgcataccttgccatcaacttttgccttggtctgaaataaattgcatcgttgttcatgatcaatcttgggctgaaccgtcaaaacttttggagtaacaacaagtgaaggtccctcttcaaagtcataatacacaacaccattttcctcatcctcctcttgagcatcatcaaaatgcgtcaaatcagcagctagatcatccttatcttcacttgttgattcatattcaccatcctccaaaatcagcattgtcttattatttgggcagtccttctgcatgtgaccacgtccaaggcatttgaagcactgaatattgctactctttggtgtagaacccaccgaagaggtgctgctacctgtaggaacaacaaatttcttgcttgcactttgtgtactctcctctttcttacttgctaaattgagagaaggagagttgctggagatgaagttcttgctcaagttaaactttggggtcggtctacccccactggacaaagagcgagtagtaaatga

SEQ ID NO: 68017 - DNA, 2146 bp, Oryza sativa
attcctgcagcccctaattggatacgattatgtaaatagaaaaggaaactcgggccgtgtccagcagggtttttctccttttaaccttgtctttgaacctgtataagaatggtaggaagccccaagaacataaccacaactcgatcatcagatcaataaacacttgacggatccaatcctgaaaacaggaatataatatttcttctcacctttgctcatccactttatctcgtgtgctacgccttttctcattgctaatttctagaatcggcacatatgcacgtaaacacaagtttgaagctataatattcggtctggacacatacttggttatcttaatttcactagacttgaacaaacgaactacagtcttttctcttagggcaaattttatagtaggggtaattgtcacgtctaattttattcatataagataagaggtgatatatacaatacaccacatctacaccacctctatcattgtaacctaaataattttattttatttgtttgtccaatcccctatttctttcatctcattttccttggggtttgtgtggaggttgctccttgcatgaggggtggctcaccttctctttcctcaattattactcccacctcatcatctaatcgtatatggtatttttagagagaacacatcaagcatcatagtacttgcccttaggctgtgttcgggagccccacttccttgcacggaaaacgaaccagtccactagcatgtgattaataaagtattagtttttttttaaaatgaatcaatattattttttaaagcaactttcatataaaagttttgtttgaaaaaaaacacgcaccgtttagtcgttttaaaaacgtgcgggcggaaaatgagatgagtgagttgggaacttaaagaaacgaaatcagccttaggtagtcttcttttaggcggtgattttcccccacgtttccaacttcaactatcttgtttttcacgcacatgcttcctaaactgctaaacgtgtattttttgaaaaaaatagtttttcacataaaagttgcttaaaaatcatattaatccatttttcaagcttttttttttgctaatacttaattcatcacacgctaataggtaacatcgatttccatgcccagccttaagccattgcaaatttgtcatattagaaaaatgccactactgtttacaatatcggctagatgccattagaattttgtcaaattggatctataccatagccatcacgtttttagttcgggatgaaaacggagtggacacggatagataacgctcgtaccatattcgtttttttttttttgccgaatatggattatctcgaatatgatcggacacgatcacacgaatacggaaacattttttcctcagaacacaaaaaccaattcaacttctaatataaacaaatatcaacatatataattagctcattttatataaaatataggataatttataaatagttttaaataattaaataatattaatagtgtggactagtgtcaagacataactactattaaaatctaaaaaggtatattgaaggtcatcggacatccgaattattatctgtatccgacggaaaccccgataccatattcgtattcatatctgggagaaaatatccatagctgtatctatattcgaaaggtatccatattcgtttttatctggagcggacggaaacaactatccgcttcattttcatccctattttcattcttcatatggaccaaatacccttgaacttgggacccatctgtcagtttcatctccttcctccatccctcctccagcctcccagcgcctctcttatgttcgtctgcaacctccgcgcccgtgacaaccgcttcaggacagcttcaagtggtccaccatgtcggcgaggtgggccaggtacaccaggagcactgccgcagcgtaccataaaattcgattcgaagttctcatattttaaaattaatttttaatgactattttcgcatgcggtcctattaatgaggcgcatgcaaaaatctattttcgcatgcaaactcttaagtggttgcagcgacggcgacggcatcggtgggcggcagcggcaggcggcgagggcggcggatccggcggcgccgtctcggggctgcagga

SEQ ID NO: 68018 - DNA, 2180 bp, Oryza sativa
gccatagggatgggctcggcgctctgcgatgggcggtgggcacggcgccgcagaggcgtgtatctggcaccggccccacgacggccggcggcatcgggcggcgagcatgggcctgtcgggcaccagccacgcgacggccagcggtgggcggcgtgaagctagaactgcaggcggcgggcgggaggctagcgtttcgggattatttttatttttatttttttcactgaaaaatatcttcgcatgtggttggctatataaaccgtatggaaaaattccttttttgcatacggttgcgttgcccgcatggagaaatagcgatttttgcagacctttccgtgcatgtgggccggctaaccgcatgcaaagatcgattttgcctgcacgcaaagatttctttagtagtagtgtgcttgggtagccgcagcgagaacgacctccgctcctcgagcgagtcctggagcgtgtcggcgtggtgcgcggcgcggtgaccgttgaaggggtcggccaccgagtggtttggggagagcgacacggacggcgtcgccgcgggcgctcctgcgtcatgcccgccaccgccggagtcagcaatggagcgcggtggcgacagtgtgaggcagagaggcaacggcgaggagaggaggaggatcgaagcggtggagagagagagagagcagctgcgtcgggagcatgttctgcaggatggtgaggaaggcccagcagcgaccatatctacgatccattgccgtgaattggagctctaagctctgagctgtgaactcagctagcttcttgctgatctactgcctgagctgctaagctggacagcagcgggactgatgccatcgccatcgccccgatgccgagctgcttgctgctgctttggctggccatcgggagaggaagggagggagaggagaagaagaagaaaatatatacgggagtggaaagggatagaaaacgtgatggcgatggtattgtttaaatttgataaaatactaatggtatcaaactaatatcatgaatagtacctagtaaaaaacggatcggaccggcgattcaaccgaatagtcaatagtagtggtattatttcaatgttttttttatattttagacatttttaataaataattttaataaaaaaagcttgcagtaacttattaacttatttccaaaaatgaaccagccacaccattgtaatcggtgtggccaatctgaacagccatgccattggtcacgcgtggcatgtcaaagggtgcctcatggcagacgttgtcgttgacaagatcaatctggcgctgacgtggcacttctgccacgcctagctccttggcgtggcaggtgtagtctgccacgcccgacttgttggcgttgcagtgcatctagcccaattattttatatttttgaagaaaataattatgataagaaatttcatgtgttaggaatatttttattaatttcatgaccattgtggtttatgatgaacatgctaggtttgtatttagaaaattgatactaaacgggtaaagatcggataaagtttttccggtatttgtgaggtattactagaaaacttcttggggttttgattaagcaagagatttgatctacctagcattcgccaaattaacttcaagacgataatcatcatggcaacaagtttagaactaggcaacacttcaatatattttgtgaacaaaatattcatgaaatattggttgccacacttgatgaagatattctccccaaattcaaaggtatttatattagcaagcatacgacaactgcatacgtcgaaggacgtggttactcaacagttgttgggaacaataaagtgtattaattcaaggatttttcttaggatcctccctttacatggccctaggggtctagttatagtcctattacagatccccctattagggtttagattttacaggggaatttacatggttgcccttatgaaagggacacttgtatgggtatacagtgtaattgagatacatgggcctctaacgggccaattagcgaacgctggcccactggccaatgggctagagcggctgggatggccccttgggcctccttggagctggggttgaaacggcgaagtcatcctccttcggcatgcacccttcgccatttagtcttcgcccaggacgcatttgggggctgcaggaat

SEQ ID NO: 68019 - DNA, 10592 bp, Oryza sativa
  unsure (1)..(10592): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaatttgttaaagttcgtgagtttttgttcgggctcagattcggccctggtttatgagacatgctcgcgagcctcgacccttttttacagccctacactgatgcgcagggtcattcccccactcctacacctaaaatcgcatgccatcttctccaactctacaacagtcagtttaaccatgatctaaaattgcatgccatcttatccaattctacaacagtcagtttaaccatgatcagtatgtcttgcaacatctcctttgcacttgcgcgcgtcaccacgagcagccaggcacatgtacactctcaattaagcacactccccgataactctcccacttttcaacatggtcaggtcgtcttcagcaatctcctcatggtgacagcgattccacttttactatccaattagaaaacggtgagtttatatcaccgagctaagttaaacattgcttgcattctccttccgctcactagcatgttactggatcgtagtctcatctcatgtcacaatcgtagaagtttttcctccgatcgaaggtttccctctcaactcttctagctagttggttaattttacagtactctaaacaaaaaagagaaccattacacagttgcaggttacaccaccattaattcgttttgcagtaattcatcttttatctggatgctatttatttctgttcgatgtcatgctcttatggctgaaatgtggtcttcccagatccaaaaggatagcacgacaattcatcctggaatattgactattcagaccatgatgtgttctgttaggacttatctaaagtgttctaagttttttttttccagccgtccattagaccaagatccaactgtcaaagcacgctattaccttgctagaggtaagatcgacctcataataaggaaagaaaaataatattcattaatacagggaacacgttaataataaggtgaggggagtaatttatgaatgatatcgcatatttgtggagtacaaatttaaaatacaacgtgctaattttgtttttaccctaaatacaattttaatcgcattttaattatatttaaaataaagtcaaatggtaaatgcaaaatttcgaatctaacatatcgtatctgtttattggatgcattgatccgcccaatccaatcgtatctgttccaactcctgttatatctgcttgattttgattaacaagttaccttgtctgcaatgaaaaaaattatctactgcaacgttccgggacacaactgtttatatgtttgttttcaaattttaaaaaagatagcaagactcatccaagcaggatcatattgacattgagtcatatacacatttgatgtgcacattctaagatatactatattacaatcgttaacatttaaaataatgtttgatcatttattttatttaaaatttagtgtaagccatatcgacttagagtttctttaatgataaaacaagacataacaaaataaataataatatatataatttgttaaataagacgaataatctaacaaaatttaacgataacattatagtaacacactaacagttaaaaataaaaatatatattaataaatgatacgaggaatatatattgcaacttcttttttctatctccccacagacactagacccacatttcatacacacagatgggtccatttgtcatccactcgaaatgttaaaacagccaagcccccatgtttgcagtctcaacattgcaattttctccaacgttgggtgggagattgcagcagtggcccatgctacgcagcctactgcctggttctcgtgctgccaaacaaccaaaaacaccggtgggaagaaacggaatcggatgtggattataaatcgcatgctctttgaatacggccatacgggttgaatttgactacatgtgacggacgaaaatttgataaaaacatcttaaatttttataataataatagagataaactcaggcactctattacatctctgatgcctggtcttctagacactgataacttgcaccgtgcattgctaaagaaatcttaaaaactactactactagctcttttgacaactaatcctactctatcatcttctaggccggatcggactaagagtaaaacttgtatttgctagcgtcaaggatgatctgccgtaatcctccgatgggtgaaaccagcatgagcagcattccgatgatgatgaaacactggccaaattgaacggtaagaagtaagaacaacatgattaaaagaatcgatttgattgtttattttcaggagcgtaatgaaaactgaaacttacccagttcattaaccatgagaggctgtacttggcgggcttgcgcattatgagccatatgatgcaggggatctaattaaataacatgaacaaataataataagcaaacaaattaaccaagaacataaaaattaattaatggagattaatggtgatcggatatataaataaatcttacgaagtaagttgttggcgcgaatccgaaacctccgaagaagccgaggaggccgtcgaagaaggggaaggttatcccgatgaacatggtcaatgctgcacaaagttgacagatcaaaacacattaaattgttttgatcgctccagagagtgtaaaagctatctaaacggttatgaaaaattcttgaaaattttgatacactcatacaacataagtacttccttcggattaataatacttgtcgtttagacaaaggcacgatcttaaaaaaaacaactttaatcattatttttattataatatgtatataaatcttaataaatgattttattgaagtattttttaaaactaatctatacatatacatgtagtcaccatatttcaaagacaaatattttataaattatttataactagagattttaatgtttgacctcacttttgtccaaaatgataagtattattagcccgaagagagtataccatcttataaaatcttagatccaaaaggtgaagtcttaccgacgtaggcggagcgggcggtgacgcggagcggcaggccggggcggaggtggagcttcttggcgagcaccgtctcgatcatgtcgaacaccggcatggcgtacacctggtacgcgccgatgacgtgcacgaccaccatcaggttcgccgccgccaccagccaccgcggcttctccagcgagatgagcacgttgggcgccacggcgttgccgaacgcgtggtagccgccgaacgccacggtgaagtagcagagcgccacgacggcgtaggcgacgacgacgccccgccacatgggcctcttcgacggccgctccggcgtcgacgggatggtggcctggatctccagcaccacgttgtgccccgcgaacgcgaacgacaccgcgcccagcgcgttgaacgcgccgaacacccgccccgccgccgtcgtcgccttgaacccgtagtccacggcggcggcggcggccgggtgggccttgaggaccgaggcgaagaacgcgatcatggagtagcagagcgacatggcggcggcggcggcggagacggcggagatggagttgaagttggggcactgcgagagcacgaactgcgccgacgcgaacatcatgatgtagaacgtgaggcggatgtcggcgcagcggccgtcgcaggcgagctcgacgaacttcttcagcgtctggccgccggtgaccatgtagacgatgtcggtgccgacctggacgatgagctggagcggcacgatgaggcagacgccgaggcgccggccgaacgccgcctggccgagctcgtggtaccggtcgaaccgcttcccgccgccgggcgccggctcgtggagctccaccagctgccacagcgtgtagagcgtgatggcgaaggaggaggcgatggcggcgacgccggtgggccagccgagctgggacatggcgaaggggaggccgaggacgccggcgccgaccatggcggtgacgttgtggaacgcggagtagtaccacttggcggtgcgggacgaggtgatggggagccagtcgtcgaggttcacattcctcagccgctcctcctcccgccgctccctcgccgtctccgtgcactcctccatcacttccgtcgccgacatcttggttcttcctcgccggcggtggcggcggcggcggcggcggcaactacctccgtcggtgatctaggtagggaggaggaggagatgaagggctaacgcaaaatatatatagcggcgaggggagcgcgtggtctcgggaaattatctgtaaaaaccgtgtctaaaatacgatcttatccgtaaaagagatgaaacccatccctaaccgattgttaactagaaaaatattttaaccgcgttaaaagagttctgggtcggcagtttaattagttgaatgttaatgagagttgtgcatgtttatatccattcaaaatacacgggtgctcgcatttacggctaattattctttcagtggtaggcgacgtacccgtcgacagcgaggcctagtctttcggaggtgctcatagggtagggtgtgcgtgtgtgcgttcataggggtgagtgtgcgtacgttgtgagcgcctgcgttttgtactgtgttttaaaaaaaacatttttatccgtaagggcaagctttgatgggtggttttcgggccgaaataggcccgcgaattcatttctgtcgcgcaaaaatggctgcttgggtgatttttgtttttagaattaaaattccagctattaggcccaatacacccggaagattaaaaggcctcggaaggcaacataaaaataaggaataagttcatctgtggtcccttgacttgtcaactaatccgatttccgttcttcaaccagaaaccagatacaacgagtctctcaattattaaaaccggtgcagactagctccctcagcggtttagatagcagttttagctgacgtggcgcctacgtggctaatttgactcggtcttcatctgacgtggcgcttacgtatcaattcgatctagaaaataataaaacccgtggaacccacttgccagtttcgccacaaaataataaaaaatggtgggccccacatgtcatcctcaatcccctacggttgttgctgctcttcttccttctccgttcttcgcggcgcggctactgatggagcggggtgcggcgtgaatgccgtcgcgacgacgctgtggtggcggactcgcaggaggacgcctcctagctagcagcggaggcggaggcgggcacgatgggtgatggggagaaggagcggcgcgcggcgggttacgggctatgggagaggaagcgggcggcggcgaggtcgcagggggttctcgccgaggttcatgttcgaagcgggcgactagatgctcatggagctcttcctcctgccatacctacgcgacggtgagctcccggtccccgacctcatcttcgagatgctcctcgaccgccatggctgggtgacaaggacaaggcctactttatcggcttgacggatggcgaggtgcccgacaggtgcgctccgtcggccttggagaggtgaaacacggcggtgagagagcccgtcgccgcggcaaagagaaggagcaggacgatgacgagggggaagagggtacagatgccgcgaggatagaggtggagttggcagcgaaagtatttgggcgagcacctggatggggttgacgatgccgccgagcacgatgcgtgtgatctgggggaagaaagtataagatgacgagtaggagtgggttgggtaggcggtcgaagtggtcgtcaccaaggccggcagcggaggaggagagccaaccttggtcttcgtcggcgtcacactactagtggcgggaccctgccggatcttcgcccatcgcgggtgaggcggaccagatctggaggaggaaagacgtggcatcagcggcaaggtggcagtcgcataggtagagacacgcggacaccaccagcgaggatggggctcctgtcctcccaagcgccggcaaccccgccggcctacccgcctcgtcctctatgcgcgctcgccgatgtggggagagcatagagcgctggtgagaagatagaggttgggagttggaaggataaggtagaggaagtgggaccactgacttgtgggtcccactttttttgtttgactgacatatatgccccaccattttttattaatttatgtgtgagactgacatgtgggtcccacgaagtttattatttttctggatcaaattgccacgtaagcgccacgtcagatgaagaccaaatcaaatttgccacgtaggcaccacgtcagccaaaaccaccgtcaaaaccgccgagggacctcatctgcactggtttcacagttgagggacctgttgtatcaggttttcctgttgaaggatgaaaattggatttgtttttaattaaacaaatcaatatgcaagcatatccaatcatcacctctcacatcatttctatgatattttaactagtctatctatcatttttataatatttaacacatacttatcaacatgttccacattaaagtacgagtatcagttcatgataagtactgataaattctgacgtttcatttttttttcttttttactcctagcttgattgtcgaaaaaatatattaaaaattgcttagtaattaccgtagcaaagcgcggggaatcacctagtatgagagatgtaacctcaccaggaggtgtctctatctagacaacccacctttatccctgttggtatttcttacgatcacagataaaatccgcaagcgcacggatataccgatgtagcactttccctacggagtattccaagggtatcaaatctaggaaaacgtgtgtgattagctcttcctccggttcatccaaggataccaagcgaagataggcaaaggatacagagaattttctactgagaaacataggaaaagcttaattttaatcctaacgcaatacttcaggcattggcaacccactgttctcagatgtcgctctagtatgtacccggatagagaggacttaagtgttcttgagggctatcaccacctctacacccacctcaaatgtactatgggatacgcaacaattactggataataattacctaaacaccacatctaaacaattattatctactttagtgtttataaaacacaaaagaaatcactatattttagttgattatagtgaacaataatcccgtatgctgattaggaactagccaagagatgattctcacaagataaatctatattactcaggaagataatgctattaatatcagagtaataaacagaacaaaataaataggagaggattaccgacagctccggaatttctctgacgtcttctactatacgctcttcctaattgtagtatacaaatagtacaatagagcctcttataattcagctcaagcttgggagtgtgtcttgaaagtgaagaagtgaagtctatttataggacagttaatgacggttgtggaaggggaaatactcgaagtgccctccaaccgccatcaaggagtgatcaggagcgtccatgccaaaccccacatctaacggtggaggtattggttcggccgaaccctggctggggcctcctggtctggcctttagcccatctctccctctgagcttgctctatctatttctgtgaattttgagttgattctctgctattttgataaagttcaaatcccatccttgtatggatatactccttcctcacctttagtctgattttcctcccaacctcggtgtttatgtcctgcatcgaaaaaacaccaacactcgtggaatatgttagaaataatccctatcactatgtcggatgttctattatttgagtattatgcaggtgttggcggtatatatttggcacttaacagccgccaacaatcccccatccaaacaagggatagaatcattccgacccattgtatccctcaaactaaacaaaaaatagggttcgctccatccctccaaccaaacagagactaggttcatcccatcccagaaaaagaggaatgaacctaacccatcccacctcatccctaaaccaaacacatggaaaaaataacgatgcgcctcgtctctctccatatcgcctgagtgcgagcgcagggctacaacgccatcatggcgctatgtcctccgagttgagcagtatcccgattctcacccccgtcgccccgttataaaattatacgcacacattttttatgattcgatatttctaaatgctctgaggtaaagtgatacgttgatatccatgcacccgtgaagttatatgtgaccataaaatctaggaaaagatacgaattacccccctaactatcacggtcaaccgaattacccccctgaactacaaaaccagacattgttcatcctgaactttcaataccggacaaattacccccctcgatccaattcaaagcggttttgtcctacgtggcgtacacgtggcaatctagtcagcattttctaatttttaaaaaatgtgggacctacatgtcataactccacttcccctcttccccactctctcttcactctctctctctctctcatggggcgatgcaggggcaggaagtgggtagcggcgcgagcgggagtggtgggcgcggctggtggtgagcgacagccggtgcaactagcggcgagcggcggcaggctcggctgctggtgagcggcggtgtgcgagagcggacgggcggcaggggtgcgcgggggcgcatgggcggtgggtgtgcgcgggggcggacgagcggtgggcggtggtggcggaggtgaggacgatggagacggcggcagcggcgatgctagagaccagggtggggaggtttcgggggccgagcatggcggcgctactggtggagatgtgggagccactggcgatgactccgactctgacggcaccgacagtgaggaggaggaggagggatccaaggcgagctcctccggtgaggaggagaaggggtggcggcgggagaggaggattgggtactactagggcgctgccgacgacgacgacggctgcttcccgtggagcggcgccgtggtgtggacgtggcaggatctccgccgccgcatctctggcggtgttaggctgctcacgccggggacatcctccgccgcagccggccgtggaggtgccggtggtactcagctggagccgtgacccccccactcccacgccgacgagcacgccacccaccgccgtcgcgacctcccccaagtgagatgtcacggcaccaccccgtaagaccaccgtccgcccccatgcgccgtccgcccgtcagccgccgccctccaccagccgcgcccgccgctgccgctcgtgccgcacccgtgagagagagaggaagagtatgataggtgggtcccatattttttttataaatagaatgctgaccggactgccacacgtgcgccacgtagaccaaaaccaccgcgtccggtttgcatagttggggtgaagaatgtccggttttgtggttcagggggtaattcatactttttcctaaaatctatttaccaacatctaaaatgtttgttttggactttcagaatacgagcttgaattggctatgctactctgccagggggctatggagaataaaatgctggaacaatgcactcaaaagcttaaatatttttggtgaaaatagagccatcagggctgttctgcctcaactatcagaataaagataacagaactgaaataaaattcatgtaaagaatgagctaataatctctataagtgaatggtgaatgccaaaacactacctgatcagcaaaaaaaacatatataccatcagatggaggaaaaaaagcaaggaggaagccgtaggatcagatcggtaaaaggacagcaaaactgttttttttttcctttttgggtcttctgcagttgtacatccagctcctccctcgtaccgtcatacgtgggagagagacagagcaaatgaaaagaaaaatagaaagaagaaaaactgcaactctagggctgtcgttgatttgaatctgcatatatttcaatatacgaaaacagtggaaagaataaaagcaatatctgaaaacagcttatattatatagttatgggtatgatacgtagtttaaaacaaatgtaaaccaacaatatttgggaatagaggagtagtaaaattatgaaattctgttcttagggtaatttcacaagcttagcataattactgtaaactatttatttccatgataacatttatttattatagatcatgtaaatctatgtgttgagggctgctatacgtacgatactcgtatgactaacgtttcccagcgaaagcccatagcgtttttcaactgttttctagtgatgcaacacacgacgttcaagtcatatgcatagtattttccatttgttttgtacttcggtttcctgccaaataggtaa

SEQ ID NO: 68020 - DNA, 3989 bp, Oryza sativa
  unsure (1)..(3989): unsure at all n locations
tagccatatctattgcactagctgaaatctttgtttacatacgaactactttcagaaaatacaattgaacctcaacgtatgtttataaaaaaaataacatgtaaacacattcggtatagaaggaggttaaattcacgcaaatgcacgacgacaatatacggtagtttattatactggagcttcagttttttaagcagctacttataactgcttgttgatgattagtgacattataaagttcatttattatctctgtcataatgagtcttgtgatgagaaaaattgatgagttgcaacccgactagtgaggcttgaagaaatgctagtttccatttttgatttttcgcacatattattagccacataaaaagacaaattcatcaattttgctcttgccccggtattacaaggattgaatgaatttgattgatccatatcctcttccactactaggaaaaacattatcgcaagcggccgaaaacggtcttcgcaggcggggcggccatccgcctgtaagcaaacgactgtgaagatcgccgatcttcgcaggcggggcggccgtccgtctgcgaagatagttttcgcaggcggacgttggctagtccggtccgcctacgaaaatagaaagtggccgcctgcaaaaaaaaaacatccgcctgcgaagataggtagaaaattttaaattttaataataatttgcccgtaaattatttttaaattatttaatagaagttcttgcaggtagattattatgtacatatattggaagattatcaagcactagcaaaatgcccatgcgttgcaccaggtaatgataggtctgaactatttacctgaagaaaataagtggaattgagctgatggcatatctttgcatctcgtgcacatctcaggaacaattatcctatcctatgtgtgaaatgagtcaaagtcccacgacagctccaccgctagtgtctcttgtcgctagtgtgtctaatatatcgtctcgtggaaaattttattttttttacaatccataatttttatcacaaacaaatattaacgtgcaagtaagcggccatgacgactctcttattttgaaagtgcaagaaggctagtccaatgttctgtgcgacagtgttaacagtaaaatttggtaatcggcaaagacgtcatcggcttagaatcattatcgactgcagcatcttggaatcagccgatgggagttatcaagtcaccaatagtcgggttcctgctatattcggttaaggaaatcaatctactaaaggaagcttatccctaagtgaccgagtttaaagaggatgcggcatggcagtttatctattaattaggaatagtttgttagttttcttttatctttaggttagtttctttcttgtccgacaaggacttgtatcaacccatgggtataaatatgtacacccggggtctatgtaatctatcttcatgatcaatacaattcggcgcatcgccaccttttaccttttctactttattttatcatccggcgggacttggcacctgacacggggctgcatcggtgttcgatctccggcgaaggggtaagtccaatgctccgccggcccaggcaattgtatcgtttacgtcggcgtcgttcaaggctgcatcagtacattcgacctcttggattactctggtttggatgatatacttgcctgcctatttatcatatgtctctgttaatctagtcttagcatatcaatttagctctatcggctacttctcgttttagggtttctgccggtatcggctaaatcgcgttgctagattagactagcttagacatctaccaccctgaaaactcagtcaacggcttgattgtctagatattatgtttcttttcatacttagtgctgcatcagttaagtttgatctactaagtcgtgctcagaaccataatctctagcctgcttcttgattgccaataagggtttcatcggggttttagccggtgatttatctggacgttgcatcggctcataaggattgcatatacatataagttggatttagccgatgacaacaaaggcttcactgtttaatctaatcttgtggatttcatgacatcggacctcctgccgatgtgtgctttgaccttcggatcgatgcttatttatcatatcattatttgctgattggtttatactggattatattgttattttattacatcgtcgtcagctgattgcctttatatcattatctacattggacatatagccgattgcttaaaccctatcgctatcggctggtatcggcatcgactattatcggcatcggctggaactactccatcggcttgtcagccgatcggctgttttgatctactatttgcatatcttgtcagttgcaagatcaaactgactggcacactcacatctcaccaatctttggacctgcactggagttaagcagatctcccaggccggtgtgttcgattttttcgtcaacagacagtaatcaatttctccttgtgcaagcccttcttgtattcagctatctcttttggagtcttgcccttcagctggtctgaccctggtgctagcctcacggtatgctgtgtttgacagatccgagttggagaagccgataggttcttttttcttcttagcatccatgtattgcatcctacaaaagaagcttgttagtaacaatcacatggatttgtattgtacatacttttcatataattaattaaaactcatctactcacatgcaccaaacaccaacatagttgacgttcatcttatcctgatgatatatggcgtggagatctgagaaatctagccatacgtaaccttcggcgctgaaacaatctgccggtgatcgagcagttatatggccgaagccttttttgctagcatgcatgtagaaggtatgtaaccttctcatctcccatggtcctttgtttagtgcccaatccggcaagagtgctttcccatgttcgtacttttccgggcaatcgtcagttaccaagtatgttggcccggctagttcagcggccttctgggggtcatcatctctgagtttggcacgttccttacaccctctgaaaacagttaccatgaagacggttaccaataaccagtagcaggtttaaatggatcataagtagaattatttatccttggtctgtgtgcgaagataaaatatgactatcaaaagtagatggagggagtactacgattcattaatattttacatttctcgatgcccatatagccaatcttgtgtggaagaatggagagtcacgcattaaatccgagaaagtcattaagatgataagttgttggattgaaatatgcctatcaaaaattgattatcaaaagtagatggagggagtagtttgttacttccttcgtattatagcaacctaatttttctttatctctctgccatataaacatatgctttgtcactttcttcatctcataatataacaacctactccctctgtcccataatataagagattttgagtttttgcttacaatgtttgaccactcatcttattcaaaaatttttgaaattattatttatgttatttgtgacttacctacagtactttaagtacaacttttcgttttttatatttgcaaaaaaattttgaataagacgaatggtcaaacgttacaaacaaaaactcaaaatcccttatattttgggacagagggagtagtatagaataagggcctgtttagatccccggtaaaatttttcaccctgtcacattgagtgtttaacacatgcataaagtattaaatataaacgaaaaaataactaattacacagattgcgtgtaaattgtgagacaaatcttttaaagctaattgatccatgatttaacaatgtggtgctacagtaaatatttgctaatgatggattaattaggcttaatagattcgtctcgcantttacacgcagactgtgtaattcgttttattatcggtttacgtttaatactt

SEQ ID NO: 68021 - DNA, 858 bp, Oryza sativa
cactgatagtaacgcaagggagtgaagtcgcatagctaatttccattgtaatttggatacagtgcactgggttcatctccctcaatggctaagttttatgaaacaagttggtttagggttcctcaatctatcatgtcttttctatatggtccatttgatctgagctcttcttgctgatgtggatggagcatatcaatcagccatagcggtcactgcatcttcactggccttctcccttgagcctggccttcttccttcagtccttgctggctctggcctcctgaatcatttctatatatttctctgtagccaatgaatgttttggagggctctaattgaagcataatcttgtgtatcatggacatggtgaggtatggtccaaggattgaggatatggggcaatgggatactgtaggattcctcttaggctgttaattctttgcttgatttgaaaacactgcatggcttgatctgcaaatactaaacgtcctataaaattgtagtggttatgatattgtgtcaacaactaaagaatgagaagccaacaaatttacatagggtgtgtttagttcacgccaaaattggaagtttggttgaaattggaatgatgtgatggaaaagttggaagtttatgtgtgtaagaaagttttgatgtgatggaaaagttggaagtttgaataaaaagtttggaactaaacaaggccataatgcctactagtgatctttatcttctgctgccgcatgggaatcttactgagttgctgtgactgctgctttgctaaacgcaccctctctttgtcctcgagctatgactaaggtggctgcgatggaagcatggcaccatgcactaaacctgta

SEQ ID NO: 68022 - DNA, 1052 bp, Oryza sativa
tatctccaacgaggttagcaccaacaaaataacaatatcatctcctatgctagtgacattattccattgatttgccacctcgagaaacaaaaagttgtgacaaccctgaaaagaagaaaacaactgcagaaaaggatctccactccaccttatctctgaagatcatatttcccaatcctatgatccatttctttattcctgcatctctctctttccttccttttgtcgacgacaggttgccgtcgactctgcaccagcaacggtgggggcatgcaggcaccgcaccgacgacggcgatcgaagaggccaagaggcaaagttttgcagtgattttggtgagtttcaagcatgcaaaccaagcagcagcagagagattcagttgggagccacctaggcatgccatgcatctttctttgcaaaggttgagacccagcagcagtgcagcgtgcttgacatctccttgtgtttttctcctcatcatggaccacttatcctatcgagatccacatatcctggcctagattcgaccacatcccatccatctcccttttcccttcctatgcagctccagagacctgcagtagacagactctgcgtagcatatggcatgatttctgcatatccattatcttgctaggcctagagatcttaacagttgggccattattgatgcaaagaaagctggtgctttgcttctttgtggagtagctgtagttcactgttgtgtttgagttcttagcatgcaaagcaagcataagtgaccagcatgtcctgacagtaaaaaaaaaaagaagaaagaaactgaattctgcatgattcttcactggctttcattctctgctgttagaagcaagcataagtctggaatgaatgcatgatgacaagagagattgttgtgttttttacgagagtggcatgaatggattggctgggaccaatggtcacaaggacatgaaggggaagggtccaattattgaagcactggaagaagctcagagccacacaagaagatgtcccagctgcctcctgtgacaggaacagggctgcaggaa

SEQ ID NO: 68023 - DNA, 1612 bp, Oryza sativa
caacatcaaagaggctggcccggcgcttctttttgccagggttggtctgccggaggaagtacttctgggcgtggctggccacctgagtcgccgtcctgctggtcacaaagttcttggagatgcctctccagtcccctttccccagctgcctcagcccttccaggaatttcttgtgctcctcctcagtccatggtaccccttcacagattaatcaatcaaaggcaattaagtgtcacatgatcttcacaggaagcaacaaacagggaataattaattactcctaactagtaaaaagtttttcaggtctgagaacctgcttgtggattgttatcgatgtgttgttgaccaattgactgacacacaaaaggttaatcatttttctctctcttttggaagaggggattttcaaccaattttgttggttgctcaatcaaagatattttttttgttttttttttgctttcacggatcatcaaattgcgtcaagaattaacagtgagttggaagtttcagagtaaaaaaaaaggaatcaggtgatggaacaagtaatgaacagtagatacaagaacagacaaaaagggtggttgctcacctttcttcctctcctgcaccttgcggcggcggcgcttctgctggccggaggcgagctcggagtcgtcggaggcgcgccgtttgccgccgtcggccggcaccggcagcgggtcgatggaggtgaggttgggcatactggagctcttcttgatgaacaatccaccctccacctcctcctcctcgtactcctcctcgtcaactccgccgccgccgccgcggacctcgacgccgaacagccggaatatcaccggcggcgaaggcttcctctccgctgcctcctcatgctgctccatctcgatcggtggccggtcgctgcgtggtcgcttttggtggtgagaatgagatgaaaatggcgggtatcgtcgccgcgatgaaaaggggggattattattgttgggctctcgacggtttggaggagactactgctcccactcctcttctctgtttatttatagagggggtttatttttcttataaaatgcatatgtatttgaaaagaataataataaaaaattaaattattttaacagcaaaaaaggacgaaaattttagtccttttgttggtactccctcagttttgacttattttactagtcaaatttcttttaactttatcaattttatagaaaagtttagcaatttctacaacacaaaattagtttcattaaaactaacatttattatgcagtaaaatatatggagggtcatttaacttgtttatgtgtgtcgtgtatatcattctactttcaaaatacacatttagattactaatatgagttaagtaaatcatttgattatcaaactatccacgtgagcgcatcttgtacatatggtatgtcacctacgattgaaaaaaacacttttggaaatatgaaaaaaaaaacgtgtgtgtatttttccctttctcacagcactaacatttagaaatacacaaaattagaggaacacaatcatttcacttctacctgttattatgtttgttttgtgttgaaaaatattactaaatttttatataaattag

SEQ ID NO: 68024 - DNA, 9739 bp, Oryza sativa
  unsure (1)..(9739): unsure at all n locations
gagatgccatccctctcatttccctgtcttccagtgacgtcggtacttacgtctaaaatcttcttgaaatgctcagagaaaaaaagatctccttggttgtgcctgtggtagcatatcgaactaaatctaattgttggcaggagttttcgcgtcaatttcttggcaacgatcagagactgaacctggctacgtgtacatgtatagtgtcagtaactcagaatcttctcttctttttttttttcagggcatcattgtgtcattgcctgggtagccacactggacagaaagaacattgcaattgcgacaaaaaaagaaagaaataactgtttgccagttgggttgcaatttgcctgcagcttcgaatattccacgtgttgatcgatgaacaacagattcagatattcagatcgtacattcgtacgtacgcaggtacgttcattcgtttctgttcagcattactatatatctcgtcgatcgatgaatgaattattagctcatggttgcatatatatgtgggcataaatatctctcatcacattggaaatatcttgcattgctagctagcccttgaatgtatcgatcgatgatggcataggcataacgtatggtcgagaatactccctccgtttcaaaatgtttgacaccgttgactttttagcacttgtttgaccattcgtcttattcaaaaaattttgtgaaatatgtaaaactatatgtgtacatgaaagtatatttaacaatgaatcaaatgatatgaaaagaataaataattacttaaattttttaaataagacgaatggtcaacacatactaaaaagtcaacagtgtcaaacattttgaaacggagggagtatataggtatagcaggacaatcgagcagctagctagcatacagatatcagtagtatttttcctcttgcatccttttctttttctgaagaagaatagatatcatcatcgacttgtttgtctttttttttttgaaacttcatcgacttgtttgtcaatggaatgcacagcaacatgcatcgatcgtcaaatccgtagtttcgtaaccaatcatcaaattaatcaaatcatgcatcgatgggcaattgtgtatagttactccatttacgaggtagtactccaattaggactagtagtgcttttaactgtttttatcttcgttatgagtcatgaccgggataagttcaattcacattttaaatcgatggattttcatcggtctctcctcgaggtgacaaattatgagcaaattgcagacgagagaagctagggtcttttgacagagagtgaaaaacggcaaccctggaattctcattttctcctcgtatttgtcaacctcccggtttttctacctcgtatggtatcacctatccaaacctccttaattttttactcagtagtagatagatagatgatcttagtaactgaagtggatttactgacttaactctagtgtttactcttgttcgtctgaaactaggaatatcatacagccgccgcagtacaaaactgagttaaaaaacgcacgcctacgtagaacaaaactgcactggtaaagtgggccacttgaatagataaagaaatggcccagctagtcctaatgactgaacgggaaagtccatttgacgtccctcaactatggtttgtctaggttagtccactattacagcccacaatgccttctttgaactgggctggtctttacattctccaaacacaaaaaactagtgaaagtttcgaagttgggggtatgtttttttagataatagttagcggatatgttttagctgaatgaatggtgattgatactccaaaattgtatgtgctgtggtcatgacttggacaaattcgaggttgcttaaaaaaagacagggaaaatcagtgtttggcagaaatagtgtgaattcaagactcaggccttgtttagttcgcgaaaaaaaaaattttgggtgttacatcggacgtttgaccggatgtcggaaggggttttcagatacgaatgaaaaaaactaatttcataactcgcctggaaaccaagagacgaatttattaaacctaattaatctgttattagcatatgtgggttactgtagcatttatgggtaatcatggactaattaggctcaaaagattcatctcgcgattttcatgcaaactgtgcgaattagtttttcattttatctatatttaatgctccatgcatgtgtccgaagattcgatgtgatgtttttcggaaaaaaattttgggaactaaacaaggcctcaatagatacttatggaggatcttttgagtggcttgcgtttctgcaatgttgttggacggtcgaccttctgctaaagtgtggtatcgacagtcactcgacattgcctcctctgcacccaataacagaagacggcgaaccacatccatcttaactatgttttttcttgccaagtatggtaccatgttctgtctcctcctggttggcccgacctcgctcttttctgtggttgttctctctaggtttggtgaccgtctgctagggctcgtttacctgagtatcttcgcaagggcttcgactctttggtcctcctggtctcctgacaactgtggaatgagcagaactttagagtattcgatcgctcactctcttcggttttcaatggtgctagagtctatcctccaggaaggccgtatgtggtcatctgctggaactgctgcttttgaggacttttgctaggagtttagtgggactccgccctctaggagtttttcatcttttttaagttgtctataagttgtcttttcttttcggttttttatttctcgtcccccgacaataacactttagttgtttgtgttatgtaattaaaacgttgttttcttctaatatattgtcgtgtaacttttttctatgttggggaaaatacttacataggatgatggtgtaatagtatgtttcctgtttcacgatttaggtcggcatgcgatgcgatgcgactcagtgactaaactttacttcgacttgacttgacttagtttacgaccttgtatttcccagtcttggacggtgatctccattgcttttgtgattttgcttaatcattttttaagttggcttttcaaaagggctccaataagtgaggtaaattagtcagacttaatgacacaaatttccgtagcctgacaaagtacacacatacacagtacacgctcgtatgcacacatgatgcacatgtcgcgcgcgctgcctcgccacgccacgccgcgccgcgcggcttataagccagacaccggcgcgcgcgccctcgccactcgcgagcttctactgctgtctctgagatactgtcagtgcactgtctgtgcgttcccggccatgtccgccgccgcggtcaccgccacgccgcgccacgcccggccgtctcctctcaacccgaacgccagggccgcggcggcggcggccgccgcggcgccgccgaacgccgtgtccaccaccaggacgcacctcgccaacctcgaccgcctcctcgtccggccgccgccgctccccctgccgctccagaacaagggggcgccgccggccgatgacctcggcgacggcggcggcgccgccaccaccgacgaccggagcggccgctgcgggctgctcaacgcgctcaacctgtccacgttcctgcccttcgtccgcaagccggccgtcgacgagatgtcgccgcgcagcctcgcgcacctgcagcgcctcctcacgctgtcgccgcggccctcgccgaaaggctccatcgccggcgagtggcggaggtatcacagcgagggcggctgggacgggctgctcgacccgctcgaccagaacctccgccgcgaggtcctccgctacggcgacttcgtgcaggccgcgtacacggcgttccactccatgccgtcgtcgtcgtcggcggcggcgtcgcagcacagccagcaccggacgctcgtgctccccgaccggtcgtaccggccgacgcgcagcctgttcgccacgtcgtcgctgtccatcccggcgtgggcgcggcggcggtcggcgcccgggtggctcacgcagcgctccagcttcgtcggctacgtcgccgtctgcgacaacgagggcgaggtccagcgcatgggccgccgggacatcgccatcgtcctgcgcggcacggcgacgtgccccgagtgggcggagaacctccgcgccggcctcgtgccggtcgacgacgacgacgacgacgacgtcggctcgccgcagaacgcgccgaaggtggcgaaggggttcttgagcctgtacaagacggccggcgaccacgtccccagcctctccgacgccatagtcgacgaggtgaggcgcctcgtcgaggtcttcgagggggaggagctgagcatcacggtggtgggacacagcctcggcgcgtcgctcgccgtcctcgccgccgacgagctcagcgcttgcctgtccgcggacgtggctgaacatcgccggcggccaccgccgatcgccgtggtgtccttcggcggcccgaagaccgggaaccgcgcgttcgccgaccgcctccagaacggccgcgcgtgaacgtgctccgcgtggtgaacgccggcgacgtggtgacgcgggtgccggcgccggcgatggcgcgggagggggaggggcacgtgcacgccggcgcggagctgaggctggacagccgcgactcgccgtgcctccgcccggacgccgggccggcgtgctgccacgacctggaggcgtacctccacctgctcgacggcttcgccggctccggccggccgttccgcgccgacgcgagccgcagcgtggcgcggctgctgacctaccagcgtcccaacgtgaggggcgcctacgtcgagcgcgccagggtgctcggcttcgagccggcgacgccgcggaccgccaccgccaacggcgccggcggcggagccgaggggcattacggctacttggctagcccaacatgatcgttgcgtactactaccactgtagcatgcatgcattgtcgtgtaccaccttaattgttataggagtaaattgtatcgatagtacaagaacttgttatgtgggtgcaatctaatgtatggacttgtaaaatgcttgttttgatacgtgaacttttcttgctcatatgaattaaagtcaaaaggacattatataactaatttgttgatttagatgctgattaggatactacgtagagacatacacttgttcaataaaaagatagaatgatatatagtgatcgtagagaaagatataaaataccgagcaatgattcatgggttagaaacatatgaaattcaagataaagtagagaacaaatttataaatataacatattttatgcatactcactattcgtatggacgccacatcctaatcaacatcagctaggtaaaattaaccttgctaagccattttagacctagatcacacgtattagataagttcgtgtaaaaaaagaacattttacaagttcatatactaaattgcacacacctaacaagtttatataccaccaatgtaatttactcgggaatggtatttaactcgtaattgagatgtatctgcacgtgtttcttgatgtgcattaattctactgcatatatgatcaagaggtgatgcggttgagtcaacttaacggtgaactttttttgagaactaacgatgaacttgttggtgtagtcgtacgttatgcgtatgctttttggtggcaaattaggtggtcgttatcaaatgactggtttctggacattacgaaatctgtcaaccatcagtggcaaagctatatagtgtttggggtacacatgaaccccccaattcctaatttctcacttaaaaagactaaaatatatagtgttgtattaaaattttctatattctcaatggtagtgcaccctcttattttgatgctagcttcgcccctgtcaaccactcatgatcgtgcatcattgggtgcatatgtgcatcatcaggcacaagcatatgtgacatacagtaccgatttgatgcttgaactactgaagttcgtacctcaaataccattattattatttagacaagagctccaggactatttgttactccctctataaataaaaaacgaattccctgtcaggggcggatcccatgtgattcatgggtattcacctgaatacccatagaatttttaaaaaaataactatatataggtatgttatgcatatatacatgagaaattagaaggaagtacagcatgtatagcccaaatgaaaagaagcccatttattcgcagcagaccatacattcctccccatcttggcccaacgaataggcccactggcccaaaaacgaacaaaaccctagtccctatcccccggtcagctagtccccacgccttctgtcgtcccagccccaatccgccgcgcctccactcatccccaccgacgggcgacggggcatcgagagctcgacgctcggcggcgccggccgccggctcggcgcgtcgccagaatcgccaccagcctcatctccctggaccctggtccctgggcctgctgctgcggaggcggcgtggcctgcgacgacgccgccgcctcctcggggacgggcgacgctgagcagctgaggttcgcacggacggcggcggcgctgcggcgcacggcggcagccggttgcggcgacgcacccccgcgtcggcgcgtccccttggtccctagacagctggacagtggactggcactggtaaaataaatcctcttgtcaaattccccaagcgattggccattgcttaattgctattgcttagaagttaaattagtcagaaatttgaactgtaggtcttgaaatttgaaaaatgaagaagaagaagccaatagatttgaagtctttgtgggaaaggtcaaccaagtctcagaaagtagcttccacctctgatccaaaaccattaaccattgagagtgaagttcagatcccagaaaatgccccttctagtcctattcagctactacttgaagcacccaatgcctatgatagtgatatgtccccaagtgtgcagttggagatagacatcttgactattgtgctactgtttgtacctttaaggctttaaacatgtcattaccactcctgtatgattttcccagtccaattttttgagttctgtatgatttttttttcagctttgaataccctttgctcaaatcctggatccgccactgttccctgtgtccagatttatattcatgagctattcttttactacgatgaagagagtgccaaagaggttaagcaagcaatgtgcaaactttcgttcaaatgcttgagccgctgaaatccatgttggattcaccccccattcgtacaagataggtcatatattcacatgagtttcgtaacttcgttcagaggcttgtttctgaaaatccgtagaaagaaaatctactccatatatataatatgcatcactctttgaggaaaacaatacattccatccgtccaaaaacataactatttttggaatttagttttttttttccaaaatttaaaatatttcatcacctatttcatctcaactaatcataattttctccctatttaaatgtcccgnctacgttttcttatcaaccaataacaatctttcatcattttatttgacctactttttagatttatataaagtctctataaatacattttaagatatgataagtggatgtttctttctttttatatgtgtgtggggggtggctgaatgtaatatgggcaacaaggacagtgacaggagtggcaacatgcagggacaaaccggcctctctctaccacgttcacagcgagaatgcaagtggatctgtggatgcatgcctcggtggcgtgcgtgtcaacagtggtcagtgtagtggatgacacattctttctccccttgcactgtcggagacgatatatatgattccatcagttaacttctctcaaatcaaaattttcgtttaaatattttaacttttattcaagttataacaaaagctgtacagttgtagattaaaaaaactataagtgatcatttccacatctattttatattctcactagctatttctccgaatccaaaactctccaaacaaatctagtttttctcaaacgtgtaattggaatgcacgtcaatatattaaaagaaaagaatatttgttacgcaatgcaatcagcccaaacaaaccttgtcgcacactatgctgctggatggatcacgcaaatgcaccttagtggtagtggagtagataagcagccaactatcaaaccgcaacgtgctcaatgctaacgacgtgctagcctatggcttattttaccttttagctctaataaaaataaaaaaatatatctaactgcttcagcagacacacctgcttgttgtcctgctgtggcttgcgttagatttgtaataatatagtttattatatggttgattgattaattaaattattagcagtcccttaaaaaataatgtagcagtacttgtgtagtacggactatgtatatattttgatgtcagtgtatgcatgtatgggagttgaaagaagcttagatttttaaaatgaagtcgtcatactgtgtaaatcatgttgtattaccgtaaccacttgccgttgcctcgggatataagtttactttagatccctcaatttatcattgaatctgaaatccgtcctgaaccgtactaccagatatgacgtgtccatcaactttcaaaaccaatacaaataagattccaaagcggtttcaacggtagtttcggctgacgtagtgctaaaccgggtccccttctccgccaaccttgtggctcctcggcatggagaaggatggcggtccatgggtggctgttggatgccgggaaggagaagaagcaagaaaggagaaaagagaaagaaaataaaaggaaggcgatacccactgcatttttttatttttaatcagacactcactgacatgtcgaccccatggtttttcttgactttaagtgccatgccaatgtcatgtaggcgccacatcagccgaaccaccatattgggatcttatttgtattggttttgaaagtctagggatgcgccatatgtattgcggttaggtataaattttagactcgacgacaaattaagggatccaatgtaaacttatttcttgtcttggtgaactactgggccaagatacccagtctgaccaaaaggcccatttacaggtcggcctgccttgtctcgctgcgttgcaattgaatacggcccaacatggaggccattactggcaggcctgctcgcggttcagcaaaacggcccattaaatactcggcccaattaatcttggtgagttcgaggctatcccattccggcccaaactgctggtgaattgctcctgggaatacggcccaaattgttcggccgcgcttagggccgtcggatcaagacggatggcctgcgatgctccacgtagtcgaccagccatcctccgccctcgtcgccgtttccgccaccgttcccggcgagctccgccgcctccttcgccgacgatctggtcttccatggccagcaagggaaattctgtagatctcaggatctctcaaccccccctcgaattcgtccaacccgagtggaaccgctcgctgagaggagagatcaagaggttggtggtggtgctctgctcggcggcgatggtatcctcctcctccccaacctgcttggtccacgccgcctccgatcgattccgcggag

SEQ ID NO: 68025 - DNA, 6005 bp, Oryza sativa
cgtcatcggttgggattgggatttggtagtgcgattgttggtgttcgtttatgttcagggtgtgccagtttcgtcagtccttcgatacatggaagttcatgtgtgccaatgaatgtactgttaacagttttgctgcaggtccaatacatgttctctaccacgatgccgcaattcgtgtggatggtgattaagggcaatgctgaattgctgatgcatttcttgtttgaatttcagaaggcgattggagccggtgatcatttgcttggggttttacgtgaataagatgggccaatgtgctttggataacgcccttcagactcagactcttcagtggtaaggacattggttcaaacctatctaatgttttgtaattgatagaactgtccggtttgacaatagatttcaagcattagctcaaatatttatatttctgtagatttctgtagattacattgatctagctggctaatgatttgctcttgcatttcttgtccttgtttgcaacttgcatcctgattattaatttgtccttggtgaagtcttaagtgatgatcgtactgttaaaagtcaaaaactatatgctcatggatcttcccgactgtgccaccactccacggtagtggcacaaaaacacgagttatcatcaatcaaaacacctagtgcaactgagttagtctgcaaagccatgcgcatacatgtgttcctttggtttgatgaagtaatggagtaatcgaagtgttgaatgtgatgaacatctctctgtttaggtctcttgtcagaatgaagatctgttttttccccagcaaaccaacacctaaatggtgctgtgtgccaactgccgtaaggctcatccagtgctcgtcttttttgttacacacactatttcatggtcaacaaaaaccacaacaacaaccagctctcttgcagacgttgttcccagagaagattattttggctcttcttctacataggagtagtacgttgcaggcttgcagctgatgtctcttcttctttgatggttacaggtcaaaagctatttgtcatttctctggcttattcacagaaagcattcttccaactactgctgcaatgctgctgctactccactacaaacaaaactagggaaaaaagaagcaaggatgcatcatcagattgtgtgccatgatccaagccgaagctccatcgatccctacacgaagcagcagcaacaaacttgtagcacaccactaaactaaactctgatgactgacaaagtgaaatcggcgcatcaaagaacgagacacacaggtaagcaccacataccccctttgaccgatcttgcctcagctacaaaagacatgctcgcttggatcaaatctacaaaaaaaaatgcaacttcaatctctcttggatcaaatcatcaaaagacatgctcgcttctttcaagaaagaaagggaaaggaatctggtgatggtctcctttccccttttttttcacccttttctagaataaagggaatgttggttttgaacaagatgatccctaggaaggacagtttaggaggtaaagaatatgctactcatagcaatgacattgagtaagatagaatgctcaatgtatagaaactgaaacacaacgcaaagttctataggttaggtgcagagtaagtaagccacagcatcatgccattaaaatgtgccaatacataaggttaccgctccatccaaacaatgagtagatgagtactagagtagtactattgtatagtaataccttcgtgttgtacaatattaatagtagttggtttgaacaaattagaagatgtcctgaaaattcaggattagtccccattgagtgctcaaagactttgtcatgactatataatctcgagtactcgtagaaaatagagtttgtagactaaagtaaagtggtttagtcatctaatttgggtccacaatataaacaataatattagttcactcacatattcaactccaggaatttttgaagcaagagatatatctagctaaaaaaaacttgaagttggagttgccagtccatagagagaacaaatttgtgaatcactgcctcttatatatagttaaggtctcctttggagcgtatgattttcgaaggaatttcataggaactgaactgttttctaccaagaacccataaaaatcctgctttttaaaggattcccaaacctgtttggaacatgagaactgaaccatttcaagcgaaacccgctccaaaaccggtatagcatacccattccttaggcccacgacactgacagccgcagcttatcaaccaaaccctctagtactactgtacctgttcttcactaacggtaatataagcattgcaatcaaacagcaacatctaagcagccgaagcagaggaagaagacagcagcaacagcagcagcagcagttcttcggttcttcctctgttcctctgcagctcactcggattctctctctctcctctgcaaagcctgcaacgcctgctgctgctgctgcagtttggtttctctctccatctgcatcctgcagcttctgtcctttctccccaacctcttttgtccgttgcatttcacctccattaatccaagcacagagagaggagatgcatccgtcacgctcactgcacgccaagccgccaagaagccacggtcaccacgcgcgctcgcgctcccagctgcccaccgccatttctgcgcccaaccaagatttccagttccagttccagcttctccccaaggtgttccagttccacatggacgtcggcggcggcggcggcggtggtggtgaagggaagtcgtcggagaagaaggttcttgctcagctggagcaggtgaggctcagcattgcgtcgagcgaggacgaggaggacggggacgcgccgcccaggagctccttctccggggcgagccacccgccggagccggtggatgagatggatacggtgttcgttgccgtggatggccgggacaaggcggccaagccggtgatcatgtgggacgcgtcgccgccgcagagcggcgcggcgagcccgcacagcagcatcgacagctccggcgcggcggccacggtgacgagcatcgcgcccagctgcaccgtcaccagcctcagcgccaagaccagcgtcagcagcagcgcggccagcgacggcagcgggtggagcaacagcacggccggcgccggcagcgccgccggcggaggcttcggcgggaagccgcacaaggggggcgacccgaggtggaaggcgatcctcgcggcgcgagcccgggacgggccgctcgccatgggcaacttccgcctcctccggcgcctcgggtgcggcgacatcgggacggtgtacctgtccgagctcagcaacgtcgccgtcggcggcggcggcggcgcggcgagggcgtggttcgccatgaaggtgatggacaaggcgtcgctggagagccggcggaagctgagccgggcgcagacggagcgggagatcctccagctgctcgaccaccccttcctgcccaccctgtacgcgcacttcgagaccgacaggttcgcctgcctcgtcatggagttctgccccggcggcgacctccatgctctccggcagcgccagcccggcaagcacttccccgagcacgcggcgaggtaattttcactccactttaattccatctcttgctctaggctcctaatcttgataggattagcattcagcaagaaaccatactctgtttaaagtgacaagatcaggtatggcagttcagagctgtcactggagaaatctttcagtattgcagaaattttcttctctaaaaaattaatcttgccaagcctgaagctggaactgatgcatgattgacacattaacaaaatggcttagttttttttttcagcatttcaattgacattagtgtattaatagtatagtgaatggattatgctccgacttctcgagtggggcattttgcctgtctgctgctttttctatgttgtggaacaggatatctaaaattaacaaatctagcagaccacaaagcatgtgtcagttgtcatgctaaaggttgatagtagcattttccccactaacccattttgtgttcgaattaggtatctcaaacatagacatcttttccgatctgtccctgaattaacaaacatgattatcctacttgtttttcccaatatttctgatgtatcatgtaatcttcttcatgacgtttgtttgatccgccatattcttctcttcatcagctcatcttaaactgaagcatacgatttattcttttcttttccggggctttgcaggttctacgccgcggaggtgctcctcgcgctggagtatctccacatgctcggagtggtgtaccgagacctcaagccggagaacgtcctggtgagggacgacggccacatcatgctctccgacttcgacctctcgctccgctgcgccgtctcgccgacgctggtgatgtcgtcatccctgggctccgatcccaagaggggcaacaatgcgcagtcgtgcgccgcccagccagccgcctgcatccagccgacgtgcttcatgcccaagctgttcggcaagaaacccaagagcagccagccgaggcagaggtatcatcatcagcagcagcagcagctggccgccgcggcgttgccggaggtggtggtggagccgacgggggcgcggtcgatgtcgttcgtggggacgcacgagtacctggcgccggagatcatcaagggggaagggcacggcagcgcggtggactggtggacgttcggggtgttcctgcacgagctcatgtacggcaggacgccgttcaaggggcagacgaaccgggccacgctgttcaacgtcgtcggccagcagctccggttcccggaccacccgccgacgagcaacgccggcagggacctcatcagggggctgctcgccaaggagccgcaggggcggctcggcgtgaagcgcggcgcggcggagatcaagcagcaccccttcttcgacggcgtcaactgggcgctcatccggtgcagcaccccgcccggcgtgcccagggctgtcgagcccgtcgccgtcgccgcggcggtgccggcgacggtgatgtccaagccgccgccggtggacaccgtcgagatggcaatccacagcaattgcaacagcaccaacagcagcaaaagaatggcagggcctccagaggtagagtctggaggcaagtacctagactttgagttcttctagcaaggtgaatgcaaagatctgccaaatattgcatcaggcagctgagaaaatatgaagtttttaaccatatacttgttttagtttgagttgtaactgtagtcactagtcagtgagtcccatactttcaacatttgggcaaaaggcattatctgaatctgaccaaccagttgtactactgtgttttcccctctgctgttgcaattctatcacagatgaactagttagcacttagcacctataaatactccaatagtaggcttaatggagtagcaaaaagtttccatgtacagcatgttagtgacatgcataatcacacattagttcttgccatgattatatacaaaaatgttactatcttttacaagagcaagcatagatgttcttttacaagagcaagcatagatgtgggaagcattgcgtatcaaaatgtgaatgcccagagacacataagggcaatagattgtgaagaacaagagaaggaattatggagacacttcacaagtcatcacagcattagtagtacatcattagttagtaagcattagtaactctagattagtgggttacaggacgaggttatgggaggcggcggcggcggcggcggcgaggccgacgccggcgggagggttgcggtggcgggagagggtgcgcagctgcgcgcgctggcactcgaggttggagacgagatccaccctctcctcccgcggcagccgcacgcgcaccgccctcgggaactccacgaaccccttgatccccctcgcgatgtgcgggttctcgc

SEQ ID NO: 68026 - DNA, 2690 bp, Oryza sativa
gctgttgtcgtcgtcggcgatggcggtggcggcggaggcggcggcgatctcccgcagcgcctcctccatggcggccttggcgtcggcgagcttcatctggacgcgctcctcccgccagagctcggcgacgcgcagcatccggcgctcgtcgtcgacctcctccagcgcgcgctccacctccgcgcgcatctcgcccacctccccgcgcatcctcctgcactccgcctccgccgccccgcgccgccgcctctcctcctccagctccacggcgagcacctcgctcaccgcctccgccttccgccgcatccgccgctccacctccagctccaccctcagctccctcacctccacctccaccgccgccgccgccccgccgccaccgcagcgataccactccaccatgtcatcctccacctccacctccatgccgatcataggatgccgagacgaagcgctcgaggaggcgtggcggcgcggcaacaagtagggagggcttgtgatcgacaaagctagtggtagtgcgccatgattggggcgcggagggggaagattcctggggcttgtctccgccaccgccaccaccaccaccaccaccactttgatttctcacctacgccatggagctttttggcgaggtcgggatggaatattttagtcggcatgagtggctccagcctccaccgcgtggccggcatggtcgccggctttgtgagctgtaaaagcgacgagctagctagccctaagccctagcccggcggcggccggacgaggagggagatggagatggtcaagtcgtcgatcacatgcgcggatcccgattccgatgccgccatgatggcgggctcatgctccatctctcctgtcctgctattgcaacgccgccatgaatgattcttgaaactttgccaaattgcaatgcattgaacgatcgttaattaggccgtgtttagttgttttggccaaaatttttttttactcacagggacacatatttaagagaaaatcccctatatatccatgaaagttcacctaatctcttctatacccctgaattttgcttaatcccttacatacccctgaattttagtttggatcccttccatatcctttccgctagttgaccgttaaattcttttgaaaaagtccattttgacctttgctataaagaaacataatgaattaatgaagtatattgttggaatgtaaaaatttattggataagactattatatttatgaatatgtgatgcactatattattggtaacaaatttacttttacatatgatataaaaagtaaaagttcttttatgtagcatatgtgttttcatagtaatacaacagatttgtttattactccagaacacatatgataaaaaaaatcttttaataactaataaattaatattaattttttatgtcatatctaaaagtatatttatcgcaaataatatggtgcataactatctcataaacataatagtctcatataacaaatttatatgctccaccaatatactatgttaatttatatgcttctttataccaaagggcaaaatggactttttcataagaatttaacggtcaactaacggaaagggcatggaagggatacaaactaaaattcaggggtatgtaaggaattgagcaaaattcacaggtacagaagggattaggtgaactttcaatgatacacaggggattttctccatatttaaaggattaaacttagactaataacaaaacatattccgcatgtaaactgcgagatgaatctattaatcctaattaatccgtcattatcaaatgtttattatatcatcacattgttaaataatggtgtaattagactcaaaagattcgtctcgtaatttatagtcggactgtgcaattggtttttttcgtccacatttgatgctccatatatgtgtctaaatatttaatgtgacggaaaagttagaaattcgaagaaaaaaagttggaatctaaacatgacctaattaattaattcggaattgattttctgctgcaattgtgcaggcaattactccatgaattgatttttgtgtgttgctgctcgatggatggatcgatctgttctttcgtgcgtggatcgatgtgatttgtcaggattgcgtggtacgcgaggtcgtagtaaatggctttcactgacgctttcgtaacgggcactggatgaatcgccatgaatcagcaacatccgtgatctgatgccaatcaatgctgctgcctgtacgagttgctggcttgctgcagtgcagtgaaatgcaaaacccggtggactttttgacaggccaaactgggccggaagaaaggcccattataatgagctacggatttgggccatttggtccggcccattaatactaggcctgtatagatacatacactgcccatcaatactttcgttggagcgtgttttattttgggccttttatatcatttttggttgtggttccaaaacttgaaattaaagagggcagcgaccgccgaaccaatgctttcatggcgccgccggtgccagcgaggcctccgccgcttccctcgtcggcgacgaccggcctcgtgcactcgttggtacgtcaccgcttgctctctcgatcatacttgcatactggtccatggcacgcatggcgcgtcgctttctatctctacctagagagggctgcaggaa

SEQ ID NO: 68027 - DNA, 778 bp, Oryza sativa
ttggcaggatgtcttatttatttaccagagtttggtaagaaactaaatggatgcgcatatttgacaactttaccaaaaaaaatagtatggtttaaaatggcatcaatctgaacaagcccttactctagcacttttcagtcttctatcactgttcactaactaggcaagtgagcagtgatataggacttttgaaccttgtaatttctatgtaggatttctcaaatcactacagccaatcaccatttgcatacgaagaatcagactcagtgttatgcttgaagagtcttcccctgaataaagttctttggtgttttttgtactagccaagcaccgaattatcacaagaagtgcagtttgtgacttctagaaaaattgaaaacacacaaaagaaactgtttaactaatgagtattcaatcgaatttatcagaaattatttaatggtatgccgaaaaggcaagatcgcactatccatttgcaaatgaacagtcaaacttgtcgaaaatgtgaatgatcttattcttggagcattgactttgtgttcatccaggcaaggaagcagtaggagtagtgtctgctgttggacctggggtaacaggtatcgaagttggcgatgtagtcggctatgctgatactccaatgggcacttacactgaagaacagattataccggcaacactggccattcctattccaccttcagtggaccacattactgcacatctgttttactcaagggaatgactacatatgtccttgtgaaacaagcctttaaggtga

SEQ ID NO: 68028 - DNA, 6475 bp, Oryza sativa
ttaaaaggtgggggccggtcctcacccatcagactagtcttttgggttgtgtaggcctaggacctaaaagttgtggctccggttggacctgtggtggagcaggcccaatgtgacctgggtggcctacggttggtgggccgggctgcgcactccaacaagtggtagactaacctttataacaagtggtgagaacaatttccatgggtcacatggtaacaaagtggtatcagagcccaaggtttggatcccggaacaatttccatgggtcacatggtggacaggccaggtaacaagtattcggggtcacatgggttgatgtgatgggggagattgttgggcctgaggccaggtaacaagtcttcggggtcacatgggttgatgtgacgggggagattgtgacttaaaaggtgggggcggtcctcacccatcagactagtcttttgggttgtgtaggcccaggacctaaaatttgtggctccggtgagcctgtggtggagcagacccaatatgacctgggtggcccatggttggtgggccgggctgcgcactctaacagatgttcttgtgtaaactttgtcaaaagaaaaaagagaacacttttgttcagtgatgctaaatgtgatctagagtaaaaaattcatggatcatccagcctcatcgtttggtcgatggctgaagcttcataagctgtagaaaaatgaacggagaaatgaaatataatttataaataaaaacttatatatttgtgttttagtgaattaaaagtcaatgctagaaaataaaatactgtgatagaacatcaaaatcaactttaaaattaagtttttaaaatctaaatgttagttgcgactaataagtacaggcaaacgagatggaggtgatcatcattctgataaacctcatgctggcatgtcatttcaagcggtgaacttgaaagatttaacagtttagccaaggctgatggtactgtcagtccgacaacaagagcaatatatagcttcgctgcctttgtttaaacatgatccacaatttgcgtctgcatctgcttcactgctcagtgaagtgattggacatgatctcaatttctcccaaacaaagacatggatttgcaaaccacaaacaggaagtttggcgaatagatcaaagtgagctatttgattcgagcaattcttctacaggctatcactgtcatcagggcaaaaactgtgaggatgaaggatacattacataccaaaaaataaataaatgtatccaaacttacaaaactgaatgattaaggcacacgttatacctttctactcaaataaaaaaaacaaaaaaaacgtgggctttcagcattatatactcatgcagtcatgcatgcactggggatggaagatctcaaggattcagcttctgttgtgtaacggctctcatattgctatctacagtcgacgagtcaagtaacggtggttagttttttcaggcagtttgctcgaaggatgtgtgcagttctcctacaattggcagacattgttcttcctcattgtttctatgcttcctgctatggttgatccagcagtccccacaaatcctagtgatgcacagctacagacagattcttcaacatataacaaaatttctggtagttgaactggatcacaatccttcctcgtgtttgctatgtttttgggaataaatccagatctcacaccatgttcagcagccataagccgctctgcggtctgtgccaccagttcatcactttccttcagggtgtgcaatttatatctcccatcttttgcaatatctgcaagataggtctttgaccagtttgctggtggaagatcagtcatcatgaacatgtgaataggaccactaccctgggttttcttcatttccaacgcaacagcctttaacttctccttgagtgcagaaaatgtagctttccagtgatttttgaattgcccatctaacagccttagctgtgcgcaaagaaatggctccttgatctttttcctagcgaactccttccctgtagcaatgatctcaggggcaaaagggaggaactcaaccttctcaagtatagtctgtagccgacgatcctttggcgattcgtggatatcaaaatatgactctgatcccttgtatggtcctgagaaaagtgtcccaaatgccaacaaggaagcatcctcagcttcagaaccaggccccaaagccttgtacatatctttgcgcctcctaacgtatgatatctttttcctctttttcaagtcttcatctggttgaaatgaatcaagcgccccatcattattctcttgatatgtccagactgttgttcggcaatcgtcctggacaggatacacacagccattttcgctgccccctaaaccggacagcatcgatcggcatctatcgtaatcacctggcagcgatccaccaccagagacagcacagcacaagccagagaagcaagtcttgcgcatgtctacgccgcaccacaatgagacaaacaccctgaaatcaatcgttctaaccgtagcctttatcggcgatagatcaattatgtcacccatggatacatacctgcaagttaaacagatgaaaatagcaataaatatttggctttgtgtcgaatttaccaaatgaacatggtaatctatggtggaaaccgtgaaatttggaaattgcattactgtaacattaacaagcaaagagagtaatctaggattaaccaaccccactttgggggagtgagatttttacctccgctcccggaggagctgcatggagtggtcccagacggcggcgcggaggtcggaagcgtcggcgaccctgaacttggggcagctcccgaggacgacggcgtggtggtcgagcaccgggggcacgacgagggtgcggttgagcagcgcggcggcgacggcggcatccggagctcgcccacctggttgctgaacccgctgtgcggcgcgtaccaaagaaacctctccccttccagctccggcgaccgcccacatcttctgccccctcctccgccaccgcctccgaagccggagaaggggaggatggagcggagcagcgaggagtaggccgaggagaggaggagggaggccgggatgaggagcacgaggacggccacgaggaggggcgcgtgcgaccgggcgctccgcttccgccgccgcccgcggctcgccggcaaatccatctcgccgccgccgccgccgacgccggcgaatcggatcggatcggtaagcaaagccgctcctccccatggccacctgccagatatcacgcacactcccacgtgggcccaatatgtcagcccgctagttcaggatgggccacattaagctggcacccacctgtctgtccagagtcaacagcatgggccatgttaacttgggctttatcacgtgcagcagcaacacaaaggacaaaaaaagaagaagcccataacctacggagccaccgacatgtggggcccacttaaaacaagatattatcgcgctctcatgtgggcctaacctgtcagtcagcatgggccaccccgcccatctagacttacgtactctaagttgggcttgttaggcatgtgcagcccagaacgtaccccggggggtgggtcgctgacaggtggggcccggagaactgccgaaggcgtcagggtccagaagctcgtgacgcgtgcggcggcttgcccatgtcggcatccgccaacccctcctcgccttcttcttctccagtaataaatccacgcaaaagcctcgccgcgcaccaccacccagctctctccactccactctcgcgttcttgtggagtcgtgctccactccgggaaggaaggagtgggtgggtaggtgagtggagttggtcgatggcgattggggcgttcgtggagagcggcggcggcggcggcgggggagggggaggagggtacggcgggcgggtgacggcgtacgtggtgctgacctgcgtcgtcgccggcagcggcgggatcctcttcggctacgacctcggcatctccggttcgtgccgccgccgccgcctcgcgcggttgattacttcctcgctgtagtaaatctatctcatctgttcatctcgtctactgcttgtgagttgtgactgtgtcgtgtgctggctcgtggttgggcctgtctgcatctgcatgggccggtgttaatggctggctcgggcccagtctacgtacaagaaaaggtttgcaagcttttttgtcatgaggaattaagaagctgcatttccagctcaaaagatctcatcttccagcagtaatgcagcttctcatcaatgttgccaacactttactctttgtattccttttttttttttgtgtgtgtgtgtgtgtgtgtgtgagatggaagacgaggcttcttgttttgtgtggagagtatagataaagataagtaatgtagtttggatgatcacgcaaacattgttcaagttctcctgcttaatctgtccactgatgttgtgacttaactaccactagtacggaggaaagatcatgctgaaagctcatgtactcgatcgtgtatgaattgtggcaggtggtgtgacctcaatggactcgtttctgaagagattcttcccggatgtgtaccagaagaagcaggacaccagagtgagccactactgcgcgttcgacagcgagctcctcaccgtgttcacctcgtcactctacatcgccggcctcgtcgcgaccctcttcgcgtcgtccgtcacaaggaggtatggccgccggacgtccatgctgatcggcggcaccgtcttcatcgccggctcggtgttcggcggcgccgccgtcaatgtgttcatgctgctcatcaaccggatcctactgggaataggtctcgggttcactaatcaggtataattctcagcacatttgatttcaggtcagtaatctctgaatgaatgtgaatctagttcaagagatagtgcagagatatctgtcacacatttttagagtgcctgttatattaaagaaaataaggaactctgttaaactattgcacaattcagataaaaaaaaaacttgtactccgtatgtggcatggtactccttatgttgttttagaagtcactagtacatcaagttcatgccatcatgcacatcgtgatgctatctagagttctagacaatgtatcaaaatcataaatcttgcatgctgaacctaacaccacacacttgaaaacgaaatgcaggccatgcgtgtcgtgtgcacaaaagtcaagtcttcattgacttgggtttagagggtatagacagcgggtttatgtggatgtactttgttccaagttgataacactcgacaagaagtggagcactgacaaactacatggttgtctttataatattaaggtcttgtttgtgtatagatcattgcattgacttgacaagtcatattttcgtttttgtggccataacgagtgagtgggtcattaaaaagttaagaagtttttacagcctgttgaatctctgttttggagagggacagtgttgaaatattgtgtggagatacaacgcagagggaaagcaacaaactatgtcgtggtctaaaaacttggcgatttactgcctagataggaattagaatggcttatgagaaaaacagtgactgttcactgatccaatctcacactgtgcaagacaagggagatccggagataaagcccaatcttgcaatcaagattttcagataacatagaaaagggattccactttgtaactaaacttcattatgcacataattttccttctgatgcatactcctaatcctagactctaatttttgcatttgttctttcttaacaatagtttcctccttcccaaaggacagtggtaactgtactgacgcctttgctatgaaactatattttgcagtcaatcccactgtacctgtcagaaatggcgcctccacgataccgtggggcgatcaataacggcttcgagctctgcatcagcctcggcattctcttcgcaaatgttcttaactattgcgttgtgaaaatcacagctggatggggctggaggatatccctatccatggctgcagttcctgctgcattcctaaccatcggtgcggtcttcctcccagagacaccgagcttcataatcgaacgcgatggcgacactgacaaggcaaggatcctactccagagacttcgtggcaccacttcagtccagaaagagcttgatgacttagttgctgctagcaacctctccaggacagttcagtatccgttcaggaatatattcaagaggaaatacaggccacagcttgtcatagcactcctggtccctttcttcaaccagcttactggaatcaatgtgatgaacttctatgcaccggttatgttcaggacgattggtctgaaggagagcgcgtctctcctatcctcagtggtcaatcgactctgcgcaactttcgccaatatcatggcgatgatcgttgtcgacaggtttgggcgtagaa

SEQ ID NO: 68029 - DNA, 1138 bp, Oryza sativa
ttcctgcaccccatctcttttctggaactagcaaaaatgtaaggagctccttgaccactaaaaatcatttcaaatatccaataataagttgcatatattagtgtctaacaattttttttcaagatggaagtcatataaatgggtccagttgatattgaaagcagtcctatttaattctgaatgcataatattttttttcacaataagagcattctgaatttaagagaaacacagccatgaaatcattctgcccacaagcacagaattttttttgtggcagcttacctgccgctgtgcagaagctaatagcacccttggcctgcgcaagcgaacatgttcataagcttcagccggagtcatttgtttgtattgcacctaagtacagagttatggtcagtatcaaatttcgattatataattaagtcgtatctgcatggccaaataacctaacataccaagtagcaaagaacaactgttgtgctccgtccacgtccagctttgcagtgaacatatgtcaacttcccacacaaagcatttccttccaagattaaaacaacataaataaatacacgagacaaacctagttaaaaatcacaattgcaacagcacaataggatctctacgaaattaatgaacttaaatttttgtctacctccccattagaggaagtgaatatcacaacatgcacgaaaagtaaaaatgtagaagagcaagcagagcaaaaaaggcagtaaataaaaggtcttaaattttttgtatccacaacgtagcagcatattcagtcaagtttcaagaggaaactgagtagcatactgcaaaaccaaatggcgacggccattatattggtagagttaagtacaatgcacaaattatttattacagggtgttgggaccaacaaacataaaaaacatctcttactacaaacaaaccaaaccaaacataaggtatcaaatcacaagttctgatatctactcatgcaatgaacagtacagtcaaaaacaaactagaatatacatagtgattccgtcgtattataggatatgcaatttgagtagattcttactgaggatgaagtcagcagcccggcaaaggttctcaaatgatggggcataaagataatctctagttggtaacacc

SEQ ID NO: 68030 - DNA, 1605 bp, Oryza sativa
aaaggaacagcaccgagcagaacatgctgatcgaagcaaaagaaaagtacacaattagagcagagtaaactataactctaaacagatcgagaaatcaatactgcagaaaaggtagtgccaatcacccacatacaggtccaaaacactaaacgaatcgaaattgaaacaaaaatccaaatacagcaagaactataaacgaagaaaatctcttctccactatgcatatgcagtaggaaagacctaaccctaaacgtttggagtgcaaactgccatgatggtcagcaaaccaccgtaagaagctacattacagggcaaaatccgtcggcggcacaagatgaacgcgaaagccacggcgatcaacaaccagaagaggggggaaaacctccaaaaacaaccgaaatcaaaagagggggtaggaaattttccccacctcgtcgacctgatcccaccagtggaagtgcggctcgaatcggttcctgacgacgttgtacaccagcgtcgggtagaacagcatccgcgcgccgacgcccaccgccgcgcgcttcgcgtcgaaagccacacgcatcaccaccccaccctcctcctccaccgccgccgcgccgccgccgccccacgacgcagctgcagcagcgccccgccgccaccaccaccaccaccatccccacctcctccgccggaatcacccggaagctcctcgatccgcatctcccccttccctccacctcctccaccccgcccaaatcgacccgatctggaccgatccgatcgggaaaaaaaacacacacaccagaaaaaaatcccccccaaaaaacaacgaatcaatcgatcagcgggtggaaaaagggaagctccgcagcgcgaattcgaaccactgggcggcgcaaggtggtggtggtggaacggaatcgaattgaattcgcgattccgcaaccgcgcggaagaaatcgagaaaccccctccccttccctcgcgctcacgcctccccaccctctcctctccaaaaagtcgaaactgcccaaaccgagcagcaacccccgcgcatccgattagtagtacacccggccgcgcgcgaccccttcgtctgacatgtggggcccacttccaccgacagatggggcagggtaacggggcgggggcgggggcgggggcgggggcgtgggtcccctagaggtgacatggcggccgttgatttgtggatgggcttggatccgagcactgactcgaggacgcggacgccacgtggatttgcagaggtggggttaaggagatcgtgtggggggttaaaccgctaatccggtaaagtggatagttccatgcttgtataggacgttaatcgcttaatccattgcttcatctcgcagtgccttctgtgtgtttatgtcattatctttcttttttgtttgtttgtttcgttttggaacaaatgcacgtatagctatagatttcttcacgaaaataaaagtagagatgtctaatgtaatggacatgagttatggtgtgatgtagtcactcaaagtataaggcgaattagttgttacgtgcctaaaaagaaacattcttcttaagaaatttttcttgtgccgtattgcttatggggtgttaaga

SEQ ID NO: 68031 - DNA, 1025 bp, Oryza sativa
ttatatctacaaccgtgtagataatgcatcacagacgctcggttaataatctatgtcaagttatgcctatttcaatctgtttcaaattgagcctatttcaatctattactaattggaaatccaaataactcgtgagtttcaaaagtagcatttgtaaagttgaaaacaattaacatgatgatgacctgttgatattcctcctaactttttgcctacctgttctttccagcgtaacacctcactccttcactcatgtctacacattcttggaagcacaacaacccatggacattgggcattcctttcgatgccttgatatggtgtattgtttgtttgttttcagagcaaaacttatccccaaatcaatttcagcatgatgccaggatgataactgacaaaacaaccgacaacgatgcgtcagcaacgcaccaagattagcctagcgtgcttccaacaaccaaccgatctaatctagttctcaacaagctgacatagtatacagtagagagaaaagtacagagaaatgcagtactgaatgcagcttggtcaccacaggaaagaaactctcaagttaattaattacaggcttaattacagctactggtgcaactgggtaaatttggaccactcatccaaccaaggattggaatcaaaccagcaagctaaagtctaaagggtagcctctgatcaggatcagattcttcaccagctaactgaagctgaatgctgaatgcttagattgcttgctgctgtaaagggaactgaactgaactgaatgaattacaggctgaaacctgaagttgtttcagttaagttcagaagaagatacagtagaagtaacagattactgctatgttttactagcagattagctcatggcaagatttttagataatggaacagatatccagtttgattgccagatgcaacagtcgatctccttgcccagaaattgagcatgaacatgcactcactctcattcatcatctacatgaatgtaatttgtttacaggtggttcttgata

SEQ ID NO: 68032 - DNA, 2411 bp, Oryza sativa
gctacttgccgtgcttgacaccacgcggccccgcggatttctttatcgactcgattctctgcagcctgatctgctccctgaacctggcgatgaactcctccgccttcttgtccacctcgttctcgtccacctccggcgacgactccctcctcggcgagttccccctcgtcgagagctcgccgtcgccgtcgacgtcgctgtcgtcgtcgtcgctgctctccgaggacaccgtcacgttgcccaggatggggtcgctgctgcctctctcgtactggaacctgggaatggattggacgccctgagccaccgtacggatcgtctgaatccgatccgtgaagaagagccggcgcgtcgccggcgacggcgacgtcgggttgttcttggctctggctctggagtgattctcttcctcctctgattgttctcaccgatttggcaactgggtagtacgacgaggaggaggaggagctatctatggagattcttggcttcgccgacgaggagttgctgctgctacggctgaattcggaggtagtgaagctgtgggaggtttgctcctgcagctcctccttgaagctcttcgccgccgtgcggcgttcggccgccggcggatggtagccgtggacgaggaacggaggtggcggcggaggcggcgccggtggggatgacttgtacgggctcctccgcctggaggagtagtcctcactggccttggctagtgtctccttggacagggacgacgccggggagagcctcttcggcgacggcgaaggggggctcggcgccgacgcgtcgaacctccccgaccgtgaccgccacgggatcggcgaagggagcacggtttcatggccgccgccgcctccgccgggcgtgtcctgtgagatcctgcgcggccgcgccgcccacggctcgccgccgtcgccgtagcccgggctggaggacgactcgccctgcggcttcagtgttcttacgggcagcgacagcggcggcgcctgctgcgccgcctccacggcgtggctccggccgcctcttgcgccgccggtcgccaccaccaccacaggctcgtcggggtggtgcatcgcgctccacgaccgcaccctgttgccacccgggctgtcgagcgccacgtcgccgccaccgtcgtcgaacaccagcgagtcgtggatcatctgcgacacgtacccggcggagtccgccttcgcctgcgccgcggcatccttctcgtcgccccgcctcccggcgttgttccggcggctgaacagcccgtacgacacggcgatcccgacgacgagcaggtggagcagctcccacaccttggcaagaaacgcctccccacggccgccgccgccgccaccatctccccccgccgccggcgcctgcggcgacggcacgagggggagcagcagtacgcacgccgcgaacaccgccgccctgaacgggaagctctgcagcagcgacgcctgcgccaccgccattggaggaagaagaagaagacgaagagggggaagcgggaggcagcgtgacgacgctgtttttaagctgcttttgctaagtttttctcttcttcttctctctctttgatagcttttcgcgcgcaaaataaaagttgtatcaaattctctcaccctttggcttgggctttatggccaaccatgcgttggagatgcatcgagattactagagatggtatctctctctcatctcatctattatctctttttattttgtgtttttcttcccctctactctcctaggcaagtgtgtgtagtttgagatggtgagggaggcttgaggaaaatggtataacttagctagtaagggaggaattttgtgtgagaaaaaggaatatatgcacttctctcttggtcttcttttgtttttcacgtttatcagtctcggcctctgtatcatgtgatgcaagtaacacaccgtttaatacgcgtgagtcaaaaacataaagaacatatgaaagaatatgcatttttttcgagaacggcgaaataagatgtttgtcctaacaatgatattttatttttacaatacatatgtattatgattggagattcctaacaaaattcctattatccaaatgcacatgcgctgcatatatgagagttgttctttttgaataaaagaaaaaaaaagagctctaaacacgcgagttggaacacgcaaaaatatgaaggaatatgcatttttgtgagaacgacaaaagaaacgaactgaaacaaaaaaaagatgttgtacaaactatggtcctttatttttgcagcacatgcattatgattatcagattttataacaaaatccacaatatccaaatgcacatgccctgcatatatatatgagacttgtttctttttttttataggaaaaaagtgagcaagtactcaaaatcataaaatatgtta

SEQ ID NO: 68033 - DNA, 2154 bp, Oryza sativa
gatttcttttatccaatttagtgcctttcattacaaattgataaaggacaaacatatacttttgacttttccaatacatttaagtcagtaggcatataagtctaaaactgcactccaagcatcaaatttggatggaagtacaagttaatgaggcaatgacaacgcagtctaccaatggcatgacctctagtaaggccgttacagtaggaactactgccacagtaaagatcaaacaatcacgtgctgctttgaagctttcacacattaacataggcatgccattaggaaggttcttgggttttgaaagctgacagcttggaagacttttcttggaccaacaccgcgaatataactacgcagtaaactagaaatcattctgaatcagaacagagctaacaacaccgtacgcaatcataggttccaatctccgatgatcgggtgtctaaacatgagaacactgagcctagttaccagccactcacaaaatccctaattcgacactgttatcctctcagaacacgtggccccatgcatccttgcagaggcaaaggatcaaattaaaaagttccacaggatcagccatcattactcgttggaacgatctggtctgattctaaattcttacttatcctagacaaatatggagctgagcatgagtttgacaaaacgtccttgtgatctcatcaaacagttggaggcatctatacgccgtccttgtaccgagagtaattaattgaagtggagtggcgtatgcatgagctaagtagtaccaaatcactcatccatgaccatcagtacaatctgcccattaaatgctttctctagcgtctgtcctacttggaagaaacaactagcagtgactgctagtagcagtactccatcaaatctcccaaatctacacgccgaagcagcaaaggaagaagaacatactagtaggaataataataaaaaaagaagcacaagaagaagaaaaacctgaggttggagaggatctagtaagtcgcatcaggccagaatggtttttgggatgattaaatcattgaaattaaggggttgggaaagaagaagaagggggggggctgacccttcttgcggtcgcgggtggcggaggaggagccctggacgaagtcgtcggaggcgtagccgtcggcggcggtgggggcggcgtcggggccgtcggcgggggaggcgccgccgctggtggatccggcggcggaggagaggagggagaggttccccatgctggcgctcttgcggatggagccatcggtgaggcgcaccccgaagatcttgaccccgcggttggggcacgtccgcgagttgtgcccgttgtggctgcagtgcgagcaccgcctcgtcatccccccctccgtccctccaccttccaaagcttcccttcccccacctatggagatcgatcgatcgatcgagtggagacggagatggtggtggtggagacgacgaggagagggaggggggagaagaggaaggggaggagaggggttaactgctgtgtggtgattggttaaggtggtcggagagaggcgagggccgtccacgtggcggatattcgggggaaggggatatacgtgagacgagggaggcaagtagcggcggcttgtgggtcacgccttctttctatccgtccacgcggttgggcttccttccttcggctgctctcctcagcctcagcctctgcttcgatcgtttcgtgtggtgactggtgaacgatccacagcaaacggcccccaacaaactctctctcgctgctagctcgtcaaactgtcgtggtctttctttcttttcttgttttttttcttttgagcgatgtcatggtctggtttaactcttctactcgtaactaaacagacgttaactaaagatgaaaaatgcacggattattctacgccaaaaagtttatggattctaaatgtgttgcttcttggtgtaccatgtaaccctaatgtgccacgggtgaacgtaaatcctgaatagttgaggattagaggtttgtctcactataactatcaataccaggttttggttgattttatcagctaaatgccagctagataaggaagataaatcacacgtatctgattcctaaagacggagagttagttttgtgaacagtagaactaattcctaaccaaa

SEQ ID NO: 68034 - DNA, 742 bp, Oryza sativa
tctctatgcatataagatttaaatgaaaggacaaatcaaatatttgagaccagaactcgatgagtcatcttgatatatatactctttaatttttgtcacgtataaaataagttaatttctttttaatcttgacgataaaagtaataggtctagtttttttttttaagaaagaagtatactagtatgatccatggaggcatcgaccaatcaatcaatcaatcaatgattcattatgttttggaagactaatactagaatagatagatagcttggcccatgagatcgatcgatcgatcgagttgacaagaatcaatcgattggaccgtgtacgtgatactagtaatgacaaattggagtaacttggacgcgagggcacttgtgctggatggttccatcgatccatccattgaccatccgtcgaccaattaagctgcctgcctgtatgcgttgcatgcatgccgtgttgccgtcatgctcatgcatgcatgtggacacactgcacgcgcaccacatatacagcatgtgctactctctttatctataaatataaacgttttaagttttaaaattttatgaatcataagcatttctatgatgttgtttgttaattttaatagtcacaagtgacagagatccataaagaaatagcagctgggctaggtgtaaacaaactagacaaaattataacccttttctatcttatatatggcaaagaaaaatagaggcttatgggctgcaggaa

SEQ ID NO: 68035 - DNA, 1102 bp, Oryza sativa
caaaaggctggctgcctttcctgctttcgtccattgctcttatcctcatttgtgaattttaggcagcctctccgccatatatacaccacggaacccaaattatcatggctttctcgctatacggtggtggaggtggcgaagttggctagagtaaggctctacaagatgaggttgtgggtgagtgaggggagaaacagggaggaggcggaggaagtctttgtgattacgaggtgattgatgctacgacagcggttgatctaaaggcaatacaacaagagaaaaggtaaaacaacgttgttggagaggatgttcagagagaagtagaagaaggtgttcgatagtaagagagggaggtgcccggggaagaacggacttgttgctgctggcggcggcgaggtaggggatcgatggtggtggcaacaaaaaacaattgaggtggactagtaattagggttgttacaagattaaatgtatctggatcatcggatctccatccaacggcctatttttttttctatcatttgggggcgaaggcaattattagatcttttaaagtttattttctttcaattctttatttggtaatgttgtagcaattcccaatatgggattattctcatcactgttttttccccttcccttgtcagaaacatgttcctcactctcaaatgcattggagacaactggtcaccaacaatccatccatgctggcctggttgactagttcagtacttctgtcaggagattcgccatcatcatttgagtgagttcacctttactctatctaatcaccacaatcaagttaatttcgaggcagagccagatcatatattatcgacaaaaggatcagttaactcccaggtgtaaatgtgtaatcaaagtgtctttctagctaggatcctttttcaaaggtttctcgtgctagctgctgataagtcataacttcagaactgaaactattatgaaccatggtcttgttaagtcatgtttggattgatataatctacctttacacatccccaaaggtggtagcagacagcattaacgaactgaatcacttggattgaaagccatggagcaagcacacatgatccatctcgtt

SEQ ID NO: 68036 - DNA, 4291 bp, Oryza sativa
tgccacgccagatatacaagtagatatagcttaatgatcaccacaataatcaacttaatgatatggagatagaatattcccaactcctagcatttttgacaaggatctgttagcttcctggtgtaatcaaattgtctctttagatagcgtgtgttaggggacgcacttacgggtggtgattgtagtgtgcgtgtgtgtctttcgtgtaatcgtaaaaaaaaagtctttctaagatctttttaaaggtttgttatgctagctgcccataacttttgaacttaaattcatataaccatgtccttattatgtcatgtttggattgatccacctagctttacacatccccaagggtagtagcaaacaacatttactaactggtgaatcacttggatcaaaagttttggagcagagctacacatgatcaacaatccgtaatcccgttgccacgccagatatatctcgagccaacgaagctcctctcacgtacaccatagggacatatatctctctgacgtgtgggtctattggggtgagcctcacgtgtcagagacgacttatgtccctctgactttacgttagaggagcctcttccatctcgagccagctcatattgattatccaagttcgtaagtttttctaaaactttttctacctaactcatgtatctccaaatcatgctgttgaaaagatagcttaagctaagctcgaacgatcacgcatgatgatcgatgttcagagctttgtgtgcagaggtggaagaactagcttttgtgtgctttggcggtttggccatgcatgcatgcatgcgtgcttcccacgtgagctcgccggagcgggagcacggctaggtgcagtgacgtgtgtccactccccgttgatttgatttgtctcgtagctgcagcaacaaccgccttggcctcatgcttccccggcgagccaccagctgccaatccggccagctatttaacagcgccatcgatcgatcgatcgccagctgcagcgagcgtttcgatcgagatcgagatcgaggtgggcggcggcaatggcgagcagcggggcggttgcgctgatgatgttccacacgatggagcgggagctgttctggcggctggtcggcgagcacgggcagcagccggggccgatgaggtgggtgatcgcgctgtggctgtggctcgagtccgtcggccaccacgacttcgtccgccgcgtcgccgtgctgccggcccccgtcgtgctgcgcttcgtagacgaggcgctggcgtgcctggcgcggctgccgcggcggcgaggggtcgcgggcggggcggagcggcggctcgcggcgctcgccgccgccggggacgccgacccggcgctccgcttcctcccctgcaccaacgcgctcctcgccgagcccgtcgagggcctcgcctacttcgacgcgcaccgcgacgaggtcatggagggcgtcagcgacgtgtacaggaacgtctgccgcgtcatcttcgacgacggcgtcgcagccgccgtcgccgccgccgacgacgacgacgacgccgaagccgccgcgttcctcccccgcgacgtgctcgagcgctcgacggcacaccaccaccaccgccgccgccgccgatgtaccaccagtaccaccaccacgccgtccacatggccccgatgctgccgccgccgccgccggtggccgagctgaacccgatggcctcgccatggttcccggtgcagcagcaggagcagccgccgccgccgccgccgcagccgcaccagcagcacggctacatcccattgccggaggactaccgctcgctgttcatcaccttctcccgcggctacccgatcagacaggacgacatcatcaacttcttcaactcgtaaaccaaaccaaacccagatcaaacaccttcttctcgatcgatctctcgccatgaatgatcataccaacaacaccttcttcttcaacataggttgtacgggccgtgcgtggagtcggtgatggtggagaaggcggcggcggggcagctgccggtgtacggacgggtggtgctccggtgcccgtcgatgatcccggtggtgctcgacggacagcagacggcgaagtacatgatcaaggggaggcacctctgggccaggatctacgtgccaagctccaagcccaactgaactgaactgaactgaactgaatactactactacatatgcatgaatgctatacacttacgctgatatagtatcatcaagctgcagccagagctatattatcatatataatcacatgaattaattaagtatgtgtttagctatactagctcagagagagacaagtgttgatccatgtatgatctgttgatgtttgtgtgttaggcatgcatgtccaagcatactaccctatctagagctttggacagagcttaattgcatgttttgctagcgtgtctctcacggaataaatgtgtgtctttcatcatcagtctatcgatgtttgtagcttgtgcatacgtttttggtaattttgcaatgaacagtggatgctatatacatgcatgttgttacctagttaattatgtgctgcactgctactttattgtttgttctggttggcaatcaggaaagtcaaattacagagttgagttagagtgaagaagccaaggcttatatcccaattaagtttgtttgtgcagtggagctaaagtcacgctaggattgaccttctgctactgtgttattctatgtggtgcctcttctgtaagtatttacgttttatttttgtttgaatttacatattaattaattgtcattctatgtatactggcttgattcttggacggagatttaatatacaaaatagtctgaaaattgactaaatttttagggttgacatctattcctctccaaagattctgataataatgtttggtttttgtttcacgaagagtagaataattgtgcattctgttcagaaaagaagggagcctcttccagccctatattcaggctaagatagagcatatgaaatattatctacttgctatctttgatttctggttagacagaagcatctttaaatcatcttctgtaggttgctgtagcattgccaaacaatttgcttctctaactagaaatccagacatacattaattaatatccttcacataaacgaaacagacaagtctaggattccattggaggactccatggatcctgataactccaatgctaacaaattgtctgaaggtaaggattttcttcaatattatttcaatctcgttagctctccgtgggaggtgttgggtgcaaatatggttaccactattttttttagggtgaatagctcaagtagtcctccaagtttcatctaagcctcagtttagtccttgatgtttcaatctatccatattagtccttcaagttttcattttagttcaaatttatccttgaaccaataactctcttgataaatgacacttataccctcatcattcacatatataagagaaaaattgtatgcttgatttttttaagataatgtatagtaaattatgtaaaacgaaaataaattatgtactagcaagctgtatacaatagtaattgcttaagtttcatgtgcacatgttgaaataattggaagtatatctgcaatgttgtttattcatcttgattttctcccttttagtatatagttgtatataaattaagggcaaaagggacattttctaatagaaatattgactaaaaatagccatatggcatattaagttggcccaaggatgatgtcaaaccaaaacaaatatttagaggagctatgtgaacaaaataaaacgtgaaggatcaaattgagccttcagtgaaacttgagggacttaattagctattcacctttttttttatatatccagtaagttttcaggtgccttctttcacaaggataggttctactagtttttaccaccaatatatcagcttcaacttcatatgttgaaccttttagattatattttgaataaggataggttttatcaattgtcatactaaatgactaatccaaatcatgtaaaatgtggatattagttatatttttagggtcaatctaaaaatatgacgacataggtaaaaatatgtcaaatgcaattatattacaaatctaatgtaattatatatgtaatttagggacttacatatgtaatttagggacttacaatgtaaatacatgctaactattttttcatgaaaaacatgatggcacatttatagcaaatccgtatttttattgcaggacacttcggtcgagctggaaatgtat

SEQ ID NO: 68037 - DNA, 5589 bp, Oryza sativa
atcagcctctcctaccacctccgtcttcctcttccccccggccacagcattgggtctggccggcgacgaccacgcgtccgtgacggcggaggagcaggaggacgtggaggcagccgaggaggacgaagacgaggaggtttcttggagctccttcgccatggccatggcgagctaccaagcttagcagctgcagagtgtgagcacgaggtcgaacaggttgcgtgcgggcggagtggcgcctgcgtctgaatgcgtagtgaggagagaggggggtttttattgcgagttccaaatgcaaacgagagttttaacttggagattataaacaactgatgatggggcctcaaacccgtcctatatatgcttcgtgtccccccgttgttgtccccacggtgtcgccgtgtttatttcaggctcgctcgttcatcatatgatttttttaaaaaaaaattccttagttgctggtataagttagaaaaaaaaactgtgtgagataaaaagcagttttatttgttgtatgtatgatgagctttagttggtccagttttagtagttgaggctaggacatcaaattggtactagtttctccaaaatttgtttatttgtcctatgaaacggggtggacgaaactttcttaaatcatgcaacctccatcgtgtagctattggtttccgtgaccaacgtttgatcgtccatcttattttaaaaaaatgattaatatttttattgttattagataataaagcatgaatagtactttatgtgtgactattttttaaaaaaaatttcatatttttttcaaatatgacgaacagtcaaacgttggtcacggaaacctataactgcaattatattggacggaggtagtacgtggtaggttaattagtaacatcgtgtgatctacatcatcttaatctatagcgagtttcttgtttaaggccttgtttagttgcgaaaattttttgggtttggttatcacatcagatataagaacatacatttgaagtattaaacatagtctaataataaaataattacagattccgccagaaaactgcgtggcgaatttattaagtctaattaatccatcattagcaaatatttactgtagcaccacattgtcaaatcatggcgcaattatgcttaaaagatttgtctcgcaatttacacgcaatctgtataattggttttttttcctgtatttaatactgtatgtatgtgtccgaacattcgatgtgagcgtgaaaattttgttttggaaactaaacagggtctaattctcggtatgtaataagttcttatgaaccagaacacaccacatgttgtaattaaggagaaaattccgaggggttttttaggaaaggggaaaaaacgcgtgtaacacctgtgttccactttgatctacaagtaacatgggacatatatcagcatccacatccatttcacctcatatcaatgtagaaggtgatgggacgggcccatgcaaaaggaggaagaggaggactgttcagtcactgacagcttggccctcaagggatgactaatattcatggaaggcagccaaggacaccatgaggggctcctcaatgtattgttcctttcaagtgctcaagaaaccctggtgtcttgctggtgacacacccccaattaaaggcatgtcacaccagcccacaacccccccccccccccttcatgtgtgctgcatcaccccccattttacaactcatctggcttttccatgctgctgcccacattagctcctgttggcttggctctttatcttatctcatcctgcaagggatcacacaaccaaagagattctccatatcaacagctgttggtgtgatacgagccactgacatgtgagaccggacctatctgtcagtgatcactactgcagaggatgtgaaaaatgcaatgcgaacagctgaccattgcaggttctggaacaggttaggatgtgaaaatggcagcccatgcaagtggaaatcaaggcaaggggcatatcagcatatggcagtggtattggccagtgggcagtagtagtatggcattgggattggagcacatggatttggccaggggatgtgtggctgcacccaaggtctggcttttggaaggccctgctgtctcttggaagcaaaaaaaatttgtgcttgccttgcatgcagccatgctgggcttgctcccttggatgtatgtggcaagtgaaccccatctacgcataattgcattggattttcccttcattggattccagatgcatgttgttattgtttttgttggtattctcttttgtgagcaaccattcactgtttcgcttttagttccttttctccttctagagtgtacttaccactactagtttattactccctccaaagtttgtcgttaggataaaaaaattgtaggtaaaatgtatggttaatttggttgtccaaaatgtatagcatgtataatgactagagatgacaactactccgtccgtcctaaaatatataagaatttttagacggaaggactatatcctaaattcgtagtattaaaatatattttatccgtaaaaaaattattatattttagaatggatggagtaattactgccacactaactacgagctccatcgcttcacctgccactgattataaactgtaacacttaatactgactaaaaaataaaaaataatatgtgaatagatcttttatatatattcttagcgacttagaaacaatgaaaaaaaactacgataaaaaatatcaaaaataactttaaaattaagttttagaatttaaattttagtcacgactagtaagctgaagagcaaatgaaaaagctaacggtgtttccatgtcagagttgtgcgtacatccaaaagagttcaaattctgatatccacgaatcagcgttcccgccctcacgcgccggcccacacgaacttgtgtaggtagaaagcatgtgtcttcgtatcgtaagagtggatacctatacgtacactcaacccgtcaacggccttcgttttccacgggggagatcgatcaatgcatgcatattgtcgatcgatcgatcgaagcgccgccgcgcggcgcgcgtcgtcccattgcctggccctgatgcggtgaacgcgcacgcgctccggacatcggcccgcgacgcgccctccgtgttctgatgcgtcctccaccgcgcatgtgcctgccgccatgtgcgcgcgcatgcttcgtgtccgctgcacagagcgtggccgcgtcgcggcgacgatggtttgcacggtccaatgcccgggcgacagccatggcgcgagcgcgacccccggcttgctgggagggcggcaataatccatttcaactattggatccaagcgttcggttccagctgccgggacacgtagtgcactctcctcgttatctcctggtgtgtcttcttcccctcctcatcactgtggccatactacatgctactactcaattgtgtatgtagccaatcggttggagtacagactacgacagagaacggtgctctgcttcccattattttctttcaagagctaggacagtacaaaggagtacagtaggagtatgcaccccccatactactctacattcgaattcgagatggcgaccacaaccttgttttggttgcaaaaatcattcggggatgcatgcttatattagtgttgccacgtttttctccactgaaatgaaaggctcaatagatccgtgcttcaacggataaaaaatcgatcttcatatctacaagtagatatacacgatcaaaatatatacttcatttgttttcaaatagctaacactgggcacaaattttaaaactgacaactcagtctttttgttacaaaaggaattacaaatacttaaaggaataacagatcatagtatattgtatgtcttaaatataagcattatggagttagtactatcactgtgacttcagagttttttttttttttatagaactgacttcagagttgacatgagaaaaacctgacatcgtccggcgacgatggcatcaggcaatatcggcacacggcaggtttgattcgctcatcagatttcggtgcgtaccaatctgtaccatgcatacgcgttagctaggtttgcggcgtttttactcatcatcgcggtagctagctgcatatgatgcatctttggccatatctgaggtgaacagtggggatgaagctgtaccaaagcaccatgatctggctgcataaaacacatttgaatctctacactgtagtcttccgtgaggcaattaattaggtgctggagaataacgcataattaatcaaggaatgaaaaatggtgagaaaaatggcacatgtattgctggtacatcgttggcacttggcagttaggcttaagactgagttcttttcatcaacttcaaacgataacttctttgtttttcgttagcatgttttcgaacctattaaacgcataattaataaaggactgaaaaatggtgagaaacaatgttattgttactggtactagtacatcgtttgcagtggcctgtcgagtcaatttcttttgaggcaaccaagacgaaagcatcagctaaccgagtgaaaaataggcccaagacgagcacgctgaggcctatctcaaagttggtccggccgagcaagcccactgcaactctagaaatacgggccacataactaacttgcaaattttgggctgaatactgggcttccaagaggcggaatcctatttgggccggatatctgcgaacgctaaatgggccgccaaaagagccctctactattcaatgggcgggcccacgaagaaaaggttgggcccactacggaacggaagcctagggccagccggcagccgtcggatcaagatggacggcttctgtgcctcgaccagccctctcgccctcgtcgccggctgcctccgccgccgcacgccgccgccgccacctcatcgctggcccgcgccgcgccgccgcctgatgggattccgcgcgtctatatcccacgtccctcttgctgcttctcttccactcgcctccgtcgcggtgagcgagcgagcgcgagcggcgatggaggagacgaggaggaggggtggtcgaatgtgagaggcgaatccacgtcttgccgctgagaaggcggcgggagggagcaacgtcgtgagacccaccacgcggtcgctgacgggtgggcccaaccacccggccgccgccactcccgcgcccttatcatctatctgcctcgtcttctccgccccctcaagctgttcgacggaatggcgcagtgggacgcgctcgtggacgccgcgctggcgaggctggcgtccaggagcctcctgcgcgccacgcgccccatcgccctcgcgccgccgcccgcgccgccggagaccttcccctgcccaggcccgtgggaccgcgcagccgtcgagatccggctcgaccgcgcaacgctccaccaatggctggctgaaggtccaacctttttttatcatctgctttgcttccatgcatatcaaattttcatttttttattattatttcttccatgtaataactgcctttgagataagcctaaacaacatgttctagtttc

SEQ ID NO: 68038 - DNA, 2323 bp, Oryza sativa
tatctactaggcagctgaagagtacggcatgggccctagaggatctgcgttgatttgtggatatactacctatcacaaaatggtggaggaatcgttggcagagctgaagaaaaaggaggtactgttgcgttcaaaatttaagcaaccacatgtgcccggtatacaaaataaaataaaaaacttgcagccttactagagtccttctacaggattgccttctttgtcccactggattttctgccaatatggctgtaatgacggctctgggaaacatcagctctctgttggctgctgggagaaaacctgcggaggacgaaagaatagcaattttctcagatgctctgaaccatgcttcgatcattgatgggattcgccttgttgagcgacagcaagaagtggtatcatttgtgtacaagcactgtgacatgtcccatcttgaacttttgctgtatgtttttcactttccagtcataactcataacatacaaaatgctaagcactaatttacttagttataaaccatgtttgtgattacacatgcagatccagttgctcaatggaaaagaaagttgttgtcacagataggcaagttatacatccaagtaaatttcatcatttaagaagcatttattctctgtattagtgagtagtgtaccgaactcagaagctcttttgattggtaaaatgcagcctgttcagcatggatggtgattttgctccattgcctgagcttgtcaagttgcgcagaaagtatgggtttttgttggtgatcgacgatgttagtatattatcttccctgaaatacagtatttttctggcctaatattaatcaagttatgttgcaaatttccttttcaaggcacatggaacacttgtttgtggtgagaatggtggtggtgcacctgagctgtttgaatgtgagaatgagattgacataagtgttggcaccttaagcaaggctgctggctgccagggtggttttatagcatgcaggtattctattctaaggcatgtccatattatctggcaaggaagaactgctcatagtgcatattaaactgtggaaatgaatcatagatgccttgaaataaaggacttcataaaatacctgagacaaaacctacttgataatatgtaaacagtagcggcatgctcatcacggccaacaggaaatgttagaacaaatgcttggatgacttcaaacattttccatatctgttgctgtcctgagtaacttatgggcatcggcgattatagtttaggaattacgctaagtgcttaacttttgatgttaatagatgctctggacaccacataatattatttatcagggtcttggttatgaaatttgcacttcagagcctcatgcttataaactcaataaatagaagttctcttgaattagcctctcttgataatacttcatgccataatctctgcattttggatgcatgccataatctgtctttacaatttccaatcttatgacgaataataatttgaaatttgtttgcagtacccgatggaagaggctgattcaatcgcgaggtcgttccttcatattttcaactgctttaccagtgccagtagttgcttctgtgtatggtaatacttacacattgtgttctaataatttaaaatattgatatgggaatctggtattgattgctacatatacctgtttgtgttacactgttttcacgaggaagggcatagaaaaccttctctatcacattaatccatagaaggacgaatttaaataaaacattaactaacgtaaaaattatctcattgtcaaagtaaatatcaggaattcttctaaacagaatcaattaatttcagctgccctctatgtatcaagggaggagagatggcggagatcagtgatctggaggcatgtgcagtattttgcctctttgacaaaactcaacataacaagtcccataatttccattgtagttggaagtgaaaaagcagccttagagctggaggttctcacttcctcccatttttgtttcttgataatatcagtagttgtgtgttctaatcttttcattttgaaactgcagggatatgctaagatctggatttcatgtcacgccaatccgaccacccacagtaccgcccaactcatgcaggttgaaaattttctgttcctagcattttccatcctaatctctattcatagacttcagcaacctaaagcatcagtgttcctagggaccatagactgtaattggattaggaaccagggtatatatgcatttttattaatgtgttttcttggtctttgctactgctctccaaagatggaatccctgct

SEQ ID NO: 68039 - DNA, 5090 bp, Oryza sativa
caaaactacacttattttgggatggagggagtaccattttaagctgtctagttgcttcgtccgtccttaaagagatataggtcctgcttggggagctaagggtgtggttggttgcctggctcgtccctggctcgcatctcggatgcaacttgtagactgtttggttgactgcacgtgtcccacagccaggccgaatagatgcaaaaagtctctcgcagccaggctgagcaggaacgaccgaatcgagcttcgctgctcatcctggctccacgcatgcagcggcgccgcacccgcgcatgcaagcgctgcacccgcgcgtgcagggagagccggagaaacgatggggtccccgacaccaccctaccttcttcctcatttcttctatcttctcttctcttcgctatcgccggtcatggccactagcggcgaccatctccatcttcgccggccagatcaggctagctgcaagtcctgctcctccctctcttcttcagcaagggctcaccaagagctctccgccggcggatccggagggcatgagctcgccactgccagatctacctgcacggagatgtcgaagtatgagcttggcttaagctcgtcgtcgtcgccagcggcaccactttcctcgccggcttgagctcgtcgctgcgcggacaccctcgccgccacggacagctacctcaaatccatctcctactcacctttttttttcgccagattcagaggttagaagctcgggcctgccagatccgagtaaccacaacaccctcccggccgctggacccgctgcaccgacggcggcgaacatgcctagctgggtggcacgagcggctaggtaccggtggcggcaagttcctctgcgagctctgttctcctttttttttctttcttttttccaccgaatgtcattaaccactgataaatatggtttatgtactgctgtgcaactgtatatgctcatccgatactgttttcaattattgttgtcaggagctccgaaatcaatgctttgtatattttgcatgtactattaaatctgatatatataccataaataaatacgctttttatttcgtagatggtaagaattttcaatattaattctaagtgaggtaatctctccttcaaagaaagaaaatacttatacctactatccatacaaccaaccaaacaaagtctctttcaagccgtatctttggtgcaagcagccaagcagaatctcacgctaacctggctaaaccaatacaaccaaccaaacggttgcatatgtatctacctagccaggccaaactcagccttgatggaagagatgggccaagctaaaacaatgcaagcaaccaaacacaccctgattctgagaagccaacttctgagaatctgaaaaagatatgttttccagtttttgacttctagtttacaactacagctttagaatctagaaaaaacttagactgtttggggagcttctgatttctaagagaagctgcaacagttagaaactcccctaaactggtccatagttttcagtggtcaaaagtgagattatacatgaggttaaacaaataatatactattcattaatacttggagagaacaaggagaggagaaaactaggggaatgagagagtattattagttcgatggttaaaaaaataaataaaaagatgaaatagtaaatagtattaaggaagaaaaatattttttgtgagctaaaattttaaactataattagattttcttttggacaaggagattagagattaatgtttgggaaagactctgctggtatctctcatttacggaggaattgagggtgattggataagataaaaagaaagataatcaaatagacaaataatactactctctatttaagatataatagtacatagaaaaatagggttaggggagtataaaaaaatcttaacatttgtgaataaacataacacacactaggaaaaatgttttactatattagtagacaaagtggataagcctcaggagatatacttgatagtccagtgataaaaagactgtggtttcaaccttaagaatcctcaacacgattataatttctttttaaaaaatatttgaaggggcgtttctctctatatattttttttattttttagcgtaaagccgtaaaacctcaggctgcgagctatgggcaggctcaactgaaggcatggccaggaaccagggtcaaaggagcaacaagtcatgtccggtgggccccacccggccccaaccccgggggacaagtcaatgagtgcccccgctccctccgaacaggaaaagctgctcatcatttgcgctgcgacgctgacgcgtgcgcccattccacgcaaaagaatactcgcagcccatgcatgcacaatactactactactagtattttctttgacttttcctgcaccccacaaaatatcgcttttgatctaatctcctccttaattaccccctctaatcaagctcccctgtctcccccacgctttaaaagcttcctcctcctcctcgccaaccaccaccctcagtccctcacctccatttccatcaagcccaagaacgaactcaccacgctagtgttgagaagtggagagagttgagaggaatcaatggagatgatggttcatgggaggagagacgagcagtatggcgggctcaggctcgggcttgggcttgggctcagcctcggcgtcgccggtggtgcagccgacgacgagcagccgccgccgcgccgtggtgccgccccgccgccgcagcagcagctgtgcggctggaacggcggcggtctcttctcctcgtcttcctccggtgagtatagatggacggacttacgtcgaagtcgtgcgtgcatgcatggatgcatggatcgatcttacgaaggttagtttgcgtgcagatcatcgggggaggtcggcgatgatggcgtgccacgacgtcatcgagatgccgttcctgcgggggatcgacgtgaaccgtgcgccggcggcagagacgaccacgacgacggcgagggggcccagctgcagcgaggaagacgaggagcccggcgcgtcctcccccaacagcacgctctccagcctcagcggcaagcgcggcgcaccatctgccgccaccgccgccgccgccgccgccaggacgacgaggactccggcggcggatcccgcaagaagctccgcctctccaaggaccaagccgccgtcctcgaggacaccttcaaagagcacaacaccctcaatcccgtaagcaaaacaatcaatcaatcaaactaattaccaatccaccatgaaatcgatcaagaacaatccgattgacttgttcttgctggattgatcagaagcagaaggcggcgctggcgaggcagctgaatctgaagccgcggcaggtggaggtgtggttccagaacaggagggcgaggacgaagctgaagcagacggaggtggactgcgagctgctcaagcgctgctgcgagacgctcacgacgagaaccgccgcctccaccgcgagctccaggagctccgcgccctcaagctcgccaccgccgccgccgcgccgcaccacctctacggcgcccgcgtcccgccgcccaccaccctcaccatgtgcccctcctgcgagcgcgtcgcctccgcagccaccaccacccgcaacaactccggcgccgcccccgcgcggccggtgcccacccgcccgtggccgccggcggcggcgcagaggtcgtcggcgtagagaccccactactgattaattagttaattagagatgagtagtggctttttcttaattagcagggtattaattaattacttaattagggttggacccctgtagttttcttgtttatactacgtgtataatttagctctggttttgaactttttaattagtttcataatctttttttttcctatctctcacttcaccctgtttgttgtttactcagcaaagaatatggtgtctttgtataaagtgatgcatgaaatggatcataaaagttttcaatattaattccttcatatctgtagtgttcttggactactaattactgccaaaagaatgatatgattactactgtattgatgcttactatccctcttgtggcacttgagatctcaggataacgatggctgattttccttgctttgttttgttaatctcctcatatgtataagaccagagtaattaattaattaattaacaggggtcgaactgtcaacggtgcaattattaacatctccgagtgcaggcatcagtgaggatgaattccaaagaggaaatcttctccttttctttccattccctgtgatcttatctttgaagcattctaagcttcctgacaggaacatctagctaagctatagctaacttcagagatgcaaaacttgcaagaaacaaaaggggaccagatcaagaaactgaagctgaatctgaagcaacaataacaacagtctctgcaaatcaattaatcagtctctgaacatgtgtgtcgctgttaaacaggcagtcaattaatcagtcagaaggtttagtggtagctgccgtctgaaccgggcaagaaaagatgagcagaatttgacctcttccaacacacaatctgcagcaacttttggctcatatgttctctggccatcttggcgaagctactactagtagtacggtgattgcaggggaaatatctcatcaaatctggatgaaagctactgaagatgagatcattggaacaagacgaagtttcctggaccttactgaacttgcgccagacagatcataccaatccagtatcactggaataaggccctatatattctaaacatgtttttgcacggattattgagacggattttgtttactttgatgataaatcaatattttgagaaataaacttcagtgatttataaatagcttaaaacaagtgatctaaataatgcagtagaagatcttttttatgagaaattgtatagacaaaagataagctgaaaatagcatgccctaatacttgggattaacatagaaaagcaagcaatggcttaattagtagtactcgtagattatgtgtgagttgtcgctactattagttaagtaat

SEQ ID NO: 68040 - DNA, 939 bp, Oryza sativa
catgtgccgccgccgctccttgcaccgccgcaccgtgtcctcctgctccaccttcgacgccgtgcaccccatcgccccccacccgcgacgcgagcgcgcgcgcgcgcttcccctcctctccgattcgatctaacgccctctccgattcgccgtcgtctccctcctcgctgcggcgagagagagagagaggagttggctgctctactcgagtgggaggagtgagctgcagctgctgcttcgctttgctttgctctctattctcgcttcagttgtgtgtggtttttggttttattttttttttctcgccctttcgctttcgtgtttcctggcccggtagccgtgtggggggtgggggccatggcgagtaattttgatttttttttttgaaggttgtgactacacagtttgaggtaaactggtttttgaagcctttttgtttttttgggaggttcttgaagcttttttttagctaaaaaaggtttttgaagcctttttagctgcttcgctcaccatgaaacaccacaaatgtgcgatcataactgttttttttctctatcaaacttatgacacaacatgttttccctttttgcttttaaaaggatatcttatataatagacatatcacagggaaggttttattggtgcttttcagcttgtcaaacattgcgttgtaagaggctttctgtttaacccgttatgtatgttaggcattgttttttccaacttatttactggaatattaaaactgattattttgcttcgtgattaaaaggaacatgttttcttaagaaaaagcattttctactgtttagataacttgttttggttatttgttaagtattatctaaaaaaagttatttgttaagtttatttcataaaatatgcatttacatttataatcaagtggatgtttgcaataataatctggggctgcaggaa

SEQ ID NO: 68041 - DNA, 6503 bp, Oryza sativa
ttcctgcagcccgttatgcttaaaatactgtagataataaagtaagtcacaaataaaataaataataatttcaaaaaaaaattgaataagacgagtggtgaaacgttgcaagcaaaaactcaaatcccttatattatgggacgggggagtacttaaatatgtgcatcaagattgtatcaataaagacctaaacaagaagtaaaaaagggtggggatgaaaaacgtagtactaaaaaacaagtcaatttaccggcaaattaagagaaattagaaatttggttgtaattggaacgatatgatggaaaagttgaaagtttatgtgtataggaaagttttgatgtgatggaaaaagttgaaagtttatgtgtgtaggaaagttttgatgtaatggaaaagttggaagtttgaagaaatattctggaactaaacacggcgaaaagtaggccatatcattttgctgttataaaattaaattgcattcttctactggttacacatacctgatacgcgtactgcctatagacgtgtagtagcacgtgcactgcatgctttctggacacggccaacttaactgtcgtgtcgtcaataggaacagacgaacgatgcggtttcattttcattagccgatcgatcgatatctcctgcctccgctacttgccaagttgcactaacatgcgttctcatttttattttgggtactgctaccttcgttccatattttttttaagtcgaatttatttagctttatcaatttttttaaaaaaacataacaaaattttcaacataaatcaaaataattataataatatattcaatgttatatttaataaaactaattcggtgctacgaatatatattactatatttttttcataaatttagtcgagcttttttaaaaatttaagtttagaaaagtcaatccagtgggagtaacttctaatacacggagggagtacaaatcattctaggaccatgatacagcccgcacatatgcatcttggtcggcaacgtgtgacaagaggtactatgccatgcatgtatcaacattgattcatatacaagtgattacccaattaaaatctaaattcatgtctaaatatttgtgtataagggttaggctcagcttgaaacgtattatagagctttttagaaattatttacttgattatgaggatatcaaatgctttaataaacaaatttaacaaatagttttaaacaaatgatataaggaatgaagcataagattttttttttagaaaatgcatttttccaagcgtgaaataaacaatccatttcaacattttgataaacaaaatctgaatagaaacacgcggatgttgagttgtacttactttataattttaattttaataaaaatggattacagcttggatcaagttttgttatcagagcttttttttgaattatctttttaccttggaccaattaactttatatttatttttcaatttaagatcattatctatcagaatttaaatcgtagtgacaaggtttcaatataatttgagtaaatttcataaaactacaggtattttgaccaaattttcacaaaactacagatttaaggagttgtatcacaaaactacatatttagcactaaatttatcacaaaactacagattttagattaagtatcataaaaatgcatatttaatattgagcttatcacaaaaataccacttttggagtttaaatccctagcaccattgttatggtggagctataaacatcattactttgtgattaaattgattctaaacatgtagttttgtgataatttagttactaatatgtagttttgtggcacttcatcttaaatgtgtagttttgtgataaatttggtgttaaatgtgtagttttgtgatacaccgagttaaatctgtagttttatgataatttggtcatagtatctgtagttttgtgaaatttactcatataattttaatgggacacgctgatcccgttcgtcaccataagcttgtctcatagacgtatccacgcgtatacgggtgttcgcggatcatctccatctcatatactccatctgtcaaaaaaaaaaaaaaagccaacctagtagattcaaacaccactatagactaggatgtgccatatcttagtgctaagttggctttttttttcaaccgagggagtgcatgtcttacaagacaaatttgtgcatatgtgagcgtggtgtgatgtgtcgtgggtttaagggacaaataagaaaagaagatgcttttcataatgttctaaaaaaagagatggttttcagaagcatcgcacgcaaggggcaatgtggctattagaacagtcactctccacccttagctacagctactacaagttgagacgacgttgatgttgatctcgtcgtcacaagtgagaccgggactagtactcggaccagagaagacaaacactacgacatgatagatgcggcctcctcctcccttcgtgcgcctcgaaccctccgcgaagccgccaacccccacccctctccccctttaaatcgctcgctcgcgcgccacactcctcgaaccaccaccaccaccaccacgtgttcgatcgcgtcctccaagccccagcacctacgcgtcgtcgcgccatggccggcttcggcttggaccagcacctcgacctcatccgcgcccacctcctcgaagacgcccaccaccacgtcctcgcgccatcgccgtcgccctcgccaccgggtactgggcgtgtcaggccggcgcccgtgtcgctgcccccgaggccgccgctcctgtgggcggcggcgtcggcggcgccgcggcagcaggaggagtgcttcgagctcggcggcggctacgcgggggagggggagggggaggaggaggacgacttccggcggtaccgcggggtgcggcagcggccgtggggcaagtacgcggcggagatccgggacccggcgaggaagggcgcgagggtgtggctcggcacctacgacaccgccgtcgaggccgcgcgcgcctacgaccgcgccgcgttccagctccgcgggtccaaggccatcctcaacttccccaacgaggtcgccgccgacgccgccgtcaagtgggcccctcccgtcgcccctatccccgccgccgccatgtccgccggaagaggcaagagggtgaggtcggaggagcagtactacttgagggaggtgaagaaggagaggctgatcatggcgccgccggagaactcctcctcgtcgtcgtcgtcggcggcggcggcagccggagacatctgggacgagctgaaggggatctgcagcctgccgccgctctcgccgctgtcgccgcacccgcacatggccttcccgcagctgttcgtaagctgatcgatcgctagctccggccatggacggcgccgtggcgagcttggagtgcagccatggcgcgcgcccggcgcggtacacgcatggctgccgcgtggtggtgtccgtgacgtcacgtgcgaaggatatggccttaatcctgaattagatagggtgttctttgattaattcgctaaacttcgtaatattaggtaatcgatttggctttcggccaaatattgaattctttcgttctattgctgctcaggtgatcgatgatcatagtagcttcattgcgatttgtcaatgaaatgatataaatatgtattaattacaagttgaagagtactaatgaagaacatcagaggctcagagcaattgagcgcacatctcgttaactccagtctccttttggaatgattggctagtagtacttgtaagacatcgaccgttgaagtcgtgatgtttgctttcttcttttcctttttagaacacgtgattttgcttttgactatgctatttgatgattaaacagagaagaaatattcgtcttacaagatcatatcaccgaaaagactagctaggcgcatggagtagtactggaaacaagctctgctaaggccctctttgtttaggcttaagcttattggactagacttttaagccagctgtggttaatctaggcccattttggaaaaaaaaacattagctgtaatttttctcgaagttatatatttcttgcactaaaaaattaaaaaattagagagataatttgagtttctaagatggattatttcattcatattttaaatagtaaaaacggaacactaaatctctatgattttattcccttcgttcaagtgtaaatgtcagttttaactttagattggcatattttgatcaacaatatttttcaaataatctagcatcaaaattgtatcattatatttgtactaagagctttactaatactctcttgcattcgaatatgtttggtttgacacgcttagaaataatggtcaaatttcatctacctctaataaaaaacggatgactagtaggagtagcattcagactattcaacgggaatcccatcccgggccaactgatggagtgtgccaccttccggcccagggatggtcaccctgggccggctaacaaggatacggcccagatggatgcgtggacctctggtagactagcagcagtgcggcccatgtacatcgcaggaatcccgtgtgagccgaaaagattgaccaaataagcattatgcttttttttagatgggagtagctatacaactattgatagtttttgggatgaaaaaatttcaaatataactactatataattacattgtaactactatataactactatataactaatatgtaactcgagtgtaactcaaaatagcctgatgggagaactggttaggggaacaaacctccaagttggaggtgttgggtttgatccctacagcacgcgtttgaattttttaagccgttttccctcactagcacaaatctcaaagcatattagacagcttaaaatttgaaagttttcaccccctgttaactgtcgccagttggttccctcactagcacaaatctcaaagcatattagacagcttaaaatttgaaagttttcacctcctgttaactgtcgccagttgtatagcaaatccgttttagaaacataggcattcacaacgccgcgcgcagacacaccatatctatatgatatctatatgagttcctcctaccactaaaagaataattagctgtaaatgcgagcactcgtgttaaatctaggatttgaactcggatgagctagttccaccacaagaaatctaaacagttaagctacgttcaactacggctgaattgttgtccacttgagagagttctggtcacaacaagtcagcaatcaggatattggcgagaagcctactcttcttcttcttgatgaatgttgccaatgtggtatgtgggcacaatttgcacaaaatgatgcttgtgggcaacaactttagctgcattagcgtcatctaattcagaacaaaacttgaaacttttcattttcctttttttgaaaggatctgaaggctgaatgaagcttgtaagcaaagtggaacacaaagcttagaagcgacttcactgatatgtgggccccttccctactgtaggtcccgcgccacgtcagctctcgacggcgctcctcctccaacttccaagtcgccggagcggcagttgggccagttggcctgggcccacttcaccccaaccgaaagccccccatcaaactgacatgtggggcccacccaaagcctactatctccgcgactaccggactggcagttgggccagttggcccgggcccacttcaccaccacccgaaagccacccatcacactgacatgtgggcccccacgaagtcacgccgcctccgtcttctacctccgcctcgtcgtcacaagtcacaagcacaagaggcgaaagcgcggcgccgtcgcggagaggagaggagggcgacgagggggaggcgattcccaaaccctagctaccctcaccgccgccgccgccagcagcgatgatggcctacgcgctgcgcggtgccgccctcgtcggcgtcctcctcctcgtcgtggcctccccggcgctcgtcccggtggcctccgccgtgcccttcatcgtcctgcacggttagggtttttttttttctctcgcttgtttgcccccctaggttttgtgctctgctggtgcttggatttcgtctgaggttttgctggtcgtgtgtacttgtctgtgtccgggcgcacgcagggatcggcgaccagtgcgagaacggtgggatggcgtccttcaccgaaatgcttggggaatggtccggctccaagggatactgcatgtaatggcgccttatctccccccatctctctctcccttgtgttctggaagtggagactgttcgagctgtgatatttgtgaattgtgatgttgccttttgttatgacgagaaattagttgctgtttcaagtgcaatactagtgctctggtttccattaatatatatgtacaggctattaattaattatttctttgtttttccatgtgaaattgttaatgcgaataaatatagatgcccaaattagatatgg

SEQ ID NO: 68042 - DNA, 752 bp, Oryza sativa
tttttaaaaaaaaaatcaaatagactgttcttgtacaagtttctgagattatgtattcatctacaggcagacactgtttgcaagaaggtgattcagaacctccatcacttctatttatgtactgtatgctgaattctcaaggtactatatcattgctggaattgattttccaggtgaagaaaatgaaagaactccgtaaaggttacagcatagttggcctttctcaggtgtgttcatgctattatgctattttatgttcatgacaatagctttattgtaacatgcagatctgttctttgcttcttgtacctctatgcattgctgttcttttgttatgtcttcttttagtcctaagcctatttgatcagtcttggttaacccaaaaccaaaaaataataataaaataaaaataaaaataaatcaaacgaggcctgtgtggaaaaaaaaaaagtgattttcctctctttgtgctgctgccgaacgcaaccttaggcctgtgcggacatgtctcgcttttgttctatgtggacctcttgagtataaaacgtaggagtgtgctatgtgacccttcgatagatttttatttgggttattgacttagtgggagttttgttttcaatgccatgtatttcactagagaatcaccttattgtttcttgttgcatgtcaaaatttccctcatatgtaccctttttgttaccttttacaggggaacttaattggtcgggcagtaattgagtactgcgatggtg

SEQ ID NO: 68043 - DNA, 3150 bp, Oryza sativa
attatcggaaccaatcgggggcaaaaacccccacggccggcaggaggatcgagcaagcaacgggacaaggcgccatttactggatctccctccctccctcgcgcgcgcgcgcgcgcaacaaaacgcgcagatgaacggcagccagaaatcgatttctctactcgcaagcattcgcaccgcattccttcgtctgttgctgctgactgcgcggggcggaagacgggaaggggaaagggattcggtcgagaggcctcacctttctgcgccgccgccgccgccgccttcttctccaactccggcgacggcgaggcagtggaatcgccgccgaggagggggaaaaaaacagcagcgcgagacaagtgcggcgcgtagggcctacttgtcaggtgactgtactggatggataattttcggcccaaatcgacaatattacagtatagttcgcatttgattcaggcccattaaggcccacctatctcggcccatttgaaacaccgaaatagagcaagagacgcgcgggctcaaaaaagaagaaaaaaagaggcgcgcgtcgccgtcgggcggcggcgaagccggagatggcggggacgccggggaggcgccctccggcagccggctccgcgccgcagcggaatccgaccggaggcaggtagataagtatcctgctcctcttccctcgcgttccagctcgcgaagtccccgtttaatttgattttgtatgcgtttttgctgggtagggttatggtatgtactagggtgtgttcgttcggggatggcgactagttcttcgagctttcgccggaggggaagatggcggtgcggccctcggggaaagaggggtaaggatttttcagtgcttgcctcttgggctcgtggtgaactggtgatagcttggagtgtgaggggatcgtcgacaaccgtggcgtgtgcttcgattattgcttaatttgttcaggttacgcgcgactctgtcagccagatgtagttggagagccttttgtcatatcctcatactgcctgtagttcgagacaaaaatcatattttcgaatattttacttttttgggatggttgctacgatgcagttgagtggttcagttgtgattggtgattgtctgtgtaggatgcatcaagcggtatttctgatttgggcctctggaagatggatttgagtgatgatgtgtaccaattgctttctgaaggtacttgtctgcttcgccatttctcaacaactgataaatttgtcaaatgtaaccgttcatttttacttggacgttcatcattcagttgatttgatgtcctttccaagctttgcttcttaaaaggacaaaagaatatttctatatttgtccggccaaattatctttagaacactttccatcttgaaaggcgtcaatgaaactgtactgtgcaaatctgccataggcatttttgatttggtattgtgcaaacaactacagcattctagaactgtatcacaagttcacaacccactttctatcactcttgctcattgcacattcatatcttgtttcagagaactgtttactccactgttgttgcttatatttcccttcaagtttgggacctgattctgaattctttcagaacaatggtgcacgttactgctgatcagcactattcggtcaataatgcagtgcagtcataagtgcaccatttcaagtgtatttgttagttggtactaaatatctgtgcattacagtgtttatatgatactaaaactcttcatgccagaacatttttagtttagtaagaaaccataaggtccaaaatggttggttcagtgttcagactagcagctcggcaaaatcttcttactaatgtttcagattaattatattgctgccatatactgggtgcgtatgattgagaaaattaaatctattaggtaacataaatatggttggttcagtgttcagactagcatctcagcaaaatcttcttactaatgtttcagattaattatattgctgccatatactgggtgcgtatgattgagaaaattaaatctattaggtaacataaatataaggcgtgtaggcttctgggctctggagtaccgttgttttgtgcaatgttcaactgagttgtttttaaactagagaatgagatataaacagaaaacaaatcatgaatcttcttattctttttaatgaactgactgtgtttctttatcattgttgatccagccgagcaacttttttaagtttatcttttatttccatacatcttatctctttgttttattgaaatggatttgttatcaattcaataccagtgaagcatatgaatctgatgatggaaactgttgcaacggcacattcggaatatgccaatatggaatggctacccttgcctgcaggtatgctatctttttcacaacttttaattcatcaagttctgttctttctttagattatcactcacgtaaacaatatatatccacctgttgatatggtcctgtactccagtgtcagtttttttatatataaaaaaagatatggtccagtcactgctgatggatcctaacttatattttattcgataatttgaagatatatgctagtatcttgcaagggatattttgtccaactgcatcaacaaaattaggcatcaagatttggatgttggtaagcacatcctctctctagatcggtgcaagtgcaacctccgtcttgaatcttgatgacattagatgagaatatctccacacgaaaataatataggccattgctcactcagttgcttacatactctgttttactttagattatgatgcctttctacttcaataggtaaatactctttagtacagaatataaaaaaaaggtaatatctctgtaacaagcaagtcactgtcaaaattatcctaacaccttcaagtttttgctatttttattaactgcgcccttgattgatccgtgactgtcatttttctttgacgcgttccgtgatagtcatggcttaggattaccgtgcataagggataaaggtgcatgctgatcgattgccgactttttgagtgtttagccacgctttttcttaacttatcctctttggtccgttcaaccccatggatgcaattttaattagttgcgagcagaaagcatattgttggcttagataagct

SEQ ID NO: 68044 - DNA, 42579 bp, Oryza sativa
  unsure (1)..(42579): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttacagtccctcccatttcttcaaaggaatccataaataacattaattgatctgttgtgttgagggcaccattggaaatgggaggcatacaggaattcttcgtgccgattgtgccgacgacagctgctgtgaacttccatggtgcgaggcaacgatcgctggcgagaaggccgagcaagttacctagcaccacctgcgaagaagacatatgttccttccattggcagtgctccttctattgtgggcaacgcacaacaaagtgggcaataggcaacagacaacatagtggaacaactcagcagatagtgttgtccggttcagaagggctgaacggatgaatgggtgaggattatttgattttctttttataactagttttatgccatgcgttatcacggatcaggtccatataattaggaatagacttggagcccgtacgttgatgggtcgggcccataaaactaggaaggaatggtacttacatttcgtgtatggacacgctgagcattgggagtaggggttggaaggagaaggatgactccacttgtaagatagtagaaatatttgagggtacaattgagtgaattaattattatgaagctcaaaagttattctaaaatgtactctaagtaatttatatatagatattttttttcaaaaaacataaacttaggaagcatgtccactgtaattcataatactaggtgattccccgcgctttgctgcagaaattactaagcaattcttaatatattttttttgacaatcaatttaggtgtaaaaagaaaaaaaataaaacattagggtttatcagtcaaatgatacctgtgctttagtgtgaaacatattgataaatatatgttaaatattgtaaaaagtgatatatagatttgttaaaatactgtgcaaatgatataaggggtgatgattggatatgcttgcattttgatttataaaattaaataaattatagatgatgttgtttacttgcatgagattaaatatgcaattattgctagttggtgatgatgtggcatggttgcatattgagctttagatttactgggctttaactttatagaaagtatagatgtgagagaaaaaacggggatgagacaagattaaggctcatctgaatagggaaagagcacaagcagaggcatcctctacagttgagagacacatttacccgttttcgctacaaacgatagatctttttcctccgatgtagcacacagctctcatttgttgtaccacaatatcttccacaaactcttctttacagctgcatacaccaatatgtactacgtgaatcccctagtagcagagagacaatcttaatttaaaggtagccacctacttgaaataattaattaaggtggccacgatatacacagccagcatgatatatatttataaaagaaccatcgtgagaatatcggcttaaatttctgtattagcgtgtttctgttcttgttttgttcttccccttccttctgtttccatcattgtttggtgaactttaaatactttctgatcctcttctgaatataacaccagcttagcctagctttggtttcaaaaataatatatttatacaagaacaagaagaaactgatcgattgatgtacacctgtactagcttaagtttgtttctccttcagagcttcactcatggccgtttcctcaaaaggttccatggtttgatttgtcatgcggatgtggttgctagtttcaaatgttcagaacactgatggaaatgggaggcacacgggagtttagtatcaccggcatgcatgggtagcctcactggctcactgcatattactcggttttcaaactcgttgttaggtgcttatgctgatcaaaagcggaggaatgtacatgcctcttcaaaggaagaaccgatatttgactaaacaacttaatttcttttacataataatatttgacttaacaactagcatgttaatttctagtggtaaagtttttgtaagggaacctcgttgtagtatagcttaacgataacatgcccacacaccctttgttttttaatatatcatgaaattgactttttaaaattatttgagtattcgtccttttttagaaatatttgtataaatagactaacatactagacatggtgaaagtaattttgatgatagatctagtggtactattttcaatttagttaactaagtaattggataaatattatagagatactactaggagcgcagtattccgagcgccaaacatgtatcagctcaggtccacctcaccccacgtcccgtcatcccgctcccacagttatcagaataaacgatttactacgataaaaacaatttccatgcttccgatcctacgccacgtcccgtcatcccgctcccaccattatcgaagtaaacgatttactttgataaaaacaacttccctgtttccagtatatattctattttttccgtacaaaccaaccactcttgcccccacttcattttttcctttttcttggatctgaatcgacccaccatcacaacccacagattggtgacgcaccatggaggaggaggacatcaccatggcggttgatggcggtggccagcggcggttgaggcgaaggcgctacttcgggcctcgctaccgaacaccggacaacaccttaaccagcaaggaggtgttcacctgggccaagagcaacaaccggcggctgttccacgtcggcgacattgacaaaacaagcaagtaaggaaacgaaactccaatttgcatctgcatactctccttcaccttcacgcatgaagcccaaatttctttttgcaaatcaaattaacgtgcaatctccaatattacccgatctgaactgatgggctgcacaagtcctacatttgcacatcgtgctccatgtggctggttgcaaaggatagggtggagtctgcctgtgatgaaggttgttagctatttttctttttctcgtcgtctgtatgacatgaacaagaatgtttttacatttttttcgtgcttgctagatgatagatggctgctactgcataacgtcgagctcatgtctataccatgccgctacatccttccatgattccatcgtcgactaccgctcgccactcggttgccctctccaatctccagtaccagtcacaagacacacaccagcatttacatccttatagcaagatcaagcaaagccaccaggatcccaacttcaccatggatttttggctgaatcatttttcttcttttctagtttgattcacctgtgagtaattttatcactcgtgtgtaattgagcctgtaatttttttcattcgtacgaccattttgtgaacagattaacaatactcttagtatcagtttttgctcttatactatatattgaacacatcaataaacatattactacacggtggctacgagatcatgggctatatcgagaggaaagtggtaattgttttactcacagaccacgaagtctaaatatttataatactggtaaaagaattactagtattgtaagctggtagtaattcttttactgccgtctaggaatggtgttgtacaatggggggcattcatgcaagtaaatttgttacttttgaatgggacattcatgcgagtaaatttgttactttttaatgggcagatgtgggaggctgagagtaaatggaaaactccacaaagtaaattcattactttttaaacgtggggagacactaggaaaacagaaaatttccaaagaaaaaatagacggtaaatattttactaaaacgtgaaaacagaagaaccagaaagaaggaatgaaagagggaaaaatctggatggttaatattttaccgggccctttgatggagcacggatgagatggaaaagtaaaaaaaaaagaaacatggaaggtggggtggtaaaaaacaaaagaaacgcgacagaggaaattaaggtgggtggtaaaaaaagggaaaaaccagaagaaggaaacgttgtgcaacgctcaaactaatattatgcgcgcattgcgagtattagcgccaccatcaatattattggtcaaagtttgaaagaaaatcaagtatcatatattccttccatttcacattacttctcattctagttttgtcctatgtcatatacttttatctttgatcataaatttttcaaaattcatgtatgttttacaacaaatgaattatatattacaaaagtacatcgttgtaattgtctctttcagtccatatacagtacatgctacttaaatttactttgttataaatgccccaaaattttgtcagccatacatgatacatccaatacaagatgaaggaaacactaggagtattggttccaagtaatggaaacctgtaagcccaagcccaaaattttgaaagaaacacgactcaacattagcttgagcagagaggttgagtgaactacacttttgacgcatttgctttggtccaaacttgttctctgtgcttgatgaccacaagatagctaagctgcgggaatgggaggctctgagaaggacgatggtgtgccacgtttcgcctcgctgcttgctgtggagtgtggaaagaaggatccatcgacaagagcaactcctgaagtgtttgcagcgaccagtacgaccacatcaagcagctcatcaaacaccttcagtgccagcttaagatgaggaaggcatgaaatcaagggaaatttgaaaaaaaaaacaccccaaatatcagcttgagtttgagattcttattataaaacgatttgttgcaaacagcccctttcaatctattttggtttgatgttccttcccaataagcaattaccattttttgtgttttttcttgcatcttttctttgttttttttaaaggagggcaaaagctttgcctcgtatattaatagagatggagaaaaaatagatcaaagtaatatgtacagggcaagcctcgaaagctaaacccgcaagaatccgcgaaaaattccaaactcttgaagctttgaggctccagccttgacccaagctcgagcttcctccttgatcttggcgatgatggaaatcggcgttgaggcggtgttttggaagatttttgtgtttcgtttgcaccaaatttcctaggaaaccaagatcaccaatattcgcaaaggaatgcgggaattgttaagggagtctaccacaaggctccaccattgttccaccgagtcgtagtcactccatttgctcatttggaggtcagtttggtccacctttgtatttctatccataccctcttggtaactctacagtgtgtcagaaggtggaccgatgattcattgattatgtagcacagcggacaaatcttctgattttgccaacctcttttcttgagtctgtcagttgtccaaagtctattttgggtgacgagccaggaaaagaatttgcattttggtgggggccacgctttccaaatggattggttgaaggcagatctcgcagtcttgcatcttttcatgtgtgttacatgactcagcgcacttttcgatggacatatacattttctttcccaataatgtgtgctatactgagctcatctttctcattttgaatctaaccaaagaaacaagtcactgttgaatcccatgagacaagtgtaatagctcatcttccagcaatctcaatgcttaagagcgaagactctggactatcaccgtccaactacatgctagacaccataagtagggattccacgatcatgtcatcgtccacgctagacacaatgaccaccacggtcgtgggtttgtggccccaagaatggacgagtaacggcacttgggggtaatctcaaacaaaaatgacttacgagaggggtatttgcaacaaactcaaggtgatatttgtggtgtttttacaagtttccttaaaatcaaatgcccctatgcttccatgacagccacacaggtagcggtggcaatgggtcaagacccatgtaccaggctctcgaatatttttaaggtcaaaaattaattaaaattcagcctattctattttagattagctcttaaattttatatactaactttgttaggtcctttatcaccctagacacaggtgaaacgatcgaaaacttaacggcgggacatatttgttttgatgctgttgagaaaaaaaaatctcgctagtcatatttaggaaatattgcagtagatatcaccggtgcttttgtcataagcctacaatgttttaaattatacttagcatatcactcgtgcattgtaatatacgattttaattaaataattatcattaatttattattaccatctgtctgcatatatcatttttttaacttctgaatattttgttcaccagcaatgcatgtgtttattccctcttgagcattacagagcagcaaggaatttgtacttgggtcatgagatataatcaactaatgttttttaggaaattaagacaggtaaaaagcgatagtctttgacattggacaaggaaatacttaatggtcacacggaccaattgccaagaacttataacgaaggtccttgacaagtacatggtagttgcccaacttttggttaaatttatagactgatatcacacagagagccaacaacgaacgcgccctgctctttgtttgttgaagaattatttttcttcaagtattgaattgttaacggcagtactgctctttgtttgttgtcatttgatagacatatcaaatctatcaaatgacaacaaaattatagtctatagtacatatgaacgggaggcatttggaattgcttgcaagatgatgagattgagcctagttctgcccaagaatgtgatgcggcatgctattgctagctggaaaatactcgatgaaactaataatgttcataggtatatatcaaacatattagagattatatcaaagtttgtgccgttaaatagtctggtatagtaacaattaatcttttcttttataactggtatatactaataacaatctgctgtaaaagtaatgggagactaacatggttgttaataaaatagttcacaatataactcgtgctcgtagcgatgggaggggtgcgatagttttcgtgtccgatatatataagttggacaacggataaattcatagaattattgagagctccatggattgccctaataagttaaagtgaaagtcaaattttaaatttttaaatttaatttttaaagttaattttaagataatttcaatgtggtttattttctacattgacttttaagtcgcactaataacacatatataaaaattgtacatgtaaattaatttttattttctaataaaccattttgacttattaaaaaatataggcaaccgatgagtaccgaaaatactacggtaatttctaaatgtatataacgttaaaaagaagatataaagggagtatataatgtttgtttttctaataacattgatgggtaacaatcgatctcatcttttcgcttatatttatacttatcagctataatttaaagttttcattttaaattgggagttaattttagagttttttcatcgtagtttatttttcagtctttgttttaaatcgctaagaacatgtgtataaaaattttatttataaattattttacgtttgcaaatatattgatttggatttatttcttagaataaggcaaacggtggggctgaatattagtaccatcgacagagcatcatatcccttgcaacacacgcttccagcattcgaaaagcacgatcagcgtgataccttgcgtgagcgagtgtgaaggcagtttcaactttcaacaagtactgtactttcttcgatccagcgggggagagtttccgtttcccttcacggaaaacgcctcccgccccggaatttcgcagggtaaagcgggggtgaaccgccgcgaaagcgtccccggattctagattcttccatgtgggccccccgcgcgacccctaactttatactcctcgtcctccccccacgcggccgcgtccaggtcatcgtcgtcgcctcgcctcgcctcgccttcccccgcgtggcctcgccgtcggatcgagccacgccgccgccgccgccgcgtcgcggatccccacgctcgccgagaggaggaggaggtgatgccgcttcccgcttgcccccaccctctcctctcgtctcgcggttgcttgggtgcttgtatgctgggtttgtgcgattcggatttgggttcggggccggtggtcgattcggagggggcactggccgattcaggcgtagatttggtttgtttgtttatggcgatctgttgtttgctagttgttcatacgcgggttggttttcctagagaattgggattttttttaattgttctgcgattacggtagaaatagatcgggcttatggataatcccgtcttcttctagcgtgtgattttatcctccaacgtgggagatattcctagatgttttatttccttgtgttgtttatttatgcttagattgttgattccatccttgtggatcgtcagcatcttattctagatgatcctatataattgtgtgaaacaaaattgaggttgttgggagggtttctgatcatcagctgtcctctttaccggcacgaatttggggaatctttcttggttgtgttcttgttggcttataccttttttatgttttgctcaaactcatgagatttttatcgtttaatgctggatccttatgtatgaccacatgctagtagctggcggagcaacttcgtaattgttgctagtagccattatattacatagtactcctaatatattctatcagttttgcatagctatttctagcattgttggtgattgtagtttcattggcaattgcagcttcttgcactttgaagaaacagcaagatggcagccaatgttggggaatctacaagcagcggcaccaatggcgatgcagctggggggagctttgaatgcaatatctgctttgaattgccacaagaaccaatagttactctctgtggccacctcttctgctggccatgtatttacaggtggttgcacatccacgcacactctccagagtgcccggtgtgcaaagctgtcgttgaagaggataagctcgttcccctttatgggcgtggcaaggaccgcgtcgatccaaggtcaaagaacatacccgaggctgacattcctaaccgcccaactggccagaggcctgccacagctccacaggccgatcctaacaacaattttgcccatgccaatcctaatgctaatgccaatccatggttcatgggcactggagtaccattggctaatgcacggtgggggaattatgcattctcagctgcgtttggaggcctattccctatgcttagcttccaagtgcatggatttccagatgcaaatccttatgcacagcctgctgggtttcactatgggtatggccatggtcatggattccatggcggacatatgggtcatgccgcccacggtgtccctcgacaaggaccactggagcaaccgcagcaggcagacatctacctgaaggccctgctaatcatggttggatttcttgtggttgcaagccttcttgcattttaagattgttaacagattcacctggtgatagaagatggtaaaagaattgccagcatatccctgtggcgttgtggtgcgtgcagtttcttcctgccaaatgtggcataagttattttgcgtatttacatgaagtgttcatagaatatttgcatgtagatgtaggataagcatctggctttttatagcctcatatgtagtactataattaggaggagccattttattttcttttctttttttagttttgactgttttgatggatatgatgtacaattattgggatgttgtctccatgtgttgtatacatgtaagaatagttcttcccaaactcttgcttgcaatttgcaccaatttccagtttatatacattgatgcttgacagtcagtgtgctgatattattatagtcttgaacagaagatacaatataattcttggtaagagttatttgatatatgtcattatgtcagggagtgccaatgtcagttgaatatttgaagaatggtaagaaaatatgatggccgatcaggtttgagtttggattgttgcccctcggctgttttctccaaactattctgggatgtttctgctcgcaatctgtgatctggaaatgacaaactattctgggatgtttctgcccgcaatctgtgatcaggaaatgagatattttgtcacgcaggatgtgcactggctctgcgcttggatgcctatccaaaaaaatgttgatcgccttctttatccagaatgtacgtggacagatcatttgcagtttgtgccctctcataagattatcaacaggagagattcgcaaaaaaaatgaatggtcgactactcatttggagtcggtttcgatcctctctcaatcatgtaacgtgtagtacggctctctcagaaaatgggttgtactacccttgtacgggagtgagggtgtgtttagttttatttgggtgtaaagggtctgttcactttgatgttatttttcactttgatgttcactttgatgttattttcaaccttaccaaattttgttaaaattatcaaaaaagtggctacatttagtttgttgccaaattttagtaactatataagaaatcttatcaaaattttagcaattttggcaatgccaaattttggtaaggtttttttttcaatcaaagtgaacaggcctaaagtttttgaagtatacagacggaaatttgaagtattaaacatagactaataacaaaacaaattaacgtagactaataagaaaacaaattacagatttcacctgtaaactgcgagacgaatttattaagcctaatttatctgttattagtaaatatttactatagcatcacattgtcaaatcatggcgtaattaggctaaaaagatttgtttcacaatttacatacaaactatgctattggttttttttccccacatttaatgccttatgcatgtgtccaaacatttgatgtgatcttttttgctaaaatttttttatctaaacaaggcctaagtgatctggccaattttgcttgcttgcatgcttgaagcccccgccgtaaacgaagaataatttatgaataaaacttttatatgtgtgtttttaatgatctagaagtaaaggctgaaaataaattacgatgaaaaaatttcaagatcgactacaaatttaaggttaaaaattaaattttagctaataaatataagtataaacgaaaagataaataccggatattttaagacctcaaaatgtgcacagaggaagagtcgcagtacgtctggcaaaggagtactaccaatcaggtagtgacaatgtgacgtccatcatggagtggccatgtgtcaagagaatactactaacagtgtcagtgacatgctcggcagctctctcaaacagtcaaaacaactcttctggtaccgtttcagtctgcaattttttgtgattgggagtgagattgttcttttttttttcgcagttacatgttacaaaacacacactctcgaatgtggcctcctagcatgctaaaagacgagggtcaatgatgaatctctaagctcattaaactcgtatcgaatgagacggttgtttgttcgagaggagaagaaacgctgtgttggtagcacatgaatgtgctctgtgctagtgtgcttggattggatccaaagcatcatgtatcagtcagttcctcctatttccaaaaatgttagtcgcctccatctaggtcattcccaaatcacaacttgtgcccttagctaagagcaggtacaatagcaaactattagctaactataaacatattttaatgagataaatgatgagagagaagagcagcgggctacagatctatagccagctgcagcacggactacaagacacactgtatatatgacaggtaggaccatatattaatagtatagtaagcaactattgtatgaattggctataaatgaattggagctagtagtgggctatactattaaacttgctctaagaagattatctaatattagtactagtattttcttaacgagaggcttggaactgtctgagtgcgtatttatttatagacgattctgaaactttttgacaatcatagggccagccagtttgacctcgatgccacaaacttttgaagcaccaaaatggtccaaatctgcaaagaagaagagcagtcgagacaattcttctccctccagaaaagcaagcagagcattgtttgttcctgtgcgcatccgtttggatgtgaagggcgttgaaaattcggccgatccccaaaaaccaccgatggatggaacagcagcctgccatatctggaattcttgattgtgaccgtaaagctactgaggaaagctgccgctgctaccactgcagaaaccacgccaccgatcgcaatacaagctgaagagcgttaagaatcagccgaagccaaaatttaaattctaaaacttaattttgtagctaatttaataataattttaatataataattttcattgatttctaaggttgcgttcgatccagctggttcccaacccctctctcttgttttccgcacacacgcaaactgctaaatggtgtgtgttttgtaaaaagtttatatacgaaagtttaaaaaaaatcatattgacacattttttttaaaaaaatagtaaatatttaatcaatcacaggttaatggaccgttccgttttctgtgccagaagatagcgttcccaacctagggaaactaacgcaacctaagtcgctaagaacacagtagtactttcgtgtcatagagggtgtttagatccagaggtgtaaagttttggcgtgtcacatcggatattatatagggtgtcgcatggggtgtttgggcactagtaaaaaaactaattacagaatccgtcaataaaccgcgagacaaatttattaagcctaattaatccatcattagcaatatttactgtagtaccacattgtcaaataatggagcaattaggcttaaaaattcgtctcgtaaattagttgcaatatgtgcaattagctacttttttagcctatatttacttcatgcaggtgttcaaacgttcgatgtaacggggtgaaaaattttggggtggaaactaaacaggcccataattgcccagcaccctaaacaacaccatatataataacctaatatgacacgctaaaactttacacccatagcttccccttataaagagtttgaggcaattacaaatttaccactattttgaatcgttattacaagactgtcactagaaaattgcaaaaatgctactagaactatcgttcgagtgacatacttgtaatattgaaaaaatcggtggcaaatttacaaataccgcgaagagtttttggtcaatcggttgaaagggctgaactgagcaaggaaaaagcgacgtccacgcagcagcaaagccagcaaggcagcaacgatggcgcgggcgcggctgcgcgtcgcggcgggaagcttcttggaaagggaaggcgagacgagacggacgcgggtaagtacgtacggggtttggacctgcaaatctgcaatgggcaagtgggttgggcaactatagccttggctgggcttgggtttagtggagacgccactgcctctgcctgccttccttgtgaccaactcatcgactacctctgctttgctttgctatgctgcgtgactgggctgtctgcgttttgcttccttgtagtactacaagactatgggtgtgtttttcacgtcaaaattaaaagttttgttgaaattgaaacgatgtaacagaaaaattagatgtttgtgtgtgtaggaaagttttgatgcgatgaaaaagttaaaagtttgaagaaaaattttggaactaaactgggcctataactgcattaattctgcatttagaggttgaggttggaaactccgctttcccttatgaaaaatccattaacgcataattattaaacattagttaaaaaattaaaaaataatataatttttaaaaacaactttttcatatagtttttttttttaaaaaaaacaccgcttatcagtttcagaagcatgtgtggacaacgagggagtggatgttagaaacctaatgcgccgaaacacagccttatcagtccggcgatatcaactcttactaatcatagaaatagattaagttgatgtgtgcttagtggacaacaataccagctttaattatcctagtcagtttggaaggatctgatcagccgctaatcctagctgtgcgtgatgccagatcaacacggtgaatcgtatataaaacttatcagcaagtaatccagctgcatatgtaagtaatataactactacattactttggtttaccagcatgattttacgactgctttggtccctttttctgcagcttgtcgggtcaatcagcttcgtggttgatgaactgaaatcagttgacgaacagagctttcttgacggtgagatgtatgctagtccggtctaacagctggcttacctgtgaactttcttttctgcaaacgacggctccaaaattagacgcttcaaaaggcaaaaaaaactgtccagtttctcaggctcgtggtcgcaccatcgtccagcctctgaccccaactctgacttcgaatttacaaatgggcgactaattttagcagatcatcctgagatcctaatcacacagtggtggtgcacgtacctaattccgagcctaatagttgacggcgagtttacctgtttgacctgcccgtcaaagccatctttggactcattggctttagtttgcatagttgcattcaggtttacgatctatctagaaaccacgaaatccggattattattttttgggatcggcttaattttttattaagttaaagaaaaatcgaagtagatttaaaacttttgacaagatatgtctggattttatctgtctttattggtttattaatggagataccgcttgcaagtgatttttatctagtattgagattgtgaactagaggcggattcagaaagatagcaagagagactgaataaattagttaaaactccaacacttcttttaaggtacgtatgacagaaaatttcagagggctctcctggtcacggtgttgatagtgaagggttcgaagtttgaaccctcgccgttccacgctagatccgtccctgttgcgaaccctggttgcattgctgcttgctcttggtgagacattcatgtgttggaattgggtttggaattgtaggcggcggcagcagcagcagctggttcaggtacaggtcacagtaatgggagacaagttgcggagaccgcgacgtcgttcgtgtactaggaaatggttttggtaggtgtgctttggttagtgcggtgatgcacagaaatttggcatgctatgacctagctgtacatgaaaaactcgatcggttttagacggagctggttagttagttagtttgttaagcgtctttgtgattaacgagttggacaactttttggggataattgattatcttcagttgtagacaatctcgaattcaataggaaattgtagagggaaggggacaatctctaaatcaatctgaatttgtagagtgaacggggcaaattaaacagaagctttgcaaggaaggtgatcttcaagagatgggcaacctgaattaaatttcagtcacttttcttatttaatctaatggttctcatcacacctagctctttcttagataacaagttaagcaataaactagtctaacatacaaaaagttttttaaaaaaaacaccaaactacatgaaagaaacttacaatttatacagatttacaatattactagatgtaaacaagtattcaaactcagataaaataaagtaaaaccatatatgtaaccacaaaattaagtaaaattgtatattacataccaatgtaatttcggcttatggatgtgtaatttttttttactgaaattttgaaatctagcaataccgtatatataaaagtatatttgacctctgcattatccatatgaccatagacccaatattttttcagtaacacagtacaagcgtagtcgcttataacacgggcatgatcacccctataaacgcacatccccgcaccttacccctatgagcgccttcaaaatgatgggtcgttatatcttaaaattgacctagtcatcatgaacatttcgctattgatgggtacgttacttaccactgaaaaaaataattaaccgtaaataagagcatccgtatcaagtctaaaacttaaatacatgtgggttgattaaagaaaacataaccagttgagtcatgcacaattcgcacagacctaatatttgaacccggttgtacatagtacacattaacacggttgagttttattttttgaatgcgaacagggatgagttattagctcatgaacattcctaccagtgttttaccgttatctctactgatactgataccgttcagtttttataatcaattactccctccctcccaaaatatagcaaccctagatcggatggaacgtatncatatttcatccgatttagaatacgttccatccgattctaggttgctatattctgagacggagggagtagtttttatgacaattgacggtggggatgattaatttacttgctttgtgttttacacctttcgagagatctttgacttcctgtaattcattctttttaattacttgtttcatgttttacacggttttagatgtctttgacttcctgtaatttatttttatttttttaccgaggatgaagagtgaggagagatcttgactttgctttcttgcttaatttagttgagcatcgacggagatatcatcgagagatcgacttgatccacctgaaaacgatatatttaccattccttcctgaacttgctgatcttccatgtgaaaaagccaccattttttactctgtttagcacctctccacctctgattcgatcttattacttttgcctttgctttcttttttttttaaaatctccacatcattttcagtttttcacgagatcattcagatctgtagagctttccaagggagcagcagcttcctctcactgtcacctcataatgaagatgctttgtgtatagttgtgtgatgtgttcgtcatctcgtctccttgtagctacgcttgtgtcggtgcagcagccagtatggttttctttttttaaccatgcatttaggttaattaatctcatttcaccgattaatttgcctgtgtgaatttgagattaagtagggaggaggcattaactagagccggcacataatgaaggctgatgtgaatggatagatgtttttgcagggcatggagagccatactggtataaacggtgtggcattgaagatttcacattacctgttgaactacgcggccatgtcacgaggagttaatgacagcatttagattatcataaaattttcaagttcttcttcttttttaaaaaaacatgtttgacagggccagagaagtttcagcaaatatatggattattccagctctgatcaagttatgtgttaaattacgagcaacgactaataagccgtagaaaaatgaagagaacaaatttataagttttttttaaaaaaaaatgtaggttctaaatttgaaattggtgtgatttgtaagacaataatcagacgacgagactttcaaaaaaaaggaagtcttttgacatgtgcacaccgacaggccattttgcttgcaatgcacacgaagaattgggacagtgctttggcatctgaaaacgccacgttgtcgtccctcacgatccaacgttgatcttggctcatgattgcttctcgatcaattctttctttttttttaagaatttcattactactactgtacaggggtactggtactagtatacatactcctctcgtactattaaaggaagtcgtttaagataatatttaagtaaaatcttaaaaatataaatcatgaatagtttttaaattattgagtctgaaaatataaaaactatatgaatagatttagctttcataaaaatatatatgccacttttcaataaatatttttatagaaacaaaaaattaaaattatgttttagagatcgcatcgctgttcaaaacgactttctatgcagctgaagtcaaggcatctgactgtagacttcatatggatgtatcagatgaccacgtggcacgttcttacagggtcccacctacagctgctgtgcagtatgcctcccctcactgcacctgatcccaattcctcaccgacgaatgctacgaaatgaaacgaataatggtcgcctttttttggcacatgaataatggcctcctgaatgtacctttcgatttgaaggttttcacaggagtttcaaagaattcaaatccttagatgtttgtttctctaagaaaaaaaatgtacgaattacccccctcccccctaactattgcgacagtacgaattaccacataaaccacaaaaccagacatattacaccttaaactattgataccggatgaactcccccgcccccctcccccctccgactcaatcctgagctgtttttctcctacgtggcatacacatgacgtcgacgtggaaatccaatcagcaaaaagaaataaaagaaaatatagggcccacctatcattacctctcttcccctcccccctcactccctcgggcgtgcgtggacgggctatgggcggcggcggcggcgcgcgaacgggcggttggcatgcggggggtggcgacaaagcgcgagaatggcacgcgggcggcaagcggtgaggagggcgttggaggaggcgggcttcgttgtcatcgtcgtggggagaggggcagatgaggttggaggatgcaccagcgagggagcgccctcctcgccgcaacccgccgcctctcgcgccctctccgtgagtccgcaacactatagccccatcgcctctagcgccctcctcgccgacgcccgtagcccgcggtccgcgtcccgcaccctccctccgcccacccccccccacccccgcccgcgcgcaacgccgtgtgctcgacctgcactggacgacccaaaccctatcaagaacgtcgccgccgctgctgtcagggttatggataccacatacttaatagtagttgactaaatctcggcaggacccaccacataccatgtcttatacggaaacaatattcgaatataggaggagttccgcataaggaaggataactagagttctacatgaaaatgacaaggactactcggattgtatccatattggtttccctagttctacttggacaagaggacacctatgggtataaatacaaagccccctaggaggagagtgaacacggaacaacagaagccacaacatacaagccaacatacgccaagacaagacactagatatcgacttcagagataggcatgactagtcccctacggtgcctacggataccgtcaggagagatatagcgttgtctctgatctcgccggatgcggattcgaggaggaaggctaccctgttgtcgactacgagtcagacattcagaccgccatgtcgacaacacttagataggctaccccaaatattgtacgagtgtgattatggtgaataagagcaataccggcttcggccaataggatgaagggttattacctgacaattcagggggcccgaacctgtataaaaatcctcgtctccgtctcttttacctcaatctcgcatatatcctggtatcaatgatccccatactatgcaaataccggaatcgtgacatcaaacgtcgacagctgccgccacgctggtcgacgccgcccaccactcggagccaggtgacgacacgcggagggagaagctgaggacaaagagagatgaggccatgtcgacccgtcgctgccgcccaccacacgcggagggagaagccgaggatgaagagagacacggccatgtcgacccgctgctgtgcacgctgaccacccgacggcccgagagaggggtgagagagagagagagagaccgatgaccccaggttgaagatgatgatgacgaactcagacggggtggtggtgatggcggcggtcgccgggggctcggagcagaagggcggagacgacctccgcctccaccctcgccacttcgccgccctccatcgcgacaggggggcagcaaggcggcgcggcagcagggggacacgggctcagccacgcccaccgcctgccgcgcccctggcacgcccatcgccggccaccaacttgtcgctcccaacgatatctgagacagagatagagagagattgagaggaagaggggaagagagaggtgggagagtatgacaggtgggccccagcattttaaaaaaatgatgactagattaccacgtgaacgttatgtaggacaataccgatttggattgggtcgaggggggttattcgtccagtatagatatttcaggatataaaatgtctgattttgtggttcaggggtaattcatattgtcgtcatagttcgggacgtaatttgtactttttttctttttttctaattatccaggttgtttggaagatagcattaaggatagccgaattcatttggattgcatctatgtttttagattcctttgggatctgcgagcacatatatttcaatattgttccttttctattcctatctttccaaagaataaattgcacattataccagcttctatttctttataagtggccctcgtggaagtagagatcgagcttatcggccaccatggctagcgctaaagatgcggattaggggcaaccatgtgaaggagagaaagagcttggggttcaacctgatttgaaggaattatcactaaggtcgcggcattgcgcccaagcttgtggaagtttggaagagcatggcagtgagatcgtcctcaaatatagggttctgcctgatttggaggaaaaaaaaacaaaaacttttcaaccatcacatcgaatgtttggacacatgcatagagtattaaatttagaaaaaaaaaaccaattacacagtttgtgtgtaaattacgagacaaatcttttaagcttaattgcgccatgatttgacaatatagtgctacggtaaacatttactaatgacggattaattaggcttaacaaatccgtctcgcggttttctggtgaaatctgtaatttgttttgttattaggctacgtttaatactttaaatgtgtgtttgtatatccgatatgataaccaaacccaaaaaaatttcataaactaaacaaggcctaaggttgtggcaggtagcttgcaatggtggtcgttggttggcttgaaatagtgatgacaaaaaggacaaatgtagcctaactagagacaaagggattgcaagtttacctgattcaaagtaaaaaaaacatgagaacaggtatgttctatgttgcaactgtggtaaagaagccctagaagcgcaggaagagaaccgatggcaaaatgtgtgatgttgttccttataattgagggcaacgaagaacaaaatagtcatgtgaaaaaattaaaccatttactaggaacaaaactcgagaaacatttaggggttttccgactagcttcgcaaggtggttggctagacaacctgagttcgatgtctcacctcttctaattatttaatattaggtcatgccctaatattcacgtctttttttattagtgacaaaacttcatgcgaaatttaaacagaacataatttctgttttttagaactaaccaaggttgtcattatcccgattcgtatctagtatcttacgatattatgatcctaccgagacgaaacgataccgatcccacctagtatcctaatttttataatatcgcgatcctactattcattactacacgatcctacaaaatcttatatggtatcccgattctacgatccctacaatactacaatattatttaaaataacatggtttaaaaaataatgtaactaaatatactcaaatttatatgaaaatcagttcaatatatcaaaaccaacgtggtttctcttgataaatgtctttatttgcatgacatatatcattactatattttttatatagaatggctatatataattaatataaatattaattaaaattaaaaaaaatctcatagtatcccgatactacgatacgatcctacgattcgatattactttgagcaaaatgatactcccaccatctatttttgatagtcatatttccaaatctgaaaattttatttttgataggcatatttcaatccaacaacctatcatcttaatgattttctcgaatttaatgcgtgactctccattcttccacacatgattggctatatgggctttgagaaatgtaaatattaatgaatcgcttgtttacgaggaatgactagtagcatgcttaaatgaatgataagtagaattacttatcattggtctgtgtatcaagatgaaatatgactatcaaaagtagatggagggagtactacttagtatcccgatcctgacaaccttggaactaacataatttctgttgagttactcacagttaacccaagtgccactccttatcagatggtctcaatcccaattaaacaaaccaacatgaggtaaacatgtaaaagctatacttaaaaaaagaagagaaccatcctaggcatgattaattacactcccttccaatagcatcaccacttgcaaatctttcttttttaccctaaaatagcatactatgcgctacttgtagtaaaaacgccaaacgtgccggtaatcccatcctcacgcgaagttaagcatttaacccccttccattaatcacgcgtcctctctcaaacccgtttagtaccactcctgtacgcgtcacgtgtctgaagtctgaacacgctttcccccctcccaaaaagcctttgacagtttgaccccccagtttgacgcgcctctccacgcgccgcgccacgccacgccacgccacgccacgccacgccacgccgcgccgcgccgtatataaaacgcgcgcgcgcgcgctctcctctcagtctctcacacgcaaacgcgaacacgcgaggacatggacgacatggccaagctagctcagatgccgcgcgctcctctgctcgtcctgctgctgatgctgggggtcggcgcggcggtggccgtgccggagtacagggaggcgccgcacttcaccaactcggcggcggcgcggtgcccgccgccgctgccggcgacggacgcggacgcggcgtgctcgccgcacgcggcggtgcacgtggccatgacgctggacgcgccgtacctgaggggcaccatggccgcggtgctctccgtcctccgccacgcctcctgcccggagtccgtccacttccacttcctcgcctcctcctcctcgtcgccggaggcggcggcggcggtgcgggagctgagggacaccgtgcgggcgtcgttcccgtcgctggcgttccgggtgtacccgttcgacgagtccgcgtcgcggggctcatctccacctccatccgcggcgcgctcgaccgcccgctcaactacgcccgctcctacctcgccaccacgctcccgcctgcgtccgccgcgtcgtctacctcgactccgacgtcgtggtcaccgacgacatcgcggcgctcgccgcgacgccgctcccgggggaggcggccgtggcggcgcccgagtactgcggcgccaacttcacggcctacttcacgccggggttctgggcgtcgcgggcgctgtcggaggcggcgttcgcggggcggcgcgcgtgctacttcaacacgggggtgatggtgctcgacctgccccggtggcggcgcgcggggtacacggcgcagatcgaggagtggatggagctgcagagacgggtgcgcatctacgagctgggctcgctgccgccgttcctcctcgtgttcgccggccgcatcgccgccgtcgaccaccgctggaaccagcacggcctcggcggcgacaactaccgggggctctgccgcggcctgcacgccggcgccgtcagcctcctgcactggagcggcaaggggaagccatgggacaggctcgacgccggcaagccgtgcccgctcgacgccgtctgggccaagtacgacctgctccggccggcggcggcgatcgagacctcgtgagatcgactgagctgctcgccttttttttgtttttttagaagaagaaagaatgtgttggttctttggttgttcatagatcatcagagatgtttatgccaagtgtaaatattgtttagaggaatgaacagtgatgatgccaacttttttgatctaaagtttcgagtttttattagatttgaatttcttaagcttttgtgtgtgcccttgtggatgttgtgttcttcgtttggcatgcatgcattgttggtttttaaaaattttatttttgtctacatttctcctagctagctatatatataatggtgccaattagtgtaaataattaatggttgctactatatatactacggggcaaggtttgcactcagttgcctactttggcctgatcttttaattatggcgattgtgcatgtgtctatttcaaacatttttcttgttgttttcaatcaatttggccaatttttaaacactttaacaacgagctgctcttcctttaattaaagcctatgttcttttgtgcctcccactaattttgggcttgattagtggcgaaagctcgtttttagcataatgggtgaagagtgattgtcggattaactgatgcgaccgcgcccatttgccttttgttttatttttatgtgctttttatctttgtgctcccacgccgagctaattatattcacacacactttattagctagatatacaattggatttggaacagcatccatgtggccaccgtggatttcagaaccaagaaaataaaaattccacgaactgagttagctcggcatgttagattctttgggggtagaacatattcattgtattcaattttttatatgcctgtttgtatttatagctaattatttttccatctattgatagtgatgtactcgtcgataacaaaatggatgtgatgaatttattaatcttaacatatgttgatttaatcttgataatgcttgtagagacgagtgtatgcattaatgttgtgtttagaaaattcaaataatcaggaaccaagaaaattagagaaatgtgaggtgtaaaaggatggtttgattcctcttcaaattaaaaaaaatggctgcttcagtgcgtcgccttttgaattaattcggagggctgttttactgcatttgacaaattttaaatatgccgcttacaatctttccagttgtcctggcctgacaacaattgaacagtttcagtttgttgcatacattaaaatttggatcaaactatataataccttcgtcccaaaatataacaaaatccaaaaaaaaaaaatagactcgtcttattattacgaatctaaacagaatatggcaaaagaagatgagattatacatattctatctgtccagatttacaataataaaatgagagtgacatcctagattattttattttagcatgaagaaagtatctacataaccccataaaaaaacctagtccactctttaccgatgcaaatctgtacccaaaaatgaacagtataaagtagcaaccaaactttaacttgtgtgcccttttctccatttcctattcttttaggccagtttctaattggcgcttaaaaaggttttgtgcccaagctgatccgggcactgttccggggcttgctttggaccccccgacatgattgcgccgtcgatcgagttggtgacaatccaacaattaatccatccgggggtatgtgcagcgatggcgccgtttcgaccggggccgtgtacaccgttaggcctgcacttttggaggccattatgtgcatctctcagcctagtatctatctatctatctatctatctatctttgtatagctcatcgatcgatcatcttttttcccgatttgatattttgatttgcggtggcatctccactcctactgatccaatctcctctcctcctccccaagattgatgtcgatcgatccatcgttttatgatcttttcttcgacttgcgcccggctcaaacctgcaatggataatggataaaaattaaatacatataccgatatacgtaacataagaaaaccattagcgtatgattaattaagttttaatatttttaagcttgagaattggatttatatggtattttaaagcaacctatataaaaagttttaatatgaaacatacagtttagtttgaagaacgtgctaacaagaatcaaatatgtatcttaatcagaaaacatgtatcttaatcagaaaacaacgagaccaaattagctaatgattcgctgttatggctgcaactaggagatggagggtactcgcatgctgcggatggccagctcccaatgcgtggtcacaataggggaacgagttttaatcctttgacagaatgttccaagtgtgtactccatttttgcatagcttggtcatgtctcatcagtgctagccacacgcccgcaccccaagtgtcacgctctatggaaaggattaatgcgacagtttttcgaaaagtatggaaaggatttgtgcaagttgggatttttgtgttttatacattgttctaggttgttggaattaaatttgcgcattccatcaagacaaatctattcatataatttttacattttcaaacttaacaacttaagagttattcatgatttatattcctaaggtttgacttaaacatggttctaaacaatttcctttacaagtacgaaggaagtagtttggttatgcgtgcatcttagttacagagaggctagtagtattcttagtacgatattatatcatcttatataattgatggggtttaatattttttattatcttagaaaattatgccatggccaaaaaaaagcagcaggtaagttgcttgcgtgatgttggatttggcttgggacgctgcagatcctttggcgagtggattatcactagatgcagtacgtacgtacatgcgcgggatcgtgctgttaacttcactaggataacaagaagatacacacttcttgcaaaaaaaggagaagcaaaagaaaaaagttgcttgcaaatatgcacttcgttttctttgcacttatattaatattcagtgctgttttttttccttttttgagattgagagagacatgcaatgtttattcggtgtcacattgtgagatgtgagagttccaacttgcaagttgtaagtgcttacgtattctgtgtgatcagcagataagatcccggttaacgtaaaaggaaaagttcacttttaagttctttgtctaagtgtttagtttgaatcgtgtcccttaatatcctttctctctcgaaatcaatgcaaacgagattccaaacggtattaaggtcagtttcaactcacgtgacatctatatggtttgttgacttagtctttatcctacaaggcattacatgcgaaaataaaaataaaatccctaattcgggacctacatgtcaccgagatatccttcatctacttctccctctcttcttacacatgttgtattcaaggtggtgagctcaacgagaggtgctcgtcggcgtcgacgccaacaccggcgatacatcagcctcctcatgagttgcgttggaggaggatcaccaccattgcctggacacatttcgcccatgtttgatggggcgctcattggcgttgatgtcaacaatgacaacacaactcatggcttccctatggtggaggtgcaggtgccagcctatcagaccccctctcgtcgacgttcaaggcaagtggcagactatgttgcgtgaagctcgttccccagcactgcccgtggtggtggagggcagcaggccttagatcgggcgcgcgacaggactccattgtcctagaaccccaagccttgccactgcgggaggaaggcatgaggtggggcgagaaggaggagcttggtggtggcatccacctcggtgcgctaaacaagctggagttggcaacgatgaaggacgacactgacgagaggccagcatataaaggaagcgctgctgagggactagcggggaggccgacgagcttcctccaccttctccgaacgctagcgccaccatcctgtgtccactaggcttgtgggtcatgggctcacggcatggatttgggcccatcgaccacagtgtgatcccaccacctcctatccttgttccatgagggcaccaaccgtgtgggatctcaacaggaacatcggcccgagaagagttgtgtcacatcaacaatgcacccccaccccaaatctccattcctccttgccgtcgtctgcctctctttctctctctctcttcactgggataatgggataaagggagagaaaaggggagagggaggagggatctctaggctatatataattaccatgttgtactgcgtggaagcttccaccgtccttgtcaccagcatcagtgatgagcacgtttcccagcctaccgtcgtcatcgactcgttctgctcgctggtggagagaaaagatggtaggggtagaataggaagaagtggatgtcaatggcatgtgggttataatctttttgtttgattgatatataggccccacatatttttttttgaaacaaataattttgtttccactatcacatcaatgttacatgggataagtgccaagtcaaactgtcacccaggcaccatgtcagtaaaacctacctcagtaccgccttaggacctcattttcattgattttaggagataagagatgagttataccttggttttatggttgagaaacgcgattcaaactcgccgtaaaagtgaacttttttcaatgtaaaaagcttcatgtccagtcgccctgttgggctgatacttgccatatgggtcttcaagaatgttgattactaggccagtcctcggggactttcatggcccttgttcaggccgatctaaagccagaaggcccataaaaaagactgaaagttttgactgctatttctttttttatcctataatactttacaagtgatccccactaactcaatttcctgtactgtggttcatccacgtcatccaaatcaacagcagccggagagtccgatgggatcaccgcggaccccaaatgggagccagaagaagccggttctcggcaaggtgaagagcaaggctaagaaatggatgcacctactgcatcacaagaagaagccgcaagaggacatgcaggacccagtgcagacggcagcagcagcaatgagcacaacaatgcagactacggatccccaagcacagctcgacatccatccccattcctgtatgtctgccagacttcacaatattgcatacattggacaatctgttaattgaaatgaaaaaaaaaaaagaagagcaccacctcttctccagttaaattcagtcaagatatcaattccagtataattttgttatgatgaagagtaatacatgtgttttccatgtgaattgtagcgtgtgaatcagcatgtgcacctgaggtatacatggaagcatcaccaaggcaaaattcaccactcccgagcccaactgcacacaatgaacaacaatacttcaagatcagcagcaggtttaagtcagaaatgaaggaagccatgctgagggaatcgaagcagctgcgtgtcaacacaaccaaaccgaagactgtaacatttgcgccaatcttagaacagggggcagaaactgtaaaaaatgattggcacagaaaagaactgtgggaaacagcaaccgagatattcagtcatgcatatgctatagtctatgaggcagtcctcaggatggtctctataatccaagacgcaatgttatcatataatattggcagaaggcaaatgttagagaagatcatatcgttcaatagatacctgatgctgaagctggcacctggagaaggtgataaagtactctcaaaagtcattactgaggctgccctcgatatgttttatgcctggtgtgtgaatgttgagaggcctttggtacagagggcaaaggaagtgttttcttggtttctgccagaaaggagagaagagttacctccatcctgttgcactgtccacccatccttgtgtttatgaaggtaagtttcaccaagtatgcaagggtagtcctatctgcagaatattattatagggtttagcaataacttgaagcctgtgcaatgaagatgcagaagaattctcattagagaattgactacggcttgaagcacgagatcaagactctatgaaacaacataagtagagagagatgtttaccttacaatgtccgaagaccggaggcgaagacagagtgtttgccccaagtatactttgttcatagaattacatcataccttacaatggcaggctgcatgtgaaaccaaaaggaggtttatgtggctgtgtaccagaaactaatgtacaagattgcaatcttaagtgtctcttcagataaagctcagtaccagagattagattcacaatcagtgaccacaaattccacaatgtaggcagaacagaaatattgaaacaaaacgaaaatcctccaactgcagaactacaattactctggaaagaagtatatatttctttgaacgagcaactagccctcacattcttgtcttatttattttggacataaccatgccatgattagcacaaaaagaacacacaagtagttcaaactagaaagtttaccagcttatattcatattacaaagaaaataaaatacatcttgctccaaatcactgttacaaacatgccatctcagcccttttaatgggacaccattcagaattatgagttcagtacatacattgtgtatattaacatccgcacatactataatgacagcaggcctgtcagtctctcactgcagctcgtaggacgaaaaggtaaatccagaatctttctcattggtacacttcagttcaagcttctgaaacggactgtaaattgagagagcaggaaatatttatatcacttcaattcctcgatagaatttagttgtaacatcgcaataaaaagtgccagcaaaatatacattacctgctgtttggatcataataatacccgctaatggaaccgtcgctacatgaaaagcagacatagtagaaaccagctatggtcaacccacagtccactccaacattgacaaagtactgctctttccatctctacatgtagcatcagaataatgctaagttgttatggctttgtaattcaataaatggtgcacatacatgaaaggtcagatggtgcagtaccatgaatatgtaagcatagttgctgaggtccacggacttgccaccatctgtctcaatctgactctgtggaaaaacataagtgagaaatgtatccaaaaaaatcgtggcaactaacaacacgaagataggcaacagaataccagaagaggcgtaaatgatgggaacttggaccagtgtctaatatcatcctctgggctgcaaaagcagaagcaggagtaatgtttcatgagtaagtttggactgttaccatacacttgggcatctattaataaaacaagtagatgatagtatcaaggataaaacgtaaatagttaaatactcacgatgcttcccacttgccagtgaaaaatgtataatttttagcatccactatctccccctcccagaacgttaccacctatggaaattatttgcaaattgctatgcaaatcagataatgggaacaagaagtaaagcatagcatattttaaaattttatcggacaaactgtttgcctactgaattagtatacaaatgtattcttaatgaacaattttggaacataaagatcagagtcaaagtggaaaacaaagttgaacaattttggaacataaagatcagagtcaaagtggaaaatgaagtaggttgctcacaggggtatcagctaagggaacattaagtgcttccattgttccacataaataaccctgttcaagatcacagccatggatccgcacattaactttccaagcttcttctttttgtatattagagacattctgggttccagcataacactgaaagatggtacaagcatatggtcagttccataaaccacaccgataagaagatttgatccttggtcaagttccaaataacaacacaaaaagacttactcttccagcacttaagagggaacagctaggaggagacggatgcccagcatttgcatcttgacctgcaacattttaatcagtatggcacattggcatggtgggctatctattgccagaaattcatacaaaataactaatgaatttcaattgcaggtgaactaaaacaacaattggtttatttatttagaaggcctcctgaaacagaaaacacttgacacaaaaccacaagcattgcaacgccttaaaaacatacaatacattacaagcagttggcaacttagctacaaaaccatccgagctctccccaaataatgcattgcgtcagtggccaaaattataacaattgagtattccaaaaggatcaaaacacatataccccagtacaactcagaccaatctagattaccaatagaccttaaaatcgcactaaatcaaaccctagaagatacctgattaggctatatcagatccaaaaaaacttggattacacagcaaattaggggttgggtgcattagcatagagaaggtaggggaggtggacgaacctgatgagggctgggaggaaggggttgcggtgtctaccaccctcaccggcatcctcggcggcggtcgccggcgacgacgaggctggttcgatgtctcgagaaaaacacaaaataccttatgaaggatgctcacaggcgagcgacgatgcggcggaagcaggactgcaggaggaccacgggcgccgacctctgctcgccggattggggtggttcggcacaagcggcgggcgaggagaccgaaattcgaggccggacgggatggattaggatgctcaccggtgagcgatgatgcggcgggagcaggagaacgccggcgccacctctgctagcaggatggagatcggcgccggcggcaggcggaggagacgggagtcgtcgacggcggcgggcgacgagacgggatggattggggaggcggaggtcgattgtgcagcgctctgctgccgcagtgcccgcttgcctatgggtcatatcatatgcacaggcccatgaggctggaaatttttcatctcggaagaagttcacctaaggtcccttatcttgtcgtcgagttttaaaactgtccctaaccggaagaccagatgtaatgtatccctaatattgtaaaacgggtcacatttgatctcaaggtatgctctccggttttgttaacgtgacggctgagtcagtatggtacccacgtggacaccacatgtcagccggcaattttcttccacctcactcccctttcttcccatctcaacccaaacctctagggcagccgtgaatcggtggggagaatggtgttagccggtggggaaaagctcccaacggcctggagcgctcgcgtcatggacttgtgcacgcgtggtacgggcaggtcccaactacaacagcaacgtcgtcttcacctatgtgcgcgagggctagggcttccgcctcgtcacgctggccaagctcctatccctcgagctcagggccatccctgctgagctactcaaaagtcgatgtgttcaggtgtccccgagctctgcctctcctccgcggaggagcacgcgcggctccgccgcatcatcttcgagatcaactccatttacaccacgatgtggttacatcatcctcgatgcctacgcccttctccctgtcgcccgccactatcaagcttctcgacagctgccagccttctccccgcccatcgttggtcgtcgctgtcgagcttctacctaccgccgccggccaccgagtagctctcccttgattcaacattcgacgtcctcttcatgtgcacgcacggacactcatggagccggtggtgctcgtgaccgtgctcaggcatctcaatgtactccatctcccgtctcttaggagatcctctcaccaatcccgatggtgtggctgacacgtgaccaagacgcagatgcgcgcgagctgccgcacaacggcgtggcggtgtgccctgaggggacgacgtgccgggagcccttcctacttcgcttctccgcactcttcaccgagctcggccgctctttgcacgcgcatgtgcatgacgcggccgttagccaccacttttctcctcacatgttgccggctgccctggagttttgggttgagatgggaagagacaggagataggtggaagaagattatcggctaacatgtggggcccatattggcccacgctgactcaatcgtccacgtcaccaaaaccgaggagcaatgtttccttgggacctaacttgacctagttttgcaaaatcagggatgctttatattagtatttcggtttagggtgtaggatcgagatttcgactagagggggtgcataggcgatttaaaactaaatgacacctaatcaaaactaacctaagttactaggctcggtgagggtcaagtctaactaagcaactaagttatgttttacaaacctagggtgatagtggctcaattatatctctaggaaagtaaattacactcctaagttcagtttagcaatcctagggtgatatgatctcaagtatgtctctatcaatgtaaattgcacaaatataaatgcgataaataaatgagacaaggagacaagagatttttcaccgaggttcggaaactcgccgctttcctaatccccgttgaggcaagcccaactccaccgctcaatcacgaagccaccccacgtccccttcgtcaaggggtgggcaaggcgggagctgacccactgttgatggtcgttagcgatcagtttcgaccgtcaatattaccaaaatagaggagaactagttattcttgcaatgcatattcaatttagaataataatattccattagtattatgtttactaacctttttgcagagaataaccataaagtgaaggagaattgacatcgaatcagacaataaatcaattgaacgatgtcgaaaaccagacttatgtatgaatgtgccaagaactcagaaatgatacgaccaattgggccaaaaattcacaagtctacggagagaagcagtggaggaggtcgccagccaaggatgggctggtttggcctagcccctggtggttcggccgaacccccattagtgccgtccatcttggggttttgtgtggacgtccaggattcatccccatgaacggttgcagggcaattaggacatttccaactgccacaaccgtcattagcagctataaaaggactttacctcctcactctcttcacacacctcaagcaaagctctttcatattctctaaagtttagtttagtgttcttaagctaatggaataggaatagagtagaaatcaaagtccagaagacttcagaagagctctcttcacacacctcaagcaaaactctttcatattctctaaagtttagtttagtgttcttaagctaatggaataggaatagagtagaaatcaaagtccagaagacttcagaagagcttgggtatggctctagtagctcttctcttctcttttgtaagctttatactttatttagaatactcttctttatacatttctgatattgaaatactttccaagtatacagcaacaggtagacttttttatgagaagacgtgcggggggacgaggttcatcatggcagcaggatcccgtttttccccttttttttatgaggtgcgcatgatccatttctctaatcgatacgctacgaaacagaaccgttatatatagccgtacgcccaattctcactaacttgacttaattaattgcaacagggtttgattatacaaacacaaatctaattttagtcaacaatactgcgctcatcatggttgtactgattccaacaaaacacctgttcaatcacacatccacatattcagttcaaactgattcaaacatgtgctcgtcatggttggactcttctgaagaatgattaacccaaagcagctatgctgctgttcctcagattgacttaaacacagtatagctcaccatacacatgcaaacattcaggctgtgttcggtatcacgagttcccaactctctcttctcgttttccacgtgcacgtttttcaaactactaaacggtgtgttttttgcaaaaaaaaaattatatacgaaagttgcttaaaaatcatattgatgcatttttttaaaaaaattagctaatacttaattaatcacgcgctaatggactgctccgttttccatgcgtgggtgatagattcccaacacccaccactgaacacagccagagtcgacatccttacagtgtttattggaccaagccatgctggatattttgggtgaaaaatcaacatgcagccagcagcacatctctaagacttggagaccatatcaagttcaacaggaacgcgccaatgaaccaggcgaaaagggcaacaatgaagcagatggtgatccctcagtggaacggtgagaaccagaaacaacagagcccgagtgtgtagaaggcaaagcaactgaaccaactgaaccagtcgaagcagaggcagtgaggcgacgtagcaacgtaaggttctcctatgtatctgagcttccagtacactcctctaagaagaactaccagtactcttcggagtactcttcggagaagaacctctggtaacctgtgaagaacgaccacgtcgcaaatccttcttccaaaagcaaaacgattccacatgtccatccttatcataataagtgtaataaagatgactactggtagatagcacaactggtgaagaagtacgtgatggcaaagtaaaggaagcggctgtcggtgatgaaggtaccgaagctgtagtacgaacagccagaaggaagcactagagcacccgcttcacgaagacgaatctccggaagagcttccatcaaagtaacacgagggtgtcgagcaagcaactgtgcacgagtcgattcatactcggagcgaagacgagtgagaaagtcatagatgcgacgaagatccatgtgagaacgctgacgctgacaacacttacaggtacgacaaacatcagggaccaaagaatcaagctggcaccaaatagaggatagctgtgtagtctgtgtatagaactcatccactaaagcatccctctgctgtaaagactgctcttgacgcaccatagcaagataaagagcatcaccgatagacacataacgatcacgaaggtgtgtccacacaagatgagcagaagcaaggatgaccacatcgccagtaagatgaacctccatactagccacaagaatagcagaagcacgagcatcctcatctaaccaagccttgtacatagcatattgactctgataagtctccataacatcagcataagtctttcgcacctttgctctgtcctcatcagtaggctaacccgaaagaacaggcagaaggaacctcggggcaagccagaaaaagtagctcaccagaaataacatcccaaagacgctgaccacgcatgtgaagacgcatatgctgagtccaatgattatagttgacaccatcaaaaataaccgggcaacaagaaactgaaactatgtccgacaaagatgacatcatcaaagagcaatggctgacgacgagagcgcaaaagtaaagcggcggtagcaagcagagaagcgggaaattctttcttttctttctttttccttttcttttctttttttatagcctcggtcacagaaaagatcaggagaggcggctatgttttttctgttttgtttttttaagcctcggtcacagaaaagactaggagaggcgtgggtgttgctaatgcgcgccctcattcccctcccccctatgcgctttctccccttcctcctcccctccttctcttcctatacagtacaccacaaaaaataaaaagaaaaaaataaagttagaaaaaatttatgtatagaaatactataaaaaatatttgaattcaaattcaaatttgaaacgggtatgtaaacttttgacttataaactttgggtctataaactaatattagaatttaaatttaaatttgaaacgggtatgtaaacttttgacttataaactttagatctataaactaatatttgaattcaaattcaaatttgaatcggttatgtaaacttttcacttataaactttgggtctataaactttagactttaggttataaactttagatgcatagaaatactatatatataaaaaatatttgaattcaaattcaaatttgaatcagatataattcaaattcaaatttgaaacgggtatataaacttttgacttataaactttaggtatataaattttaggtgtataaactttagatgtatagaaatactatatataaaaatatttgaattcaaaattaaatttgaatcagatatataaacttttgacttataaatttttagtctctaaaatagaacttttagaactttaggtgcatttcactaaaatagaaaatagaaaagtaatacggtggaaaaaaaaaaccaggtggagggtgcggggaccgcgccaggccaggaagcgatcgcccgccgcccgcccttagcctttccggagaggcgtggcttttattttttttaaggatcttatccagatcggtcaaaagaagaaaaaaaatgaaaacgaaacgtcgaaggctcgaagccgtacagatcgaagccgcgcacgaaggcgagcagccgcgaacttgcgcagccggtggcgagtggctgccgacgacgggcgacggccagcggccctcggcgacgggcaacgaccagcgacagccggcgacgagcccccgcccccacgaggccccgacggccagcaacggctggcgacgggcggccggcgacgacgagcgacggtagcagcagagctagccacggacggcggctgtgacgagcaacgccgacaatgaggcagcaacagtaacccaggtactcgatagaaaaatcgatgcacggaagtgccgaaaaaattggatcatctaaggcaagaggagtctaaccctagtttggctcttgataccatgctgtgaatagcacttgtattcatcccagggcaaaggcccaaatatgtgcatacatgtacaggtgcatacaaatatgcagaaaacccctttacaaataaagaaatataaccgaaactgacatctaacacagccatccaattactagcactcagcttgatgctattggagtattaattgaaggaagaggagtgtaattacttacctgaaaaaaaaaagaaacataaactaattaacccttgtatgttttcaatgatgaaatctgaaacgaattccattcaaacctattaataacaagaaaggataaaatagaacaatggatgcatatgagactgccaacatacatctaattttaccaagaccaactagaatggcaaaaatttctggagttacagattatcaacatatataaaggtagcgaaatgaagcatgacttttagaagtagcatatggtccgccaaatgaaattgtaggagttacagacttacacagaaatctcgatattccacaacaatagtagcatatggtctgccaatcctaacttttaggatgtacctgcaagcattacacacgactttttggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttcaagcgcatctctgtatcgacaaaataactctatctaagggtgacgtcggtggaaccggtgaaccacgcgagctggttagatgcgtggggcagagggctcgtagtacccccttttcttgatccagccttttcttcgctcggtagttaagaacctaaaatccaaggggggctgatctttaagatagtgttattaaagtcgtcgatgctacaagtcatgcaagctgttcttgttatgacctgtgcaatgcataacggaagcatcttggccttcttacctcaatctgacatttgttccgttatacgaatcataaggcatctcaacagtagagaactcaaatggataagtcttcctttcatagatttcaccagcgacatctaattctcgcactacacagacaaaaaaaaggagaaaaatacttaagatactgaacagctttactggcttacaactgaacagcaagctctaagtcatattccattatttgtagataggaaagttttcagagggttcaattttcctgctaaacttgcaagatagtgctcttggggtcaatcaacaatgtaaagcatcaaaatttatcaagatatgaagagtgcaaagaacctgaagggaacaatgacatacaagaagagatgcaaaaagatcaagactaccttaatagagagctctttttccttgactcttcaaaatcacttgagagagctacctaacgaagtgaagtcatagaagtggcctctctcatggtacagctctgcaatataaaagatcacaggtaataataatgttagaacttggaagtacctgaactattgaagatcaatgctgctgataatggtagaagaaaagaagtgctcatgtgagtactttttccagtttctcaagcaattaaatcctatactttatcatggttatgagaatttgaaacaacattggctgggtaaatactctaatgaattttcagcggaacaaagaacctgtccgttcacatttgtttgtctacaaacaaatcacattttcagcaacctgaactaacatgtcttataatacaccaccaatttgatgcagtcaccataggcattagggcactcatattcagaatctaccagatcaagggcgcatatcatacctatctgacccagaagctcaatcttgacaccttggtgctcaacccttttacctggaatgggcgctatcgacacctgcaaatcaattcaatcacaatcacacacactcccatctccaacaccagaacacacaccacccaagcagacagtgtggcactacctctcctgcaatcgtctccaggctctggaaggccaggaccatcctattctatcatcaagctgtaatttcaggacaaaacagaaacacatcacccgcgaatacttctcaattggatacttggaaggacagaatcactccaagatcagttctaataaataggcagtatctagcacacctaaacaaacatgaagtaagctcaaaatatagaagaacacagaagcattttggttagttcaaggtcatataaaaatctggtgctctgtcttcacatgaaagaaatggatagccaactgcagaccagaccattgagcttcaagcaaagaagataaccagtacatagtggcatagtgcagtgtggatttatgctttctactataggttttctggtattgcattaggaaccttaatcaaaattggcatcagttcacaaatagtgatattgagttatcaatctccgaccaaaaacattaagagaacctaagtatgttatatctctttgtcaaaactgagaaacatccattaacagagaatattaagaagaaacatccattaacattaagaaatattactagcggcctccttatttcatatgtataatataaagaaccaactaccgtggttagtttgagattcttgttagttttcagcttccctgacacaagtccagtattccattaatgaaatgacctatggaagatacagttccaaagagtattcaccctccagctattgaagagacccatgcaactagatgaatacacaaccacaagtacaggaaaccattcttagttttaggcttttagcatttatgtttactggtaatatcttaattttatttccaaatttcaagtttgaacaacacatatgtcagcaatgtaacaggacaaatcaagaacataacaaaaaaaaaaaatccttcgtactaaccagactttctagccccaagtgttacgaaattatcttcaaa

SEQ ID NO: 68045 - DNA, 703 bp, Oryza sativa
cttgatatcttgttcatccatgatgtgagcaacggatgtatccgtagtagccatggtcacatcatcctccccttcttcacagaaaaccgtcctcggtttttccatatggtgctctttgcgtagtccatttacagcaacctgtttcttccaattaaaacaaggcaaactcgagacaatttggttagcaataacatttctctctagcttgtatgttttatccacatgtacaggaagttctaaatccgagcagatgtaaagtctatgcacaaaatatattccaagatcattatattcgccaaagatgtgaaatataacattggttggacatggcaaatcaaaatgagcaaatattttgtccttcaaacaattgagctcacaagaatcatcaaacagaatatagcccaatgtatttaaagaagattgcaattgaagttcatcattctcgctggacgtgtgaataacatgcttaaattaaattcagtacatggagaatcaagattaaacgtagcatgttcattcactagttgtggaatggatataagtgaaatactatcatacaactcttctttatcacaaggaatagaatgcaaatcaacttgtgacaaaggcaattcagaagtaggttccactaaagtttgctctaggtcagcatggaaagtggaaaaatgtaattcatcagaagcatactcacttgagtaatttt

SEQ ID NO: 68046 - DNA, 5730 bp, Oryza sativa
  unsure (1)..(5730): unsure at all n locations
nnnnnnnnnnnnnnnnnnnnnnnnnnnnnnnnnnnnnnnnnnnnnnnnnnnnncgcataccataaacatgacaaaggtagtacacatgcacagatgtaaaagaagtgataccttacctttttttgcagcttcatgaagaggagcaaagcctgctgcatctttcttattcggatcagcacctttgtcaagaaaatacttcacagtaatctcttgtccatccaacacagcgcaaaacaaaggtgtcatacctagcaagggcattacaaacaagaaatttaatcagataactccaacaaaacgatacaggtagtgttgtggtataacagctttgcaaatgcacaaatattagctgctacaattccaaatatgcaaaggagcacttcatgaaatacttatagctcagactgcatttatatgacatgcaatattaaacaatggaatcattcagaaacaccacttaataagttcatatcaacaaggataatactatagttaaaactatacaaaactcccatttcccaagttcttagaaccaaaatttgatggcatgtatataccacgcaaaaggaactagaagaaaaatcaagtgcataatagatgagcttcacaaagtgaactgcatgcattgtctagacacaactgtaccaatcaagagtaggcaaaagcaatataaaaaggaaggctgaaggagataatccttcaaataagaataaaaaggcatatcaccaacactttgctattgtgattctttcttggatgatgttttcttatattatctatggcccgttacaaaaaacaaattactagattagtgcaggaattgagttttcttcagggaaattcttgcagtactccctcagaaaatactacctcacaagacatcatacattcatacgtcccaaaggtgccacagaattgtttgttttcattaaaaaaggtgactagtcaagaaacaacacttaagaatcaaattatagtactaaacggatttattcacatagcagtgttacattggtgtgccaattcagatagcagcatgtcagcactatagttaatgtctccatgataaggtaaagacagttcctgaccctatcaagactaacctcctcacatacaacagctcccattacaattgcattgctcacgggagatgcactaagcataataaaacaatgcaataacctggaaaggcacataccggaatcatgattagcttcggcattgacatcgaacccaagctcctccaccaagtacttgcagagatcaatttttcccgagcttgctgcctcaaacagtggctcatacccctccatcctcacagaggtgagcgattgccgatcatcctcatccatgctatcaaccacctcttcaataccgaaagtttcaaaagaaaagtaaggcgcaaatttgcacaaattgtaattctagttcatgcagaagttgtttttttttgtgtgtgcatgtgcataaaacaagatcaaagttctagagaaatggagacacaagtacctcacgaaaatcacatctaagcacttagaaaagaaaacaaaaccaagtggaagagatctcttacagaaatatggcatcataaagataagtagtattagtaattattaatcaaaagaaaacaaaaccaagaggaagagacctctaacagaaatatggcatcataaagagaagtattattagtaattattaatccctattaagaataatggcaaacaaacaaattcatatccagattactagattagtaccaatttgaaccaaaaatagacaggaaaaccctccgccgcattaaacacacatacacttctatcaacaacacgcacgatcggggtatacacgatcatatcgtaacggaaccagaaacgatgcatgaggctaaaagccatctcatccaattgtttacacaaatgcacaaaaagatgggagaacacatttgagtagaatatcccccaacaaagccggcacagaaaatgctgaaaaaaagttcccgatcaccagttcaccaccacacggaagctaaaaaaaaaagccctcaaaaccctaaccaaacccctatcccaggaagaagcacgagcagttcgggagtaagacgggcgcggggtagagccgtaggatctcacccttgaggcgcgcgacgtcgccgtccgtacacgccatcaggaactccatctgcggtggcatcccgccgccgacatctgcaaacacgcacgcacgcacgcacgacgaacaacaccacccaacccaccattagagatcccttccggagagcagaatcagcccgagcagaaacgatcggggagcagcggacagcggccgcttagcacgtactgatggtgcacccgaagccaaggcgggtggcgatgccgctgattgccgcggccgccgcctccgcctgctggccacgcgcatcgctcccgcgccgccccattcccggccctcctcctccgctccctccaccgccgcgatccacaccaccaccaccaccaccaccgccgccgccgcctccgcctccgccgtcgcggccgcggtgccttcccttatccttcttctccatggagctcagcgagcacggcgagcagaatgggatgggggcgaatgggcgatgtgggttttgcttgcgagaagcggagagacgaggcgatggcttctaggagaatgaaggaaggtggccacgtctcgtccgctttaatcgcagcgcagcgcggagggattgagatcatctctctccgccgcctccgaagcaccttgcctttagtcactgacaggtgggtccatggttcgtcgggaccacatgtcagtgactaaggcatatacataccgaccttttgaaggtagaggagcctgacccagcgggggagaggagggagagagaaagtccggagtggcacgatcggccgacacgtgtatgtacggacggcctagatggagcggggagctgcggccttgcctcgcatgagacggagggcggagattgtgggacgtgccgcgtgtaaaatggtaggtgtaccaaaatatataccagcgtcaacgagatggtcgctgccctgcacttcgccgtgcatttctcctcaagtggataaagctcaagattctctctctctgtgatccaattgtgaaatcatttgctgcagagtttttctttgtaaattcaggtctttcaaaaatagttttttttgggcagatgtgactactaataactattccctccctaaaaaaaaccaatttgtgtagattcgttggggaggggtcacacccctcctaggttgccctccttttttttttaatggagggattacgatctaattaaggtgcttgtcgagcaagaagacgcatgatgatgaggctgccgaatggtggagctcatccttcactttccttttatatatacagtggataactggagatcgtcaccagacaacagcgtacggagatttttctttccttatacttcgcccgtcccaaaatatatatacattttataggttgacacgagtattaagaaggtagatgagaccgtgagaataattggagaaaatacataattggttgaaaagagaaagcagctgaagaagaatggttgtgattagttgataggaggtaggtggagaaatagctttattttgagacaagacactgtgctaaaaatagcttcatttagagacggagatagtatatgcatatgggctaaggggattagggtaagtaggtggcgtgcacatagtaaaggattgcaactgcgaagccacagaccttgcctttaagcaataactatgcaagccacgctatgcgtgtctctagcctatgtgacacacgaaatcagcccaaggccattcaactccacagtgcatgttacttcttttgcatggctttgattggggcgagctagtgtcgagactacaaagctcacaatacaggtgaccaagacaatgaaggtgccccagcccaataaattaattcccccagctacccttctcctctctcttccctatcggcatcgcctccctcaacctgttgcccaccgcctgagctccctctccttcgcctctctcctccctatcgccatcgcctctctcaaccaggcgtcacggccgcaaatgcaccacttctcgaagaagaggaagtcgtcgtcgtcttcctcgtcatccgcacatggctccgctctgtctcctgggcgtggaagaggaagttgccgtcgttgtccagcccgtcgatggcgaagtcaaggatccacctcacggcggaggtggcaggatgaaagtgcgacgcttggcctcatagtggctccactccgtttcctccgctgtgtggatgaggaagttgtcatcgtcatccagcccaccggcgacgaagttgaggatccgcctcatggcggcggcggtgaggcagaagcgcgacgcttggccttgtagtggctccactccaactcctccgtggcgtggaagaggaagtcgtcgtcatcatctagcccgccagcggcgaagtcgaggatccacctcacatcgacggtgctccgttggcctccgtgcgtttctccgaaggggatggcgaggtttgtgcgggagtgacggaatcggtggcatgggagggatcaatccatggccgggagggtgattttgggaataggtttttcgatgtggcgcgaggagacgacgagatggaggctcgaccccaacaacgcaggcacgattcgtttgtgggccatgtgtggactcacgaagagcgagaaaactcatctccctgcgtggaggtgagatgctctgcagggatgcgcaattactcgccacgtaggcattcatttgagctggcggcacaaagaaactcaccacgcaaacacactgtgaagggcctaagcgtaaatggcatggggtgggccagaaacgtgtgtgtttcccatgttaatattttttttcgtacgtgtagtattattatatcgaagaaaatatggtgaactaatattaacatttttttctgcagtagctatgtaatggacgtgcactagagttcttcacaaattctactttcgagatgaccgttaattgaatagttgtaattttgagcaaatatttgctacttcctccgtttcatatatatatatatatatattaatgaatctagacatatgtgtatgcctagattcattaacatatatatgattgtgggtaatgctataaagtcttataactgaaacggaggtagtactagacagtaaaaaaaaagaatttggtattaagtgctgatattacttagttaaagagtgattaatcggttatcactcatgtaattttcaaaagacaatactgagttaatacgtctaatagattttttttatacagaacgcatgtgcgcgcatccatcactatacacatttgtgtgtgcgtaatatttatggagattgaaatttaaatcccgatgataataaggtgacaacgatacataaaagttaaataaatatgaacatatacaaattacatagacatacattcagtaccaactaatgataataatagagtaaagtccatcaccggtccctaaacttgtaccgctgtgttatcccggtccctaaactcacaaatcgactgttcaggtcctcaaacttgttcgattgtgtcatcccggtccctaaacttgcagatcactcgtttaggtctaccaacttgtttagttgtgtcactccggtccctaaacttggatttgaatatcatatagatcaaataggacggt

SEQ ID NO: 68047 - DNA, 1294 bp, Oryza sativa
tttgggaccctaaacagttttaattcaaacacttctcaactacaaagttgtaggtcacgtcgagggctacaattttgatataaagttcatcttcattagagttcacatgaaaaagttatgaattattttttgatataaaatttttagactgtactgtttagggaccagggtgacacaactgaacaagttggaggacctaaacgagtgatttgcaagtttagggaccggaataacacagtcgaacaagtttgaggaactgaacggtcgatttgcgagtttagggaccaggatgacacaacggtacaagtttagggaccggtgattgactttactcataataatatctgaacttgatcggacattgtatagtagtactgaactcggaatgaacaacaggtaacaatctgatagaaaatagtgtcaagatccgttatgatgaaaattaaaaacacattgcaggagcacaatcagagcaaaattcatctccaaattgttaaccacgagcataaagactccagccacgagcaactttgtccacacgtcatttcacttaacgtttcacgtcagtcaaataatgggattggatcacaggtaaaataattccacatcgcaaacacaaaatggagtgcggagtaatagtttgctgagaaaaacatgattataacatcagaagataatgcccaaattatgttctacaggcagatgattcctatcctacaacataatcggtcaacagaacctagctaaagttctttttcacatgctattgtgcatgtatgggtgctttcaaattatctaggggatacaaaaagacttgttttcttggataatgctacgcaaagatctgagcggctgagcatcattgcattaatgaatgctccaaaacagactaaataattctattatacttacacaaggtgcaagtacaaaatttgatcatttctatgggaaagacaaataaatagctaaaaataaacaagtctctggccatatcaataaattaattcctaataaacaccttccacatgaatcatgatcaagttaaattgaatttagtcagtatattgtgtgctcaattgacaagtggcatgcagctaaaatgtccattatgtagagtttataaattgttttatactttaattagatatgtgcagatagatggtttaaaatcaattgcataggacatggccaacgctttgcaaatttacacggataataaatgtatgactaaatcagttctgggacattacgaagtggtatctgcagaaatcctctcctgttggagaaatgtcag

SEQ ID NO: 68048 - DNA, 1836 bp, Oryza sativa
  unsure (1)..(1836): unsure at all n locations
aattaacaaattgagctaagcaacaccagctttattcaaggcacttatactgcttaccacctcctaacataggatggtgaggagtgctgctgataaacgctccacccggagtagatggacaccaagacgatctgcacggagattgtattctgagttccgagaaggcgagaacatgttattgtgatataaaagttagtgcctttgcagtaatgcacatacaagtccaagccactaaaggtttattaaggtccctgaaattacaagtagaagttgataaaaacagagcagctatccagtgctattacagttagtgtcaaatttcaaatgtacatgcaaacccatttcaaaggattgctgtgagagtaattttcccttaagaaatataactgaagatagtgtgtggagtcaaaattacaacagttctcatagatttatgaaaaatttctgatgtactccctccgtcccataaaaaaccaacctagtactggtgtgacacatcctagtactatgaatctagacatacctctgtccagattcgttgtactaaatgtgtcacatccagtcctagattcatttttttcgggatggagggagtaaaaggattagcagaatgtttactgaatggtagatagtactcgagtagtatttatttagtcaagataattcagaaatatttgtaacaagcactaatgctatataactagtagcatgtatgaagttactgggtcaacaaaagtgctagagaaggcatctgaaaagctgtttcaagacggtaagctcacattaatggcttatttatgtaaaactgattgaaatacggcactagaccattttactccagatgactaattgcttcatactgagttaaaaaccctacatattcagaacaaaagagtccaaacatctcccacaaggtgaactatacatgataagaaaaagaccaaccttatttgcgagctgtatagctttctggaacatatatctcccctccagcttcaccatgttgctccccactgattgttttccttgcagctgaaaactcagcactcatagcattcattccttgtatcaccgcttcctccactgtcccgtaaccatgttcatcagcatattttctaatatcctctgnnnnnnnnnnnnnnnnnnnnnnnnnnnnnnnnnnnnnnnnnnnnnnnnnnnnnnnggcaccctccgatggtaatgtttcatcatggaaagacatagcggtcacaggatccagagatagagcaaattgatccaaccatctaaactcaaatcttgccttgcttagtgtatcgtcccatgcttgtgcatagggatggccctttgccaaatcagcagcatgagcagaaattttgtaggatatcacgcctgtcttaacatcatcacggttaggcaatccaaggtgctcctttggtgttacataacagagaagtgcagtgccaagagccccaatgttggcagcaccaatggcgaggtgatgtgatcataaccaggtgcaatatcagttgtcagtggccccagtgtgtagaaaggtgcttcattgcaccactccagttgcttctccatgttttcaagaattttatgcatcggaatgtgccctgagccttcattcattacctaaaaattgagaaatgtcaaaaacactgcttgacaaggttaaaaaaaattgaattgtgtagctaatggaaacaaatcatcattcaggcacatcaccgttcaaagtttctactaccaaattattagggaaacaaaaacgattcatcatttagagcatgtcatttacaataaagagttttaaaccacatctctaacatcttctcatatgtttatctg

SEQ ID NO: 68049 - DNA, 6238 bp, Oryza sativa
acgtgaaactatgccggtcattctctttgccgtaagaggaatgtaacgaagaagcacgccagcatggattgtgaagtaatcaacaccctgctcagcttgttcgattaaagtatctctaaagacttcccagcttagattttcagcaataccattaactttctcaagtgcttggtaaataggcaccgtcccaatagggactgaagaattacgaaggatccattcccgggtctcatggatatgacgccctgttgaaaggtccatgacagtatcagctccccacattgtagcccactggagcttgtgtacttcctcctcgatggagctcacaacagcagaattcccaatgtttgcattcacttttacaaggaagtttcgtccaacaatcatgggttccaattccaggtgcctcttgttggaaggaattatagctcgtccacgggcaacctctgaccggacaaattcaggactaaggttctcacgtgtggcacagtacaacatctcctctgttatgattccctgcttagcgtaatacatttgtgtgtatcgaggaccacctaacttctccctcctgtcaatccattccttccttatctttggaagtcctgcaaaaaaattcaaatgcttatgcaaattgtcaaatatgttagggggaaagagagggaagaaccctcaaccatcctatcagtatagttatttgaatatggagaggactggacatagttacttatgtagcgaaaatgtgagaaaaggtagcctaggcactgcatgatgtcaacactggtttgtataccattttggtttaacagtattagttcagttgttctggtgtcatctctttttactggccgttttggtactatcaaattaactatgcaattacattcatgtatcaaactgcacgatacctaatatcatacgtccatgttccctatggaaattatttctattagttttgaaataaattggtataaatgaaaaataaaactccgcaaatagtacagaaatataaaaaaaataaaatttgtaaataaaaataacaaaaagagttcaaaacaatataaggtatcataattgcattagagtgaacataaaagaacaagaaataatttccactaagccgctgatctttcctttcatgcaggattgataaaaaaatgtaagatgttatgttcattagcttggtttgggggtttagtttgacaagagaaatgaggtcagtgagttaccaatccttggactaatgttttgtggaccactggtgtcgtatgtgtcaaaatgcttctcatctccggtcaaatggattctcctaaatgggatcttgaggacatggccagattcctcgtgcacaatttctctgaagaacatagtcacaggcaacataagctttagtggaggcgttaacataccggaatgtaagtaattccaatacagttcttaatgaaaagtgaaatgtaaatcttgcctggattcttttgtgctccttggaaagcattcttcaaatgatgggagtggcagaaattctggagcagaaggatcaacagtgtgcttgttttgcctgggttttgctggctctgctgttgactggtcagtcactgaagctgctctaggccttgaacaagtgaagttagcgctcctgtcctgcacatcttgaggacgtgcaataccaccaaatccaggtaaaactgcagttttgggtaacttcagacttttcatagccattgctgaagagaatgagggttgcagggcagccatttcctgtccaaaggtagagaaaaattaatgattaaagacagtgcaacgctatcaactcaaaagctttatatctgcacttgcagaaaactacagtcctaatcttatctccatgtaggctatctgaagatgacgacaaatgcatgtagcagtcgaaataacccctctagctctgatgcctttaatattcagagttcattcatgatgcctgatgaactggttttgattgaaaaaatgattcatatttcaattctatactggagaactctattcatcccttaaggggatatcccctcatttttgcatgtcacttaaaaagtcatcaaaaaatttaaaataatttagtaagatagatcaatatgtgatatgtaacttcacaaacatgcatattcaaattcaacttatataagtaaaaacaaaaataacaaatttaactatgaatagaacgtgtaattcacggttaaatttgttatttttgtttcaaattgtataagtcgaattttaacttgcatgtttgaaaaagatatatcgtataatgatctatcttgacaatttcttttcaaattttttgataactttttgaacgctatgcacaaaacgatgggatgtccccttgagggacaaaaatacacttccttctatactactctacatctcagatgaaacatgccttacaaaggagttgtggaacttgtgtctcccctctcccgtgtgcactgcaccgaacaagagcatagagcatatacccatgtggaaaaactagcgtccagaatcaaagaggccccccatgtaccaatacgatcgagaactagataaccacggtagcaacagaggccttcaccacgcgcgcacgatctatcaagcatcaaccgtatcatacggaaatcacacccgcaaagacgcaggcaagcaaagcgagaccagccaaaatccttacccccctaatccacaacgcatccagaaacctacgatgctaccgctagaagcagcatccaaaaccgcaaccccggcccgtcggccgcgcgagatcccccacggattccgacgaggcaaatcccccgttcgttctgatcgaaacgaatgccggagagcggaaggaaaggttctctcacctcggggcggcggcggcggtagccgggagccgggagggagaggagaggaggggcgacgcgggcggaggaggaagtgaggaactcgtgagcgggatgggggggaggggtgcaagggcggaagatatttttatagcggggggcgcgcgggggattgcagatttggggggaggatagcggacgggtggccaaaagagagaacggacggccaaaagcgacggccgacgggaggggagatatttctgtccggccaccacagatactttctctgcgccagcggacgcttccaacggtccgaaaaagagaattgattaggacaggagggatgatggcgtggcgtttgcagtagtatggggacggttaattttgggcctgtttattgatgacgttttcagccatacaattatttagtaaagattgaattacgttttgggccagattttattacctaagttttattttggaccacccttaaacatatcttttcactttgaaccggataaatttgctattgttataatttggaccaccacgaacgattttttcagtacaaacaacgaccttaagcacatcagctctagtatacagccgaactcttctatgtatggttcatatgtttgccaaaagagaagttagacgtgacgagaaaagttgttcatgatagttcaaaccgtaataatgataaatttacccggtccaaattgaaaagatatgtttaagggtgatccaaattgaaacttgaaacttgggtaataaaaggtggtccaaattgcaatttactctttagtaaaattgataattatatgaatatatttagtttgttactaaatattggtaatgtgtatagaattttgacaacattattaagccaatcctatcaaaattttgataatattgtcgatttataaaattttagaattttcaaattttgataaggtttatttggcaccaattcgaacaaaccctttgttcgttggttgaggtggtattgtcgtgctatcctctaccgaacctcgggtgttgtatgttagtgtttgatatgctatatgacggatgatactgtaccggtggggacggtattgtgctaagaatataatcccacgggacatggattgttttgttcgccgagagaaatggacaaagcctttttcactgtgtatatagggtctaaatcatcgtttcaagtgacgaatacagggaaatacatgagaaaataactactccctccatttcatattactaagttgtttgacttttttttagttttacttaagtttatagaaaaatatgttagtatttcaactcaaaataaatatattgttaaaatatattcaatgttacattaaatgaaactaatttgatattttagatgttgctatttttctgtaaagttggtcaaacttaataaagtttgactaggaaaaaaaaccaaataatttataatatgaaattgtggggacacccgataaagtcatggtgtcccacgaatacgtaactgcccaggatgttcagttacgcatgaaatgatataaaagcataaacttcgattatatagtacttaagtcacttaattcacaacacaacataaatacaaaccattacatatatggcctataaagccttatttctacaaacagataaactgctagacttcaccacaggaactgcctgagcgtaggatgacctagaaaccatagctgtcccactctaacgggtcaacaggatcttcacaagcatcctcctcatgatctgaacccatttatgagtacaaaaggtactcagcaaaacatgcttatgatagcaaatgcagtaattgcaatataaaacatgcagtattaagagctggaaggtttaaaccctaaccttaacagttatttcatagagcctatcttaataagcatttgatataaacaacagtattgaacatttaatttaaacaataataacgagcataaaaatataaatgttacctataaataacttgaatagaacatcaagtaataaataaattaaccatattaattaatagccatttagtttaacttgtgcccataatctggaatcacccatagacacatctccattaaccgggagcacggcgtattcgaatactcaacgactctgcagtgtttgcccagctttacccacacgatacccacagctggccgggctgaaaagtaacaaggtgtaatattgctccatatatctctcccttctacctagtaagttaaaggatgctcgggatgttgctcggagtgatccggtctgaggtgtgtaccaacctacctccgcatccacttaccattgttcgttactcgatgggcagcccagaacttcatgggcccatagggcagttctgaactctcggggcccatcgagcctacatatataaatcatataaacatgaaccatgtcactttgcttcacacacttgaaagctaatggccagtacaccgaaaggcctgcagaagttcaatcaattggagcaatatacggccaggttcgacaaatcgatcctgtggatgggcgaaactatatcattcttattgacaaagggggttgattattatatcaattttaaataagaaataaccataaatatatccatatatccatcacgaccataaacaggtccataaaaccaaacacatgaactctatcatgtgtaccacccgctcacatgcggtgtcaacagttcttagcatatagccataaatagttccataagcatgttttcatatgcaataataatatccatattaaatcaatagcatgttaaataatgaaccatttgcttaggtgtttctcaaattttatcctaagtttgttagactctaaggctcattaaggtgtttataacaacaacagaaaatataatgcaataatagtaatataattaatttaaaagaattcgtgcagtctatcgtactccaaaggacaagtacgctaccaaaataactctctaactactgggattaaattgttcaagggagggtgcatgtcttgcaaccttcgggctcgatgtagtcgtacaaaccatctcctcctggcgcggagatttcacttgctccgactaccggaccaacgtcaatgctttctatttacgcaacaatcatcaccacaataaaataacagaaaaataaagccacccaaaagaaaatagtaccccaaagtgcaacaatgggtgaaaaggatttaaagaaataattttagggatttttggaatttcggtgaacggcgttgtcggtgacatggggccggggggtatcatgactagaggcttggggagccacggtcacccacgtggcctgaccccctcgggggggtcgggcccgagggtgacgtggccacccctccctccctctgtctccccgaggggt

SEQ ID NO: 68050 - DNA, 32681 bp, Oryza sativa
  unsure (1)..(32681): unsure at all n locations
ccgaccccctgtggtgtcgccgccacgtgtgtgggttaggtgagcacagcggcgctcacctaaccgcatttatagcgggtcagacgcgcgcgccacgccgcattcaatgcggcgcagcgcatgcttatccggtccatgaccggtcgcagggtgtgaccggtcacagaccggtcagatcgcgggttaggtggcaacaggcggcctgtcgcacgcctcgccccgtctcgtcggaatgatgagagcttcctggctcttgtccctagccggagccagcgtgctaactcctggagttggtatgtcagtcccggtcagatccattccaggcttcagcgcaagtatagcaaggaagtcgctggccattaaatgaaggttgaaacgggcgtccaccgggagagcgaacgagcggagcagaaggcgtgtgctctgcttgtcagaggtcacttccggctgtagactagccctcattgtaaaaagcatgttcctttcttaggcagtaagaggcccatgtggtgacccctaaccagataaaaaggaggcccaggcctaagaaagagagaagaaaaagagggtgctggagcggaactctctctggctctccggctctcggtaattccttcacacacagatccaccagaacacaggagtagggtgttacgcttctcagcggcccgaacctgtctacgtcgcccgtgtcttgtgcgcttcctctctcgctgacattcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttctcccgctcagcccaatggccgaacgggcagtggcgcacaacctctctccgaacgctagcggtgacgacggggagcagaacccgcgccgtcgggctcgcaccccaccgtcccctctcgccgaaatcttgggcggggagaggcgctcggggaggtcagaggatccgcgacatcgccgcccgcgggcgacgggggaggacggtgtaacgccccgattttcgttcgggtttaaaaatcattaaataatgcattttctagaaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaagtcacaaagttcattaaactaatttaaataaaaagaaaacaaaataaacttccccttcctccctttcgggctcggcccaaaatcctctctccttcccctcccgcggcccggcttgcctccccttttggcgcaagtctgcttatcctccctcccggcctcccctctcactcaggccgacaggtgggacccgtgggccccacctgtcatccccaacctccagcccgggccggcaactgccatggccgcccgagccgcccacgtcgccgcccctccccgcgcgtcttccgattcccgcgcgcgtgtgggcgcggtccaccccacgtcatccccttcctccaccatttcccccacttctcccctccaaaaccgacgccaaactgcccccactcacccacgtcgccggcgcccctttcccccttcaaatccgtcgccaaccggcctccccgtcgactctcgaggctataaaaacgatccccgggctcccctcctccgtttccccctctttcccaagcttccccatgcccgaaaccactccgccaccaccaacctccctccgccgccgccggttgccatcttcggccggccacctccgccgccgtagccgtccccgcgccacaccgcttgcgccaccggcctcgccacgcattgtcgcacaccgtccgcaactccgtttccccaaaccacaatcaaaacaccgattccatcgctcacccgagcaccgccgccgtttcgccgccttcggcagcctcttgccgccgttcccgtccacctcatgccgcgctgccaccaccactagcttcgctgctccgccggcaagcccggccaccacgccgctcctccattccacccccgagccgcccgctccacggtgaacccgagccacagccacttttgtgcctccagtcgcacctctgccgtcgccctggccaccgccaagccgtgccgtttccttcaccggctcggccgcttcaagccacagatcggtcgccgctccaaaccaccggaaacccaccggtgctccattcctttcgatccccggtgagcccgccgccgcctaatccgtgccgccggccacctcctcgtcttcgtctcgccgccccattcgctcggtgagaaccgcctccctctccactctctcgccgcctctcgcgccgtcgccgctcgccgccggcgtcgtcgccggtggtctaggctcggcggtcgccgccgcctgtgggcgtgcctgcctggtcgtgccgctcggccgcccccggccgtccgatcggccccggccgatccggagcgtcgggtgcgcgcccacgtggccggctgccgccgtggactcggtccacggtgggctttgccgctgacgtgtggggcccgcccctttgtgacgcggtccgcgcctcaccccttgctgacgtcagcatagcctttttcctttgaaaaattaaataataattgcgcaataaatcggtaataattgtagaaatccattaaaatggctcaaaacttctaaaattcatatctaattcattcgaactccgaattgagccattcaacttgcaaaattcatctaaaattgagctctacatgtttgtttagtttttatgtactgtttccttggtttttattagagtttgtcctcgttttgcgtgccagcgtgtagtttccgtcgtttcggaagtccgcggtcgcgaggaaaagagttcggaagatcaaagtgaataagcaaggcaagtcacatattccccttgagcatgttgatcccaatttacaaatgttttactgtttgcaaataaatatgcatattttgctaattacatggggtcagggtattacctatctgctcgcttgtgccatgtttacttgatatctatcctttgtcaaccgggggtaataaatcgactagctcatgttacttatgtgacctagctagaactatatgcttagccatgcttaattaccactagctcagttgatgggataattacagtattagacctttctagtatcttgttgagctgcgtgctcgagacatctggccatgcttcatggtcgtaattatccaactaaaatgcaactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgtggcttccggattcacctaggcacgagaggggactgcccgctgccttgcgaggagtgggggtgaaacctgagatgtggtgtgcttggttagagggggttatgcgaagggtcctgtcacggcctctttccggtatgtcgtggtggcatgtcggcgcacggaaacgtgtcgtggggctgtgtcttgtgggtacagttgtagacctctgatcagagtaaaactattcgaatagccgtgcccgcggttatgggcggtcgaccagattcaccgtgattagtcccaccttaataaatcgactcaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccataaaccgtccttgtgttccccttgcacgtctgcatcgttggtgtggcttgctgagtatggtggttgtactcagccttgctattattcccccttttcagaagtgtagtgtttctgagctgaagatggagttagaggaccaaggctcagaccccagttgagttttgcgtgtggagtggagctgaagccccgctaggatcgcctttttccgctgctgctgcttttgtttcggtgtgaggactaagtgcctcttctgtaagtattttacgcgttatttacgtttggaactgtttattacttgtcgttttgtgtaccctggctggtcctggacagggatttaatacacaaaatagtctggaaatttgggctaaatttctgggcgtgacagacggcgagacggggcgcgtcgccgcctcgtctacggcgatggcggcacgccccagggcgcgctccaggctgcgggcgcgctcctgcgtcacccgcccgtcgtccccgatccagagactccagcccgacgttggctggatgacgtggccgacttggtcatgacggcgcagcagcgcctaagcgccggcgggcggtcctccgccaccgagacctctggcgctgccgccgccggctccaggtcgtcgaggcggagggcgcggcgagcggcggccgttacccgccgttcgtccgccattccctcatcaatgcctccgacccaagaagatgtgcgtggggggccggatgcccgcctcgatatcgagcgccggcgcgactctcgtcacgccgcccacgcaacggagggcgcttcctcgtccgaagcgccacttcggtccgggcacgggggccggccccccgtgtccccggttggcggtgctggctgtcgagcctttgtggcgagccttcggaacgtccgttggcccccaaggttccggcccaccatcaccgaaaaatacgacggaagcgtcaaccccgccgagtttctccagatctacacgactgggatcgaggccgccgggggtgatgacagggtcatggcgaatttcttccccatggccctgaagggacaggcgcggggttggctaatgaacttgccacccgcgtcggtccactcttgggaggatctgtgccagcagttcaccacgaacttccagggcacatatccgcgcccaggcgaagaagcggacttgcatgcggtacagcgaggggacgatgagtctcttcgctcgtacattcaacggttctgtcaagtccgcaacactataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggtcgcccccgggtccgccgcttggtcagagcggcgggacaggaggaggaagaagaggtcggcccgtcccgacgacgagggtcatgtcctcgccgtcgagggcgcctcgcgggccccccgaaaggggaggcctgcgagcgacaaaaagaaggaggccggcgctcccagcagggagcgcccgacgggcaagtggtgcaccgtgcacaacacctccctccacgacctcgcggactgccgcgcagtcaaaagtttggctgagcggacgaggaagtgggagaaggagaagaggcaggagcgccgtgagggcaaggccccggcggctcccgccggcaaccggcgaggtgaggccaagcagaaggcccccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgactcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctagggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggagacgagaggctcagcacctccgtcccggccgccccaaggcggcggatggtcacgtgcgacaaggtcccggtcaaggaggttgccctgggcgacggcccgtccaagaccacacgaatcggtggtcttctggacgacaaataggaagacgcgctcgtctccttcctgcgggcaaacgccgacgtctttgcctggagaccggcggacatgcccggggtccccagggaggtgattgagcaccgtctcgccgtgcggccgggtgcaaggccggtccagcagaaagtgcggcggcaggccccggaacgtcaagccttcatccgcgaggaggtggcgcgacttctggaggccggattcatacgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgtggggtgcgaccttttgtgttttctagatgcatactctggttatcatcagattcgcatggctagggaggatgaggaaaaaactgcgttcattacccccataggaacttattgttatacgacaatgcctttcgggttaaagaatgcaggtcctacttttcaacgtactactcgaatttctttgggtagcaaattaggacgtaatgttgaggcctatgttgatgacttggttgtgaaaacgcgcaaccaagagaccttactctcgaatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttaaggatgtgcagtgcgtcaccggctgcatggccgccttaggtcggttcatatcaaggctgggagagaaggcgctacccctatttaagctcctcaaacgctccgggccgtttacctggatggaggaggctgagagggccttcactcagttgaaggcgtacctcagttctcccccagtcctggtcgccccggagccagatgagccgttgctactctacctggcggcaaccccgcaggtggtcagcgcggcgttggtcgtggagcgcgacgaggagaaccctcactccgcgcatccccaccctgtgtcgactcgacccgggagagagcagggaggagaggcccccgagccgaacggcggcccgaggcccccaacggccggagttggccctccgcctgcttgtccgacggtgccaggcgcccccgacccccaggatggccccggggccactgcgggaaggccgcgcctgtcgcctctgaccccgaggtcgtcggcacagaagccgagtgcgccccgcgcggcctctcggacgaagagcgccctggagatgcggccccaggcgaagaggatcggccccgccgaaaggtgcagcggcccgtctacttcgttagcgaggccctccgggacgtcaagacccgatacccccaggcccagaagatgctttacgctattctgatggcttcgaggaagttgcgccattatttccaggcgtatcgggtcacggtggttatgtcttaccccctcggccgaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtccccgctcccgaggccagctcgggcccctcgcagctgccccacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactcccagttggtcgttaaccaggtctccaaggagtaccgatgctctgacccgcagatggacgcttacgtgcgccaggtgcggcgtatggagcgccatttcgacttgatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagctcccctaggttgattgcttggatcactgagatccaggcgtacctcgcagatatgactctacccgaggaccgcgaagggagtgaacgcgtccggcgcatctccaagcgctacgtgctggtggaggggaccctctatcggtgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccaacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcattaagatcgataagcactccgcgcttaaattcatcaggggcatcactgctcggtttggggtgcctaaccgtatcattacggataacggcacccagttcactagtgagctcttcggtgactactgcgaagacatgagcatcaagctctgcttcgcctcccccgcccaccccagaagcaatggccaagtggagcgcgccaacgcggaaatcctcaagggcctcaaaaccaagaccttgaacatcctcaagaagcacggcgactcgtggatcgaggagctgccagcggtgctctgggcgaaccgaaccacgccaagcagagcaaccggggaaacgcctttcttcctcgtctacggcgcggaggcggtcctcccatctgagctcaccctgaggtcccctcgggtcaccatgtattgcgaggctgatcaagatcatcttcaccgagacgacctcgactatttggaagaacgaagacggcgcgcggcccttcgagccgcgcgctaccagcagagcctgcggcgctaccatcagcgccacgtccgggccctatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcttaacccgtggaacatcgaacaccttcgtcgcttctacccctagtgggggtcgggtgtcatgtctcgggctcgggcgaaccccgcaccccccctcgggcgtgcagggttggccgggggctaccacatgcatatacttatcttttttctcttccgtatttcaataaaagcattttcgatttcctgaggactgtgtctgtgccatcgttcccttttgaagaatcttggcttggattagcacgctcgtgcccgaccctgccctcggtggcccgggccggctaaaatcgccaaacggggcccagaaccgagccgtgccccggggcgtggtgaactccgggggggaattggcaaaggcccacaatcggggcactagcctcaaaccgcgctcccggcctggccagtctcgacacgtggatctccccaggcactagccccgacccgcgccgtttgaggctggggcctgggcacgagcccttgttcaagccaagacacagaaggactgcggcacagaccatcctcgtctcatgcacacgacaaacagaattgacacagaaatttcctctttacttgattacagattaaatcagtctatacaagaagggggcccgaaggcctcggaagaagaaggaaaagttattaagattggcggggccctgggggctcactccgacgcgcccgggtcgccggcctcgtcgtcgctgtcgtccgcaccgtcgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaactcgtccagcgctgcccacggggagaagtcagggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcgtacttcgcggtccgcccgccccaaaggcccgcctgccgcccggcgcggtctagacgggagacggcgtcccgaagcatgccaggccctacctcgctcgccaagcggagggcctcgacctccccggcggacgagtccagtgcgccatgcagcccggcgatggtgtgctcggcggctgtgaggcgggcggctaggtcgccgtcgcccgcggccgccccgccgctgtgagccctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgtagcctcggcctcctcgagagctcgcccccgctcggtgagctcgtcctcgcggaggcggagtgcggactcctcttcggcgcaagcggcctcgtgcgccgccagtgttgcctcccgggtggcgacggcggcctcaccgtccgccaggtctctctccttcgcgtccagggcgcgggcgcgctcctccagcgccgtggcgcgagcctcgagggcctcttcgcgctgtcgggacgccgcctcgttctccgccgcccgccgttcccgggcagcggcggcgtcaaggactccctgggcggcgtcgagcttcttctctagctccgccgcccggctcccgtattggaggcggaggtcgtcccgcgcctcgtcgagcacggcggtggcgatgagggcagtctcccgctcctcctccacctccctagcgatctccgccaggtccctacgacgggcctcgagctctgaggcgtgccggcggtgtgccttgcggcccgcctccaccatggcctccaccgagcgccgcccctcctcgacgcgcgcccatgccgcgtcgagctccgcccgctctacctgcaggacctccatctgggcacttaacccgtccagcaccgtgctgttcgcggcggccaaggcctgcaggaggggctccgcgctcactggggcagcggaaggcagaggggagagccgcctcggtgtgggtgccgcgcgactcggcccgccgatcgacgtgccggactcgggggcgtcccccgaagctggctcgtcccaagcgtcgcccgaggggtcgggcccgagcggcgcgcccgcgacctcgtcgtgggtggcctcggaagtcgtcgtcgcctcgggcggagtcgggtcgggggcttggcaggccgcctggcatgcgcgcgccgcttctgcctcccggacggactccccggcccggcggagtctggcctcctcccgagcggcctcctcagcctggcgaacccggacggcctcctgggcagccttctcggcttcccggaggcggtccgcggcttctcgccggtcagcttcctgcctccgggcctccgcggtcgccgtctcctcggcctcagaccggccggacttggaatggcgggggggggggggcgacgggatctcgctgaggcagaagaaaaaccagaagacaaaaagaaacgggtgagtgaaaactcgccttgggagatgggagaatgaatacggccgcggtgggcgtggggacgaacctgcggggaggtcggctaaacgaccacctcgggggcgagatgagattcccccggcatggctcggtcccccccatcttgcggagccgcttcttcttccgctccccctcgggctgcagcgtcggcacggcaccctctgggcgcctgctgctggcacgcaccgccccgccccctcggggaggagatgggggaggggtaccctcctgcttcctcttcccccgggcgtcggcagggcggctgccccccgggcccccgtcgcggggcccagaaacacgaccccctcccggggtagatggttcccccctgcggctcccgcccgcgccatcgtggcctcggggggcccgctcccccgacgccccgaccgcctgcatgatggtcaggatgttggcgcgctccggatcgcagcagagggggaggactccttgggggatgagggatgcctccacggagctgagattcagcacccgttggaccaccatcttgaagtcttcagggacccagtcccatttgcgtccctggtgggtcctcatgtagtcctcgggcccggtgtactcccaggcgccccgggagcgccgttggagcggcgcgatccggcgacgaaggtagtcgccgaacaccatggcccccgtgagcccctgggatcgcagacccgccaggcggtcaagaacggtgtcatagccgtctcccagatctaccgtcgcccgccagctggaggcctgcgtcgggggctggctcggaagtcggaggcgcgcttcgtcggcgaggggggtgtagaaccagtcgctcttccagtcgtcccacttcttgcggagaacgcagggaatgtagcggttcagcacctgcccccgcggctggaagtagcagccaccaactaccgtcggcggcgacaccggctgtacggtgaagaaccaccggaacagccggagagatgggcgcaccccgataaacatctcgcacaggtgtgcgaagatggctaacgtcattatcgcgttgggggttaggtgcgccatctggagatcgtaaaactccagaatatccatgaaaaaagcagagaatggcgggaccagccccgccattgcgaaagagaggaagaagacggaccgccccgggtagtgtggcgccgggcgtccctcgcccagcgcgaccacctcccggccggcggcagattccggcatgaatcggcgcggcagcccggcctgcctctcgctcacgatacgggaaggcggcagcacgctaccatcgagcggtgcggagccccgtgccatgacgccggcggaggaggagcttgagagcgagcgagtgcggcaagggtagggcacaggaaacgaagagttagagcgcaagtggcgaaggcaaggggaagagtggcgaggggaaggaaacgaatcccttcctcggcgtctttattcccttgccaacgctatgcccgtctcctcgcttcccgcgcccactacctcgccccctcgtttctcgcgcccacgcctccactaaccccactcgcccgtttgcggcgcgcgcggcagatgtgtggccgtggcggttgagatggggcagatcgtgcgcgcattaactgcgctcgccaaccgagaaaaacgccatcatcatgtctccaggcgaaacgaaccggctcgtcccgattcgcgcgctgctcgagtaatgtagcggtcttgaagaggccgctcattattatcggtcggttttcccttaccgatgcacgcgatttacgaccgctgggtttctgcccgcctgtagagaccggccccacctgtcaccgggcctaaggagtgacgtcacgcccgagcgcttccctcgaggggggcgatcgccctgacgtaacgccgggggctactgtcggtgacatggggccgggggtatcattactagaggcttggggagccacggtcacccacgtggcctgaccccctcgggggggtcgggcccgagggtgacgtggccacccctccctctgtctcccggaggggtcgggccgctcccgtttcggccccgagggctggggcgccccgaccccctgtggtgttggcgccacgtgtgtgggttaggtgagcacagcggcgctcacctaaccgcatttatagcgggtcagacgcgcgcgccacgccgcattcaatgcggcgcagcgcatgcttatccggtccatgaccggtcgcagtgtgtgaccggtcacagaccggtcagatcgcgggttaggtggcaacaggcggcctgtcgcacgcctcgccccgtcccgtcggaatgatgagagcttcctggctctcgtccctagccggagccggcgtgctaactcctgagttggtatgtcagtcccggtcagatccattccaggcttcagcgcaagtatagcaaggaagtcgctggccattaaatgaaggttgaaacgggcgtccaccgggagagcggacgagcggagcagaaggcgtgtgctctgcttgtcagaggtcacttccggctgtagactagccctcattgtaaaaagcatgtttcccttcttaggcagtaagaggcccatgtggtgacccctaaccagataaaaaggaggcccaggcctaagaaagaaaagagaagaaaaagagggtgctggagcggaactctctctagctctccagctctcggtaattccttcacacacagatccaccagaacacaggagtagggtgttacgcttctcagcggcccgaacctgtctacgtcgcccgtgtcttgtgcgcttcctctctcgctgacattcctcagatcgagggcgaagaacctcacttagcgcccccggccgaaccggcaaaggggggcctgcgcggtctcccggtgaggagccccacgctccgttaggcgtaccctagggctaaaattagggtggcgtcaacgggtgctcggattgcaacgaaactgacacggatggattcagaataattctaggagtttgttataggtctcggatttcgatttcgaggtcaaacagatgtcaacttgataggaaaataaaaatgatttttcttatttatttttcaacaggaaaatcggatttcctgttcttctcgttctctgcacaggaacaggccggaatcccacattgccggtggcagaggaggccggttttggacaagggggtgccggttttgtgatctacgggttgaggcgattccgtttttatggttgacggcgagagaaacgccgacggtgaggctggtggcggtgggcggaaacgggaggcggaggcgactccggcgaactccgagaagggaggcggcctgatgaagttcactaaggctagaggagtccgagggtggcgatagccgaagttagggtggcctggagcggcggcgcgccatgtggccggcggcggccgaacagagcagtggcggcgggaggcgacgcttgcgacattccggcgatgaattggatgggtaaagagagggggaagggagtactcgtcatggagaatccaattttaccttcaatttctgaggatttgcgacgtatgcgacgaattttgaagctcaatcaatggcgtgttttggggatttttcctccggtgccgacgattgagtcaacggtggttggggcggattcttttgcctccggtcttgagccttctagttgagagacgaaggaaatacggaggcgggaagctggaggtgtcgtggcggcattcgttcgtcgttcgtcctcgtgcgagagcgtgcgggcgtgtggcgtgcgcgggctggcacgagctgggcgcgagcgcgcatgagcgcagcgcgggattgccgcgaggcaacacggggcggcacaggcgctggctcagcctagccgagtagaggaagaaataaaaggaaaaacggagagaggaagaaaaacagagaaagagggaaagagaaaggaaaaaaaatggaaaaagaaaattaaggtggaaatagggaaaaggaaaatatggggaagattaaaataaataggatttgaattgatgtggaatttagacggtccaacattcgggatagaattaaatcggattaaaggaattatttgagggatgatacgcactttgcgacaaaattaaacgagaaaagaaacaccggaaacaaacatggaaaataatattttaaataaactactaactcgacagttatatttttagagaatcaaagcaaactaaatcggttttaaaaagttgtcaaattttagggctgttacagaaatatagggagtaattgtatatcaataaaaaaactataggaggataaatattcaattccaatatagatatgagctcaattttctatgcacacaagaatgataacattttcgcacgcggtttgcactacccatatgaaaagatactgaaaataatttttaaatgataagtgcccttacagcgaaaaaaaatctttagacctagcagggttccagtcaaatgcaaaaaatcattttttatagtgcccttgcaacaaaaaaaaatctttatgcctagaaccaataggtaaatatacgtttaggtatcgattatctctacgtgaaacccacagcatccatgacgcgcatgagacccacccaggttcgtgaaaaaaaggcccccaaatatgcatcattaactctcaccgtacacaaaagaagtaacatatgtaatttggatttcccatcgcaacgcacgtgcatctttgcaattcttaaaagaaaaagaaatgagagatgaaaggaaaaggtccacttgaggtcccttatcttgtcgtcgagtttcaaaatcgtccctgtgaagcatctaggcccccgttgttagttttggtaattaatgacaagcgctaattgtggactaaccgttctatcgagttataagttttgagttaggttcacatcatgtgtgcacatggatgactaccgatggattaaaatttgatggcgcaaagcaaagaaaagaagatggttgttggtatttcttaacgacattactagaaatataattcccaacaatggcgcagaaatacttctggtatattatggttacagagttcatccgcaagcgcacggatataccattgtagcatttcacccgagagtattccaagggtatcgtatttattttatcctgtgggaagatcttgtagagagaactcaactaataatttatatgttacttgtgataatcatattttaagcaggtgttatgataatccaagtgtagagtgacacacaagcattacctactcatcctcataataaataatctaaactaggtggaaagaaaagagaaaggaaatctattcctatacttctaatatacctagtatacatactggctaataccctctatccgatgtcatcctagtacttcgagaagccacccctgactgccgagttccttacgacagctcatcatgaccatccaatcggggctaaatatggaggaataccctccccaggaaattaacttaggattatatataggcgcagaggaatacccgtactgagctatcaccatcagcggcccacctctcatccgcaatttataacctcaaataatgatatcccgtaatctagacaccacgtctaaactaccagatactactctaatatcatcgtcatgatatagagtaattgcataagcaaacactatacccgcaccaaagcatctcccagataagctagccatatactcagtataacaagaacataatgtanagttggtactcatatactcgaaaagtatttcaataccagaaatgtatatagaagagtattctaataaaagtacaaagcttacaaaagaggaaaggaaagctactaaagccatacccgaactcttccgaagactttcggactcctgattcctattctaattctattccaccagctagatactactaaactaaacttgagaggaatgagagagctcttgcttgaggtgtgtctttaagtgaagagagtgagctccttataaagaggtggttatgatggttgtggaaggggaattgtccgaagtacccctcaaccgccatcaagagaagatctggagcgtccctgccaaaccccacatccaacggtggagaaatgctttaattttaaattagtcgaggtgtagggcgatcaaatttgctagtttatttttagctttcgccgtactattaagaggggtaatgacctagcaaagagatgatttaaattgccacgctaggtcatgtttgcatttagacttgtgcttattttcatatcattgtatcttgctgttgctgtggtgagtgaccaggggcggtcaaaccgccacacagtggccggtcgctatgtggcggtctgaccggggcatgtcggccggtctgaccggccccctggtggccggcggcagcgctctgggcggccgatccagagccgccagagccgaggttggtcggaccggccacccaactgcggtctgactggccaggcagttggggcccaatgtcagccttgcaacggctagaaatctagacgttgcacagtagcacggtatgaccagccacacacctccggtcaaaccgacagtacactgagttgggggatttcgcccccaacggctagttttagttggtgggtgtcacaccccaatctagtatcaccgtacaacggcacctgacaggagcgtgtcgtagggaaaacggcgcaaaccgcttcctacgaaaccgcgatctcagtaccagtcccaggacatagcgctggtacccacgatgacaaatatgaatcattgcaatccttaaaataaatagaggacttatttaccttaacttagttgcaactcaggacagcccgagaatgcatccgacgacgcggacgaggaaacaccaacaacaacagcagcagcggaaccaacgatctaacacccaacaccacaggcgacggctgggaaccaggatgaaaccctattcttcacttcacttcatcttcaacttcacagcggaggaactatatatatatttgtatagagcaagggcgagtactttcgtactcagcaagtcacgggaacttaggtgtttgatgcaagcttggaagagaggcaaggttgttttgcaaatcctttgtttgaaatcattttgaagtcactaagtgatttatttctttctaagtttgggccgaaaagagacttgcgtctcgattctactttaagagatgtttttcaacaactcaattcgtaatgtaccgacctcccgggtcagatcattacttctcggctcctagagccatttaacttgattaatcggctcccagagcctttttcattttctcgaactcccagagtccagctgcccagcagcacaacaatttgcttccactcaggaagcctagtctatgatgcccgcagacatcccgaagcacacagattcgtttcagaccacataggtcatccatctgccatataggctgattctggtgacgattcccacaccacaacaatttttcacaaagcactgacaaacaaatctatgctataggaaacacctcatatccgcccatgaccgtgggcacggctgttcgaacagttagttaacctctgcagagggggtacactttacccacacgacattactaacccggatcacccagcccgtgagatcagccacgtcgggagatcctaaggctttcatgacaatgcatttcgaaagtcgacaccaccctgttgaatccacttgtctcttggcatcaaggcttccttggtttgctatttacttagccaggggcatcctattgcacccgtgtggtcacacttattatatgctcggatgaatttcccacaggaatcagtccttatatgcgaatacgggacaatgccacataggcacaacccccgcatcgtgagttttcacaatttattttattttcaaacacgccaacaccacatgtcgggttttcaaggcttctcaaacccacttcccaaattatcgacaaacaatggtgtatgtggaatagttagtatatgcgctcagagagcacggataccgaagtaccacaaaggtggagcaacaaggaatcagggtggtacggcctacaggaattagtgcgactactgggtaggtccgtcggtttggcacgcaaaccgaggccaagcaagttaagtgtgtgattctaataatgcaagttgtagacaaaataataatgactttccaattataggagcaattgattaaagggtgacttgccttgctcaaggtcttcacgaagcttcacgaatcttcgagaaatcccgcgattgacgaaaatccggtaatcgcaactatacgcaaacaatcgacaacctaaacaaaagaccaagaaaaagatcctatttggactaaataatagtgccattagattgatctcaattttagagggttactggaagtggaatggagtcaatcgaagttatgaattgcgagatatgaattttggaagtttagttggaatttctggaatacgagaaatggtttgtggaatttatagaaataatattctccagaatattattgacagtcactgacgtgcggggccaagggaaatgatttatggaatttcagaataaagaattgatttatggaacaaaggaaaaatgatttatcaaatccttttgggaaaggaaatcaaggagggatgtatattggacttgtttagggtggcattggtgcggcccaggtggcttgcgcagcgcagccgaaccgatgggctggcgcgcgcgtgtgtgggagacggcctaagaggggcgcgacggttgcgggctgaggcgcggggcgagtgggccggctgagcatgacccacgcggcgcggggcaggctggtggagcgaggccgagctattgcgggccggtggggcgagcgcggcccaggcacacgacgcgggcgcacatggctgcgggaagggtgagggctgaccgggtcagcttgactcggtcaagccgaggtggctacgacgtggccaccacgcgggcataggagagagagggaagcggtggtgaggccgaccggggatccaacggtccacggcgtgcgaggaattccggcgagcggcggcgaaccggagtgggcggcgggcaccggaagcgagagggggtaagggcggtcccatccaccggctcggatgagggagaggcggccggcgacggcgggatgggtggcatggcccgagcgcagccggcgaggcgggcgactggggtggcggtctgagaaggttcaaggggacacggggagggtcgcggcgcaagaaatcggcgagagaccggccggcgacggcggcggaagcagagctacggcggggcggcacagcactgagaggggcgtcaccggggaaacagagagggggcgcgaggagttacgggagggcgacgacgaactggttcgacgagagaaaagggccaacgacggcgcgcgactgcgtggtggcggacgcagcatagcgtgcggtacgaggaggaagaaggcggcgatgcggaaacagagcgcacagcgagctaggcgagtgcggggacggcgaaaaaggaaggtgaggagctcaccgacaggaggaacggtgtcggcgacgatggcccgatggtgagaagggcgggaagccagcggggagggcggccgggctccacggaggatggtgtttgcgacggcgaacgcggctcgacggggcagaattgcgtcggccgagtggtggtgcctggcggcgaacttgatgccgaggcgagcgcgccgggaaggagcaggaggaagacggcgacgagacggctgcagctccgaggttgacgaggccgacactgaggcgcacgtggccatagacacagtgcaacagcgggaaggaaggggctcgggatgggattttataggcgaggaggcgcttgactggcgctcggctagcgagcggcaatggcggttcgtgggtaacctgaaatcgagcgacggcgtggatgcgtttggatggcgaggtcggtggatcgggcggcatgaattgaatcgtgagtgcgggaggggcagctcggctagttcaaggtggggcgcgacgagctggcggctggcatcagcggcgtcagggcactctgcctccaagagcaaggagacaaaggtgggagagagaaaccaatgtccaggagggaaaaagaaatggaggacggtggaaaggggagcttgctccttccgttttggggaggtgcggcaggcgaggcgcgtgggagcggtatggggcacgcgacgcaggcggcgcaggcgcgacatggcagcttccaatagtaccacgtgtccacgtctgatacccatgagtatcagatctgatacccagttactaggtttgaatattgggttgaataccgaggtaccgagtatgatacctatgaatagcagatgagatagcgagttatcgagtctgatacctatgaccatcggatcgacccatgtaaacctaaagaggtgtacgggtagtgtcgtattggagtattgcatagctattttgtatcgtaggagaaaagagcactgccactagtcgatgtagacctgagggtctccaatatgaaaggacagcacacaacacgttttcagagataaaaagaatccaggtctgtttagatctcctagcaaaattttacaccctctcacatcgaatgtttggacatatgcatggagtattaaatataaatatccgggcctattgagatctcctagcaacattttatactctctcacatcgaatgcttggacacatacatggagtattaaatataaacaaaaaaaaattaattacatagattgcatgtaaattgctagacgaatcttttaagtctaattgcgccatgatttgataatgtggtgttacagtaaatacttgctaatgacgaattaattaggcttaataaattcgtctagccgtttacaggcggattctataattagttttttattagtctacatttaatacttcaaattagtgtccgtatatcgatgtgaccggctaaaactttacaccccttttaaacacccccttaggctgtgttcgctcctcctggttggtaacactcccgtccggcatgaaaaacggagcggtccattagcacgtgattaatttagtatttgcatttttttttcaaaaatggattaatttgatttttaagcaactttcgtatagaaactttttgcaaaaaacacaccgtttagcagtttaaaaagcgtgcgcgtggaaaacgagagagatgagttgggaaaatgggcatccgaatacagccttagtgagtaatggataagtagaatttatacactataccgttgagacggtacaccgtcccatatatttctccaacggtaatatctgcaacggtagcatcgcgtaaaagaaagagaaatctcccgtccggttgtctcctccgctgcttgcgccgccgccaagacgagtcgcggttgagcatgtgaggggcggcgatctccatccggcgagcagagcaggggagaggagaggatcctggtgaggggcggcgatctccatccggcgatcttctcgggcgctcgcgctcccggtccccccggcggcgatggcggccgcggcggttggggtggcgagcagagcacgccggagttctggctcgaggggagtggcattctgccgatggacgaacggcctcctccacccgcgcttcgtcttccccgaggccgccgcggtggcgggctctggggctggctccgctcaaggtacaatccgccgcgaactccctaggttttctttttggtggctcggttgcgggatctaccgcgcgtttgggtgctcggagattccgatgggtgcgcttgcttgcttgcttcgcgttccgatcgatcgttcatcagatcaatgtgatgtgatgcctgtcgcatgattcgagttctatatagtagattgatgcattaattcatttgtgtacttctctgaaatttggggatgtgagtagtaggttatctgaacttcacgggatgctatcggaccaaagtaattagagaatttccctagggtgtttgggtgctggattggagatgtttagagtggagactggacaatctacgttacaggagttcttctggtgctacgcatattttgtatccacttgtttaagcttatgctttaggaaatgtgctgctctgccccggcacacacgttgcattaggaaatgtgctactctatagtgaactgcggaattaattcctcaccatgtgttttctttggggatacagactgcattgcattgagaaacgccattatgccaatgaaaatttctccatatgcttcctatactggttcacatagtgttcaacactgtaagttcctgacagctggaacttacagctaggatgctgtaagttcctcacttcctgtgcccatgttctgaactgttccatatgcatttcccacttgatgttatttcaaattgctgtgttccacttttgggccatatatctggcagtaattcaaacagatatagttttgccaggagttctagctaacgtctcttcccggtccttgagatcacatctgcttggttttgcatgtcctattgtttgaaacttgctgcctattagaacctccttagttgtctcaatacttttacttttattactgctacattaattatcttgttgctgagccctgcaactaaaaccctcccccttcccccctctccactgcagagcacagcgcgaccacctcagacaaacccgaggttttcttcttctcctttttgatcgatgcagccgttgttcttgcggggaaagggttctttttttccttttttattttgtggaggcgcggctgtgggcgatgggcggtggctgatgatcgggggattaccaccaccttcgtgatctctcgtttttctctgtggaattggggtggatggatggatggatactctgttcatagatggcgacagtccaagtttattcctttttatttttgtatgttttttccttgttgggtttgttctgttgctgtagttgccgtttcttggcttcttgctttcaatgtgttctctcttctccttctcttttttctttctttcttttttgttgttgtctgttcttgggggtaagggtgtcccaatcgtattggacaagccttcgcgtatgtaactgattggaattggagtgtggagttagacgccgacaggtgaggcagatgaacaagagttcccaacccaaaagttcactaatgaagtgaagtgtaaataaaataaaaagtaaataaaagggagaaaatactaatagttgcttggggagttgggattctccaaaagatagtgtctttttttcttcctttttcggttacgcttggtgagaagatgatttatttggagatggtggacgacgcctatttctgttttctggctgtctaattctgatgatggcgtctcatgtttttcaggtgcgttttgcgtgaagcgggttttaaggatggttctaaacaaggtgctcgagctgttttgtgtgaagaagaaggattccaagaagaaaggtgctgcacagctgcactactgcccctatttaacatcatctttacgtcagctgcttctgtttgtttgattgatcctaggatgctttcctcatctgatggcatattatcagttcgtcttgtgcactctttcttccatgaattctgttttttttttcaaatatgaacgtgttttctggtgaaaggatactgcagattaaatggggttgtcataatggattgacattattggataattgtggctgctgtacattattgctatatcagatgctttgaggttaacaaagtataccaaaatgtgatatgtgtagtaaacttaatctcaacagattgagagtgctactagtgtgattggatatattcactggagagtgaacttgtgaatagtctggtattatgaatccatgagtcttggtgatcaatattgttttgaagtttgttaaactgtataatgaaaaaaaacttaatatttcattagcctgtatacccagccacgaaatccgcatctccctctgaagcatggaattctccttattttgtttcagaaagataaaatcaagtgttttgctcttctgcctggagctttctaataaaagaatattttcatgcaggcaaagccattaatcctctttgtaaagttatcttttcatgcaactttttcctccttgtttgtttttgtaattcttatgcttcatgtagctgaacctgttcttttaaaaaattaaaatgaacaaaaaaaaaaaaagccccccccctccccgtttacccccaaaggggatatttgttactttaacagaactacacattatctaatgttcatcactctttgctttgctgtcagtcggtagtattgatgcaagtaaacctcttttttgcagttaaatgagcttcagtatcctattctgtatctctgtctttaagattggtgtgcctttttttgtaacatcttggtttgaaactagttactctactggctttcagttgccgctccacaccccactgcaaatgtcagcacaaacaacagccttttggatcccttttcaactgggaatggtactgtgctatctgtgcaaaaacatgagcctgaatgttcaagtgttatatcatcaatgacaaggacagaatatggatttgaaagtgatggttgcaatttgtttagccattttgatgttgttcaagatttttctgaccattactatgcaaagaattcaccagggaaggtaagctgtgcgttttatgaattctatttctatcaatagatccaactgtgaattaatttcctgtctttatctgtggccactgatcagacctccaaagattgggtgaagacaatccaaaatgaatggaggcttctacagaaagatctacctggtcagtacatgcttttatatggcaaatcattgtattcaattttatcaaaccgtcagtgcctagatggtgaacacatataatggtcctttcttatactgacctctgttttatgccaattatatctgatccgtgtgacatgctaacagactatgtttgaaatctttcttgagttaaaggtagtcacatgctcagtttgggtttgaataggatatattcattggttataccaatttgtttgtggtttggagttttgttacaactgttgctgaatcccgaactagctaatgatattgtctatgcttgatgtataaaatactttattcgtgctatatctgatttatctgttagtttttgttaatgtgtcacatatcttttagttatggtctgcatttatcgtcccttttccatgcaatcttgtcatagaagcataacagtcttcagaacttaatcttgctaagtttgggtaatgggacaaatggaaaagaatgtacatatctcaaatcatgttgctgaaggaagctaatgtatcacaagtatcattacatacagtttacatttgcgccttaagtttttcgtttagagcaactgtgactgaaatagctgatgtcttcaatactagaaacttgcatctcagtctggtttcaatcatgcagaatctatctatgttagagtttatgaggataggattgatctgctgagggctgccattgttgggccagctgaaactccatatcatgatggtctgttcttctttgatgtttgctttccttctgaatacccacaatcccaccggtatgaaaccacttcacacacgctttccaccattattttcatgttactaccaccactggtataacctctttaaaataatatccaacgtgtacagaaagttcattaccatatgcatttcccacttgatgtaatttcaaattgctttgttctacttttgggccatatatctggcagtaattcaaacaaatatagttttgccaggagttctagctaacgtttcttcccggtccttgagatcacatccgcttggttttgcatgtcctattgaaacttgctgcctattagaacctccttagttgtctcaatacttttacttttattactgccatattaattatcttgttgctgagtcctgttttgatgattatgcacaaagtattcagttgttctggtacctaaatgagtagtttgcttgctggcgtatcacatgacttaaacaataatacttctctttttgtaactgaaattaagtcaataaaaagggaaaaaaaacttgctattacatacaaatcaagaaattaagtcaaaaaatggagaataaaagaatggtaccttcagtgtggcccaattgaaaggttggatgtgatagtatgccaagattgttaggtttacatagaatctttcgtgagaaccattgccattgtaagatcatccacaaagaataccatcaatgcatatgtattatcatcctgtgtacaaaaatagcaggcagcaaattaaccaataaaaaactgctcatagcataaacaactaaacctaaataggaccacatatatcattcatgttgaactaataatgagcagcaaaccagaacagggatcagtggctagatcaaataggtacacttgcatatagtatatagaaatcatagtacaacacaaagggaaaaatcgttcattgctttaagtagaactgcataccaaattgggtttatccgagtcgtcgccatacgctggtacagtcatggcttgttattgttgtcctagtcatggctgagccgccgctctcaatctctcttatcgtccctggcgtcctagccatcgctcggatctggcactaaatggagtggagagcgattagaagagggcgagagcgagggaggcgatggtggggtggggatggaagaggagaagatggtggcggcgactcgtgtccctcgcttccctgtggccagatccaccggtgacttatgcgatggcctctctcggagagagcggcggcggcgcggtgaagatggctggaggagggtgaggaggcacgcgggtgaggatgggtggcggcgctagttgtgacgacgcgggtgagaggaggagggcggctagggttttggtgcggtgtggtgacatctgcgccgttcattcccaatctgacgagcgcacggcttaggcagccacaaaggaacacgtgggtggtcagatcgacgttagtgcgagatccaacggacgacaacaatggggcctggcacgtaattaacagaactgtggtggctttttttgcaaaagtgatagctgacgtggcatccctacttccagcaatcccacggcatttagagagattaatatatccagtggtccaaaaccaaattggtgtgttggctggttaagagtgagtgcaacttttatacagtcgcatgtgcctgttaaatatagttgttagtgctccacttgaaaaagttgctgttatttgtttaaatcttatgctttagctggaaaacagtataatctctaaagcagcatcggcattttcgaagatcttaacatttggttgattatatgcagcttgacgcatgtgcacatcccttctttgatgagctacgagagcccaatgcacgcctgccatggcaaatggtcgtccattccctcctctgttcaacttcaagcatgaagtaagtaaacgagaacattttcgaacagtcgctttttatgttacatttatatttacctgtcatggatgcttatcaatgctcatttctgcaatgcagctaactggcgcctctccagaactcgtccacagactcataccggatcatatcagacggcaacatggcctcaacttgcgcatgctgggagttagaatggcaccgtaacgctcaccgttttgttcgtttatttttccatgagctggacattgcaatcctagatgactccattgtcttggattgggactccatctcagattgcaccatccatgattcttccatgatctatccatccgtcaagccatttccgcaaggactcagtaccagagaagtacaattatgtaaaatatctagccatgggagaaatgcgtgctgctgctgctggtgttaagtacgtgacagggcatgctggttgagtagtaggtaaggttaaggataaatgtagttggtggagactgagagacatgttaagctagggaaccctgctttctttttttctcctttcattttggtttcttcccattttgtgatccttagcattgccctacagtagtgtagctgctcccagtttttgtttgctctttcatcatgtaaatgccaatcccaatcccaatcgcaatgaaccctcttcctttacatcctggtctactccctgtgagtcttaggtctgtgagtttgtgctgctggttcttcattcaaggtggcttgggtgtgcgttctgatcgatttggcgtgacgtgtttgtttccgtagggaaggactgcaaggagaagcaccctaacgtcaagcaggtatcttgtggcgcgtttgtgttgctctgctgcattaactgctacaatgtgtgttctgacttggttgatttggtggtgacaagtgcaagtccatgtctgatgctgtgagttcctcacttcctgtgcccatgttctgaaccgttccatatgcatctctcacttgatgtaatttcaaattgctgtgttccacttttgggccatatatctggtagtaattcaaacaaatatagttttacccggagttctagctaacgtctcttcccggtccttgagatcacatccgcttggttctgcatgtcctattgtttgaaacttgctgcctattagaacctccttagttgtctcaatacttttagttttattactgccatattaattatcttgttgctgagttctgttttgatgattatgcacaaagtattcagttgttctggtacctaaatgagtagtttgcttgctggcgcatcacatgacttaaacaataatacttctctttttgtaattgcatttcttggttcaagcttatatctcagttgaccataggctatagtggaaagttcatagatcaaatatgttaagagtaatggaatctatttactctactgtgcatttaattgaagcagagatttcttaatctggttggctatttgatatcaggtgaaagcaaatatttgaatgatattatgtgaaacatacgacaggttttggcacttgacaaatgctttgttgacccacgttgtttattaaatcccacacaagaagtaatgaagagggcattataccattaacagatgctattcccaatattccaatcgtaagttttattttatgttggtgaaaatctagttttcattgttttctccataaatgccttgcgtgtgtaattcttgtacatatactccctgaactgttattaatatatttgaacagtatgattcatatgattctgtcccgtgtttgattaaaaaatttaggatatcgcctaaaagatgctattagctgttacaatcttatcatgagcaatttatgatctgcacaaccagtaagtgattgctaatttcacgttagaatgatggcatagagtagaatgaattgtacctttgtttataagttaaaaactttgggttatttattcttgtatttggtaatacaatgatgtcctgttgccttgcttctataacatggcaataataggtcgggctactcaatgtcgctaagggctactatggctcagatttaccttttttttaaaaaaggaaagcactaaactaattttaatttatctttgtaatgaatgattttttgggattgtgtttctgtgtgtgtgcgggagggggatgcgaatccgtatatgttgttaggggcatgcggatttggaaatttcaatacaccgggaagggcaaatttattgcattgttcatgtatatggtatttctctcaagtacaagagtacattgatgacatatattcagatgtttgcaaatttctttactgtaatcttccattatcagcttatagccaacaggaccagtttattacaagggtaccaagataagtttttttttttctagaaaggaagacaaatggaaaacctgctacaagt

SEQ ID NO: 68051 - DNA, 1469 bp, Oryza sativa
taagttacaacttgtttttttttagtttgatttcttcatttacaaactctctttttgggacttccttttggactttaaagctttattttatttctgaaatgcaaatttccataattttgtttgaacttatggttactaggttgtgaaaagaaaatatttacttacattccaaccttgcggctttttttttgtccctcgacgcttcatttttcgtccacgtttcaactctatgttttgagttggattttatttatcttcgaacgttcttctctattaatggttttgatatgctatttggactttaaaactttgatttggtttctcacttaccggttgttttttaatcccttagtttcagcttggtattttcagtttgatttcttcaattacaaactttcttcttggaacttcactttcgactttatagcttacttttgctctaaaatctcattttccgtaattttctatgaatttacgcttactagttttttttttctgaaatcctaatttccgtaattttgtttgaattttttgttactattttgtgagaaatatttgcttgcatttcaaccttgcggcttttttgtctctcgacgcttcattttctgttctcgtaactttatgttttgagttggcttttatttatcttggaacgttcttctctattaatggttttgatctactatttgaacttttaaactttcatttggttattcacttaccggttgttttctaatccttgaatttcaactcgatattttcagtttgatttcttcaagtacaaactttcttcttggaacttccctttggactttaaatatttattttacttctaaaatgtcaattttttgtaatttcgtttgaacttatgtttactagtttgtgaaaataaaatatttgcttacatttcaaccttgcgtcttttttgaacgcttcattttctgtcctcgtttaaactttatgttttgagttggatatctttatcttcaattgttcttctctattgatggttttgatatgatatttcgattttaaaactttaatttggttcctcacttaccggttgttttttaacccttgtatttcaacttggtttttcagtttgatttattcaattacgaactctctttttggaacttccctgtggactttaaagcttcggtttacttctgaaatttcgtttttcgtaattttctatgaagttatgctttctagtttgggaaaataaaatatttgcttacttttcaaccttgcggctttgtttccctcgactcttcatttttcgtcctcctttaaactttatgttttgattttgatttcttttcttcaaacgttcttctctattgatggttttgatatgctatttggactttaaaactttaatttggttcctcacttaccgttcgttttttcatcctggaagtacaacttggtattttcggtctgattttttcaattacagactttct

SEQ ID NO: 68052 - DNA, 2120 bp, Oryza sativa
atcccaagtttcaagcttatggccaatagtataccaccaaaaagatgcagaaccggtacacttattaatagcagccttaatcatttgagcattagagaaatcatactcatcaaattgtttgtctactgctagctcccaattaacataagcggcggaatcatacttaccatcaaaaactggcaatttagattctaccattgcaagatcattttcatgtacctcgtatgcaatgcgtgaaaaagtcgctatatctcgttgatggtgaagaagtcgaggttgagcataaccatctcgtttccccttgtgcaatcctgccatggttagtagcaaacaagaaacatacacaagaatatacacgctcctatcaactactaggtagtggcagctgaaatattacacacactcaagcttttcaccaagctcttacaagttcttaccaaagcaagcggaatgttaatgtacactgactcaaccaagcaccccaatggagtttagatgtatcgatgccttggcaaacatttactgtacggctgcaatcaaatctgtggagctctgggtaggcttaaatatgtagcaaaggaatagcaaatgctcaaagcaaagaatgcaaagttgaataattgttcaaagtcaagtaccgagctggtcctaggctagaacgtactagagacgcgagcctagacacaaacgataccacaagatagcactagaaacaactcatgcatgctctgatatataaaagaaatctcaatgatacaactgattttctcttttctttttcttctttatttttctttttttttctttttttcctttctctttttttggtgcggcttttgttttctctttttttagcacctttctgcctttttttttattttttttgattttttttaccaaaaaccgactcaaggacctcaatgtaaggtcaaagggactcaaatgtaaatatgaaaattacagggactcaactgtaaaagtccaaaccaaaattaaaaattatacaaaaatggaatgctcaagttatgtcggttccgtttttgcaaacggatcttgaatccgacaccaaaataaaatttcaccgaagtgtttaaccaacccagacagaaacaatcatgagggagtgtgaatcggactcacaagtctcggccacgagatgacgcaagggaaggaatcccactcggcctcggtttggaaaggtaccaggtgataaatagaaacatactcgacactaaatagaaaccaaaccagtcaatctaatctaatattctccttccatctttctcacgcgcacatgcacaagcgcaccatcacggcacagccaccaaacagaagctatgcaactcaagaactcaaaaactaaccgacagaaacttctgaaaactacgaaaaaagaaccgtggcagcgagccgattccgttttcgtagatcccgacgacaacagagacacgggggcggcgacgactatggtccaaaacgtgaccagaactcgaaactctaaatgaactagacgctaataccagcaacacgactcgacaatgcaacacaaaactcaacaacgcaaaaactgaaaagaacaatgcaaaggcacaaagatggctaggtataggatacaattttttttgttgggaaattttctggttataggtagataaaaactcaccgagcaacgaaagctctgataccacctgataaaccctgaattcctctcgaaactcaaggctgttgttggcccaatctttcggtgagttgtgataactacaatttggaagaaacgttgacgatccgactacaaccgtactagacgttgtgttgcgccttagcgatcgatacacctctccgtgggttgttgatcttgccggtgcagattaaccttattcctgcaagcaaatcgaagaaacaagcaagaacaagataaaagcaatatgaattgcaaataggaattgagcacaaatgataagttggggtttcgaatacaagcagacgacggtctagccgacacgcgcgctgcaaggaagtagcaatggctaaactttcatctaaacaaaacccgagataccctgaaggggtaccaagctatttatggagataggaggaccctaggtcgtcctccacttgat

SEQ ID NO: 68053 - DNA, 2880 bp, Oryza sativa
ccactcgtcaaatatggccgtttcatatgagaatgtcaagaagcagggatgtgttgagatcgtaggttttttttgtgcgtgttctcctctttaacgaggtgtgagtctaagtgctcttgtatcatttggctgtgtatatccctcgtggatatagaggccggattaatgaaaatccattatctattaaaaaaaaagatagccccccagaagcccagttactcgtaggggatcttttctgcacctccggcagatatcatgttagtaggaacctgcaaaacaaatcatctaaaagaaactactggaaaattgctaaagcgaatcatagaaatttttttgagtaaatttcacattggaccaccattacttaccaatgttgtggcttggaccaggcatgagcgtttcttttcactttggaccgaatgtattaaccaaatattccatttggactggttcttcttcctttggttgtcctcccttttctgttttgtgatgtgcaaccttgcagtacccgtgaacttggcctccatgctctctgtgctcaagctaacaaatttactgctagagccaaccggagctagcggcgttgagaaaaatgtgagaaaaatgtgaatgcaagtggaacgaaaggaggtgcttgtgctcctggacccggacaaggcagagtgttggaggttgagaccatcaagatcaaggagaggaaaaaaccaggagtaacagagagcatagtgtcgctgcgtcggtgttggtggagcctaccatggacaagcgtgggggtaggggaggggtcctgctcaccaacatggagggctcgatattgagaagggagagagaggatgggggagagctagaggaagaacaggtccaatgtgaaacatttttcaaagaacctaggtccaaagtgaaaagcaagggttacccatagcccaagctgcaacattggtgaaaaggggtggccccatgtgcaatttacttaaatttttttgaagtttttttaaatgagtttcaaacaccaacaccctgtaaaacttaacaaattaatgttttagaatcgaaaataaagaaatccaactgaaagcatagagttatcaaaggatggaatatgaagcgtcaagagagaaacctagaaacgtttgatacaaggaaactgcgattttcatacaagcttcaaggtgcaacaaaatcgatgggtctagctcactacaaggttatttattttcgataaacatggacacaactatacaactcaattatacaactcaatcataagttcaaaattaacttctgagcaaaataaatcggtcaggtgtaaatgcaaaagaatattttgtttttataaacgagaaaataaagttcaaacaaacttaaaggagatgaaccatgacaacccaaaaaaatttgaaactcgaaaaaggatatttgaagaattgatgcaagacgaacgttttaaaatcaaagaatccaactaaaagtacaaaatataaactcttggatgaaaaaatgaagcctcaacggagaaaccaagatattgtttggtacaaccaaacttcgatttccataaaatcaataagatgtgaccaaatgtagacgtctagcccacaactaagttttttttttcgataaacaaggagacgtaactctagaactttgttataaggccaaaattaaaacgtcagagcacagaaaatccgcaaggttgaaatgcaaacagatattttcttttcgcaaactagtaagtataagatcaaacaaaattaggaaattaacaattcagaactaaactaaagctttaaagtccaaagcgaggatcaaaagtgttaatacaagagaatattcgaaaataaagaaatccaactaaaagcataaagtataaacgaaaggatggaacacgaaacgtcaagggagaaacctaaaatcattcgatacaaggaaaccgcgattttcataaaagcttcaaggggcaacgaaatgcatgggccttatgcacaacaaagttatttgttttcaaaaaacagggagaccaacctctacaactcaattcaaaattaacgccggagcaaaataaaacggccaggcttcaatgcaaaagaatattttgtttatataatctagaaattaaagttcagacaaatttaggtaagacgaacgataacaaccgaaaaaacaggaaactccaaaaaggatatttgaagaatcgatgtaagaggaacatttcaaaatcaaggaatccaactaaaagtgcaaaatatatctggatgacaaatgaagcctcagcccgcaaggttgaaatgtaagaaaatattttcttttcacaaactattaagcataaattcattgaaaatgatatttccgaactaaaataagcattaaagtccaaaggaaagttccaaaaagataaactttgtaattgaagaaatcaaacagaaaataccaaaatgcatgggttcaggtcataataaagttatttgttttcaaaaaacagggagaccaacctctacaactcaattcaaaattaacgccggagcaaaataaaacggtcaggcttcaatgcaaaagaatattttgtttatataatctagaaattaaagttcagaaaaatttaagtaagacgaattatgacaaccgaaaaaattggaaactccaaaaaggatatttgaagaattgatgcaagaggaacatttcacaatcaaggaatccaactaaaactgcaaaatataaacttctcgatgacaaacggagaaaccaagaaatcgtttggtacaactaaactacgattttcataaaacaataagattcaaccacatgttgacgtctagcccgcaaccaagacattttttttgataaacaaggagacgtaactctagaacttagttataagtccaa

SEQ ID NO: 68054 - DNA, 1121 bp, Oryza sativa
taaaacaaagcttttaaagtacaaagagaagataaaaaaagagaaacattgtaactgaagaaatcaaaccaaaagtaccaaattgaagctcaacgatgaaacggtaaagaagtccaattaaaaacataaagtcaaagcataaagcataagttcaaacaaacttaaggaagacgaactgtgacaactaaaaatattggaaactccaaaagtgatatttgaagaatcgatgcatgaagaacctttcaaaatcaacgaatccaactaaaggtaaaaaatttaaaacttatagatgaaaaatgaagcgtcaacggcgaaaccaaattttttttttaggacaagcaagctacgatttttataaaatcaataagatgcaaccaaatgaagacgtctagcttgcagccacaagattttttttccataaatagggaaacgtaactctagaacttatttataagtccacaattaaaacgtcatagcacaaaaaagccgcaaggtttaaatgcaacgaaatattttcttttctcaaactagtactacctccgtcccaaaatttagctatttttagcacagtaacttgtctcaaaatgaagttatttctccacgtaccctctcctctcaaccgatcacaaccattctcttcacctactctctcttctccaccaatcacaaccatgctccaattatttctatctactttcctaatatccgtgcctacctaaaaaatacatacattctaggacgaaggaagtatgcacaagttcatagaaaattacggaaaatgagatttcagaactaaaataagctataaagtccaaagggaagttccaaaaagagaaattttgtaattgaagaaatcaaactgaaaataacaagttgaaactagaggacgaaaaaacaatcggtaagtgaggaaccaaattaacgttttaaagtccaaagagcaaatcaaaaccattaatagagaagaacgttcgaagataaataaatccaactaaaaacataaagttcaaacgaggaaggaaaatgaagcgtcgagggacaaaaaagccgcaaggttgaaatgtaagcaaataatttcttttcacaaactagtaagcataacttcttagaaaattacggaa

SEQ ID NO: 68055 - DNA, 2941 bp, Oryza sativa
  unsure (1)..(2941): unsure at all n locations
ttgagtggctgcccatcatgtagagtttgaggcataggtttctgatggaggtgtctctctgtggcacagatagcaaactcgtagctgctttggtgagagctgacatagcttgatccatgtgcacagtcgttatgctactgaacgctggggcatgtaggaattctgcaacatccaaatccagcttagttaactaccaaggtaggtgcctccaccgcgttgacagggcgcttgtctttgcaaccgtactaatgttgagtctcgccaagatatccaacaaaatatcgtcaggtagattgctgagcctatcgccctcctccgcttgctacaataattagattacacaaaatatgttagtggcttgaagcattaaaactctaaagaatactccctctgttttttaatagataacgccgttgactttttcttacatgtttgaccgttcgtcttattcaaaaaatttacgtaattataatttattttattatgggttgttttatcactcatagtactttaagtgtgatttatatcttatacatttgcataaaattttttaataagacgaatggtcaaacatgtgagaaaaagttaacggcgtcatctattaaaaaacggatgtagtacttataattgaaaccaagaacttacaaaggtgtgtccattatctatctccatgtggaatctgacttgccttctgcagcgaagctgctatgttgaaagcccaaagcttacgacctgacttttttatgcagcaacgaagttaagagccctttatgcgcntaggaagccaagaaacncaatgctngtgtttgttgttcatgacaaaggttcggctgcccttttgtgggggggacatgagcattgagagtccgactagaataatgatatgcccaagggctcccaaatattcccaaattttcttggttccaatagtcgccgccgatccgacaatctgcccctggaaatagcacactttctcctcggaggaggcaggagaaaggatactcaaaaataaccgacaatagtatatgaaagcgagaagatgagtagagtaaccacaggcgagcggcggcgtaccataccgtagttcggaaatcttagcgtggtagacgccgggcagggtggtgacgggcggagcggcggcgggcgcgcggcgggagatggggggattggcgaccgacgagcctaagaggaaggaggagacgaccgtcgggagatgggcgaggggagaggcttcatcgtttggcttattcatatatttacataaaaaaaataatttgtgaatacaacttttatatacgtattcttaacgatccaaaagtagaggctaaaaaataaacttaggtgaaaaaaatcccaaaaccaactctaaattaaatgttaaaaatttaaattttggctgataagcaaaagatggggctggaagtgcgaccatgtcgcacacacgggccacggcctcctgacctcaacaagggaaagcggagatgggccgatggctactcgtcacggcccataaaagctcgcttgttttgggccccatatattgggccgggcatcctcagatttctttttctcagagaaaattctgaccggagaatctctcgatcaacagccaacgtggtaactcaccgtgcaggccggaccgccagcagaattcctaattcccgcgtatgcgccgtcaacgcgtacttccggcccacacacgtgtttctttttctcttttttttttggcgcagttaatgtttgcagtgtcataattgtaaatcccccatttgctaccgccatgtttcttcctttttttttcacagttcgatgtcgcacgggtaggagaaaaaatcataattagtttactagtaatttttaaatcttaacttaaaaattttcagatttggtcttgaaagttttcaaatctcgagttgaaagttttcaaacctcgagttaaaaatttttaaatctcaagttgaaagttttcaaaattttcaaatctgaacttgaaagttttcaaatctcgagttgaaagttttcgaatctcgagttaaaaattttcaaatcttaagctgaaagttttcaaaattttcaaacctggactttaaagttttcgaatatcaacttgtcaagttgaaagtttcaaatctgagttaaaagttttcaaaatttgactttaaaatttgaatcttaaatcaaaagtttcaaatttagtttaaatttttgtcaatctgttaataaaaaaatctaaaaaaaagataaaatctttaaaaaaattcctaattactgttattaatgttaactaatagagatagttaagtgggaagtgcgcgctagcggcacactcgcctgctagccactgccactgccacagtgcaggttgcatgacttgcatcccaaaaacaaacaattaaccaaaaacaaaaaatcaaagcagtatagggagatggtgaggcagctttcggcttggacacttggacgtatacaccaccgactggctccgtccatgcttggctgctctgcgccgttgcctctctcatctttgaagatttgaagaggatgcaggcaatgcagctcgagacgaagccaaaaacagcgcctatgcaatccaagcacggactctctgtaaaataatacacactcacactactagtagtatactaccactacggtatactactatgagacgacgacgatggtaaaatatcataattcgataacgtactactcaaagtcaccaggttttttcttctctcttttttttgttgatgttttgtccacaaaccaggcaatacaaattccaatgttctttttgagaaacttcaccagttacggtggaagaaacaatcaacaataatacaatgtgaccatatatataggtacatggtacactaaactcagtaacagattctgcgctcccgcgcacgatacagccatacagtgcatcataaaacattac

SEQ ID NO: 68056 - DNA, 1634 bp, Oryza sativa
tttacgaactagtaggagagaggacaaggtagagctatataatatttggtaggtttaatttgtttgcatgaaagtatcaataactaactaattatctttggtggtgtacatccgagaatttttttgagaattaatattatttttatggaaaatcgcaaaagtagtggccaaccggggaaaattgcgaaagtagctccctgtcgaacgggtgcagttcgatagggcacctatcgaacgacgggcagtcgacaaatccctatcgaacggctggagttcgacaagctcacctgtcgaacggagggagttcgacagggcccatcacccggcgccgcgaggcctgtcgaaccgggggcgttcgacagggccctccaccgaccctgtcgaacaatgggcattcgacaggccggtttaaagccccgtccacccaggccgcgatgcttgttcgatttgtttgaggaccacatcgccagccgccgccgagagtcgccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtatggttaaattagttcttagttagtacatattattgatatgttgtgtgttaaaataggtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgttaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaaactctgccttatgttcaccccacgcagggagtatctgggtcggcacacttcccttacatgccaacgggggacaacgtgttgaacacatcagcatggggacttcatatcactccgcgtgcgccagagcagggccacacaccgcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccccagggagaagtagggatggattactggcacgcagcacctcaggtcacacagccgacgcaggagacggaggccggtcaggggccagacgtgacaccaca

SEQ ID NO: 68057 - DNA, 1912 bp, Oryza sativa
aggtgttgttaaggaaggcgtaggcgtggtggaaaatggggtgcgggcgcgcgtggtcgaggcgctcgcggaggtaggcgtgccacagcttgtagctccccgggagcgcattgagcgcgcgctcgtagatgacggcgcgcttggcgaacggcgcggcggcgcgggcgacgaggtagcgccaccaccccttgagcttgaacggctcgcgcaggatctcctcctcgtacgccaggtcgtcctccgtcgggtacatctccggcgagatccccagcgcctccgccgccgccgcagacgccgccgccacggccaccggaccccccgcaggcgacggcatctctcgctagggtttagtgctccgccgcggcgaggaggatttgcgccggagagagagagagagatcgagtcgagacggagaggctggcttggcttggcttggccaggccggcgcgtcgttttgttgggccgatgagttggaacccgagtaggcaagggcttgagtggttttggtgggccttcagggattttgggctgaacttttttacggaggaattgggcttatttggtatttgagtaattgggccgagttttgtctgaaccagagcccaaccgtcagtcatctgcttctgctactctactcaaatatttctttccccgattttggtatacatttgtcaatttttttgttaaaaaaactacaattatactgtatttatatttgactacagatatatagatagtcctttttttcctgaacagaaactttaagttttttttcttagagaagaaactaaagataaaatattactatttaattatgtgattacgtgtaagagttatttgctgcaatgcaaatgttgaagtatagtcgtgctacggtttctttatatgccacagaccaggaaaaacttggcaagagaaaatagggtgcttttttggatagatgtcgaatcatgccgcacctgaattaggcagactgactagtgagtagtgactaccatcactgatacaacaaatcttggcgttggacattatccgtacgagttcttctcaacaatattctcccttggtccaaaaaaaccaatctagatggggatgaaataccacctagaacaacgaatctgatattccatccccacttaggttggattttttttagacggagggagtagctgaacaacgaaaatgttagcccctctatttttttgggataataggcagtgatcccagtatatgctgaataaaagaggggcaaaaaccacaatgttaatgagactagatcctaggtggttgcgcgcacgcgaaggaacggacgacctcctacgtgcagcgggagggagggaacggaaggaagaagaacggcttcgtttttaaaatagtagagatatcacgtacaaactgccagtataccactaaggcgacatctaaatacatttcagcatgctcccataaaacttcattgtcaaggacaagaggtttggtatacttcgaagttcgaaagaaaaccaacattgttacattaccggacttctgctaattaaggctcaatcttgcacaacaattcatctatggaaagaaaaaaggagccattagctcataactccagattatttaatcaataatatgaaaactatatgattgatgatgaccaacaaaatcaatggaaagcctctatcagattcagagagctcacatcattcgtgtgcttttcaccttgctcctgaccaatcctccattccaggagtctatcagaattcagagagctcacatcacttttgtgctttcaccttgctctcgaccaaacctccattccaggaggcgcacgtgcatctgcataatctgcatattgccgaaccaactgagcacgatttcaggtgagcttaacagaatctgttcttgaacaagaaaaccaaga

SEQ ID NO: 68058 - DNA, 889 bp, Oryza sativa
gtgtggcgacggcgatggtggaaccgacacagcgtacgccaacactcaacacgacgcggcggtgggtaatacgcagcgccagtgcactacgtacgtaccttacctcattgtttgctaaattttaatttcagaattgattttaaaatttttttaatgtagttttaaaatattagtttcctgaccacatatttacccctatattataacttataatcagctcttaataactaaccaatggaagagtgaatcactgtgcagtcgcagttgagtcacttacacaggacatttaaactatttgccacctttaatatgtgatgtttaataatttattactcacaatctatgacgtgcccttttacatatctacaagtacgtagtaaattgttaaatgtccacttacatataagccccgctctaacttttgtgcagttttcgacatttcctgtgaatattataactgtaaactgtgtatctctataactgtgtacaaggaagcctcacccaacaatggagttgtggttcattttagcaatgaagggcttttagtacttccaattctaacgcaacatattgaacgcacttaactgtatgaatatatcggacgcactcctacatcccgctgcgatgcaagtcgaccacggattcacgacccagagatccttttaacccctgactacaattttttgccaagattttcctgactcgtatttgcatacactcgaaaaacaatcgcactggttccaaggctaaacatctgcattcatgctctgaaactaaatctctttataaatatcaaatagagcactaatacgagtaaagctaaaagccgatatttcttatctacatgatgagactacgactagttcacggttgttgccaaataaggtta

SEQ ID NO: 68059 - DNA, 736 bp, Oryza sativa
aagcaaggttccagtatctaaggaaaagagatcccagaatgtatcaaagagtcaacgtaagaaatatctgcattgatctccataaaatacaaatatagcaaaaagactaatccagagaataaggttcattcaagtaacttacttgagaaatatggttgatgttattccggatgaagaggcggggttgcttttctaagactttgttcataacatctaggccctgagcaagtgctgttgcaggatccttggactgagaaggtgtcaaattcccaagcaatttctcaagataattaaatttaacattggcatttggccagacttccaaagcttgagtcagtagatcaagagcttgcttgtacattgagctagattccttatcctttggttcaatcaccagcgacacctgttcaatcaacaaaactatatgagtattcaagacctcagatcaaaaaagttctgctgaagacactagtaaggtggcacaaagtgatcaacattctcattatatcagaaaggttcacatgagaggatggaaccactaataggaatgccttgtcaatccactactgcaatcaaatgttacactgtgctttgtctcttttcaggagaaaaggcaagccaggccgcatgcctcaaaagcaatcacaatgaattaggcaatgaggcaccaacaacaaaagcaagtaccatcagaatgtccagtattattttttttaagaacattatcatgaaatct

SEQ ID NO: 68060 - DNA, 1023 bp, Oryza sativa
  unsure (1)..(1023): unsure at all n locations
ggagctcgccgacgccggcaaggtcttgcaggacatcaaggtgttcgtccagagcaacaggcggcgcgcgccaccgcctgaattgagattcgagagtttgatctgcttcgtaccgtacacgcgtcgtacacttcatatacttgagattttgaattgggatttctgtgattcaaggtgaaagtttaaggccgcagttaaaagtttcgtatgattttatgttgaaaactgtataatttgagtatgaaggttttaagttttcatatgaaagttttaaatttgaatttgaacggtttttaattcaaaaatgaaaaattgaggtcacagctaagtgtcatgtgaaagttgtatgaattaagatgaaagttgtatgatcatgcattgccaccgcgatgaaattttggcatttcatacgaagcgagtgtaagatcacttggctaagtttcatgtgttgaaaacatgctcaccccaacatgtcatagacttactagggtgttcgtatttgcagctaactatttttaccctttttttaatggtaggtgtcatacccgctttatactgaaagatgttggatcagtctttggagatgttcatacggatagagagtgggtttacaccggtgcagtccttggagatagtaaggagtaagtgtgggtacgtatgtaagtgtttaccccctccgtccaaataaaccaatcctaactattaatctggatatatgtgtgtccaggttcatttttagagtttgttttttttttgacaaattagtatgtttgtaccgtgtttggcaaaaataaaaaataaaaaaaaggcatttggtatagaaattatgtatgagtcgacgactcgtaagagtacatacctccaatagttacgcattcgggaatgtattttctacactcangtgtatgcatgtagtttaaatagttatataaaaatttcataaaatttgataagatggactacgataatataagatactacaaacatgtaagtctaaattcgatatacacatgaaaaacaaaa

SEQ ID NO: 68061 - DNA, 968 bp, Oryza sativa
tgcaatattacaaatgacacattcataaatgtaagtaatttatttttataataatgctattcatgaaaaagatcaagataaatttgttcccttatagctgcaattattgcaaagtatgtttcacagacacttatttaaactaattaaacaacgtatccacacatttaaatagaaagaaaggttatagtcgcgcgaacgcgcgacttaataagctagtcatatgtgaaaatggcacaaatgttctgaaaatttttgaaactttgcacatccatagtgtcgcaaaagttgtgataaaatgagaacttacgtgtatgcactagtaccaaaaccataactataaccacaaaacatacgattcagaaatgcagaaatcacagagaagccactctacggttgtgccttgaagattcctccatataattaatacaacccctagtgctgaagtaataatacagagacgaaactaattatgcatgtctaaaagttcttgttcagtttttcagggacggagagattgaccgactatgcatctcaacaaacacttattcagatgcattactaaaagtactttttttcagggacggagggcttaattacaatgacagatttattacaatactttactatccaagtttgccgcacctaggtttagtaagccgcaggtttttagccactcttggcccactctgttacagaaacagaggtatcactctagtccagaaagcaaagccgaccaagtcacctttactgagattaacgcaaaatcagtctttatttcttgagtatcatagccatggattttctccttgaaggaaacataatgctggtcgaaactggatggaaacgcgcccacttcgaacttcaaatctatgaaagaatccctccttacagcaaccaccgacctctttaaaccacgtgactcactgatgacaccatcaaagagacggatttccttatccaagttactg

SEQ ID NO: 68062 - DNA, 1034 bp, Oryza sativa
atgcattattcaattctttttcttttttgcgaggaaacattatttgatttcgaaagtgtacactgctactggagtgttgaaacctgaaaaatggaactgggagactgcatttctgttgctgtctcctgtggtttagcctttcatttgcaaagttattagttgagctacggcttatagaccgagtaatataatgatggtgataggtgaacaaaactacaaatttcgttaattcggattcttccaagtgaaccaaaatagtgtattcctttgatcacaaaataaccatcacaaaactgtcagcaattttgagcatatatttgcaatttgagctctgaaggtaatgagtagtggaaagcatgtacaatttgatcacaaggtctctcatcttgatctatttatcgttatccctttcttttaccaactcatttgtaccaaaagaatcaatcatatggcaactaaaaccccatatgaaaaaaaaaatcctgtcgctcacatccatgtagatcacctgacataatctgcaccgtcaagaaaatgagcatactgtgtcccattcagtttgttgctcacatcatcccagttcctgacaaggcctggaagaggactagtgtgaattttcacctgcctgctgaccagctttctcaccggaactccgaggaattcttgtacctggaacaatgcctgcattcatagagatgatattttagcaaagcgagggttatcattgatccttcgttacagcatttgaatatgttttagtacatttctgttgcggacaatatcctcgtagtagaggatcatgtgccgtgtggtgttgaagtggtccaagcaatctctgatgtatttctcggcatttctgatgtttggaatcagatttgacacatccagcaccggcttgaatttcgctaatatctcagcctgctcagaaaaaatatataagcatttcattttttttttcttccttgccaacatgattgatagtgatgttacatttctcttggaatggaaatatgtaggatttaagtttcaccaaa

SEQ ID NO: 68063 - DNA, 938 bp, Oryza sativa
atttaagataaatcaaataggtttaaattaaaaaggtattcaaataaagaaatttaaataaaattttaaaataggaatttgatatcaaaacaaaagagtttgaaattagaagaatttaggtcaaggtctcactgggatgggatctgtggttggagagacatgggtgcttgaagattgaaatggaaattaaaggaaaaagatttactttatagaagtggggcccacatgtcatatgtctcttcttcctccggttcttctctccttgcttcgttttcttcctctctgttagccagggaaccgagaggaggagaggaagggcgccgatgctgtggtggctaagatatgactgcgccggtagaggatggtgttcccgaacgatgcgcatccggggaagtcggtggttggcaaagggagtgaaggagatggccggaacggcgcaggcaagagtatagctctggcaacaagaggaggtggctgtggtggttggtttcggaagggtaaaggaaggggaaactaggaaaatgagttcacctcgtcgaggcaaacccgatggcgcaaggatttaattagtggaattccggtgagggagatcggccgacggtaggtggcagccggacatggcaggagagagagagagaggcagagctcgaagagctcgattggtgtgtggaaaatggagggggttcgtcttcttatataggcggtgagaggcggtggcgaatgacggttgcgaaggcagtcggcgacttggccacggtgacggtggcgtggagaagaggagcacggcgtcggcggcggcacatctggaaggggcgagacggcgacgacgctgtggttgcagacggcggcggcggcaggcccacagggaagaggaaggaggcggctcagctggggctgggtcgcttgggctgaggagggagatgggctgaggggagaag

SEQ ID NO: 68064 - DNA, 1521 bp, Oryza sativa
  unsure (1)..(1521): unsure at all n locations
agaagaaagacatctgaatttgagttaaaaggacaccaacntaggtggtgtgctgtgcatctacacctctcagttttggttttaattcctcttcactcaagacttgtaattgtccagaaggattttattattaggaacaaactgagactaacccttgtttgtgcaatcatttaaactcatcggtgtgctttgtttctgttttttttttctcttttcagctttgggtacaacctgaacaaaaacaattctgccctgcattcaacaatctaaagactttatctattctttgtgtttatgttgaatttgacctgttatgggctttaaacctccttgaagctgcgccatccgttgagctacttttcattgatgtaagttttcctttcgttttttcaaaatgtaacaacatgacagtaaatgtagctggaaattctcactatttgcaaaagatttacacaaaccaatttctcacactaaatgcagacctgggaacatatatgcttggtggaccaaatggatgaagagggaagaaaggatatctatggagaaagaacacatccttcatgggagatatccgagtttactggcaccagaaaatggcaattgaaaaaactccagttcactggctttaggccactcaagcaacaattggtctttttaaaggccatcatggagcaagctcgcaacctgcagactgttattctgaaagaggaagaaccatgcgaggactgtgaggcattaggcacgcctctttcttgtataaaagatcatgacttcccaaagtcgaaggatgagcaagacaatgtagtcgagcagctcagagagaagatttcttcggattcgcaaataattttccagtgtttgtaacatccccttcccaaattattttcctatagttttggaaaatgaatatatcctatgtacatccccgtgtacttgctacttgcaacggaggagttgtttgtcactgaataaatatctggaatttctattttagcttcatcctgatatccaaatacgtgtggaagtagttcaatgccatacgtactggtagcattaagaagaaccattgtaaatctaaccaaagatattactacctccgtcccaaaataagtgcagctgtaaatattcgtgctcaacgtttgaccgtccgtcttatttaaaaaatttgtgaaaaatttgaaaacatttagtcacacataaagtactattcatgttttatcatctaatagcaataaaaatactaatcataaaaaattttgagtaaggtgtattggcgatccttaaacttgtagggttatatcatatagttccctaaactctcaaaatgcatatccagatcctagaacttgtcaaagtgtatcatctgggtcccaaattaactcatcccctctaggatcctacgtgacgctgatgtggcaatgccacatggacgtgacgtgtccttttctctttttttcttcttttctttttagttttcttctcattcttttttttccttttttctgtacggtccacagcgaa

SEQ ID NO: 68065 - DNA, 833 bp, Oryza sativa
tggtttgcgtgatagagaaaacataggattggagaaaacgcgtgatttaaaatggtacccttctctaatcatatagaaatgaaacccatgcaaaaataatagaaggccccttaaatgccataggaaaaatgaagaaaaataataaagaaaaggtgagacctctaggtaattttccgattaaaatgaaatgtacaaatataataatatggaaagttttcttccttttccaagtttaatgtaagaaaaaatattttcactagaatttgaattctatgaaaatcttttgccaatccttagtagcttcagatcaagcaagttttgtttaactataacatttttagaacggaaggcttatcaattgaatgatcaagtaataaataataaatttgggaagcacccgtggtgacttcatgacaaccaaggttcaaatcctgatacacgagtcagggtgtgcatttgcaagtatatgagtgaggtatgcgtgtttgatgatatacacgtgcgtatatgtctaccgtacaataacgataaaaaagagagtaaaggtctgttcactttgatgccaggttgctaaaaaaaatagctatatttagtttgctgtcaaattttaataaatataaaagaaaacctaccaaaattttggtaactatactaaaattttggcattaaggttttttttacatcaaagtgaacatgccctatataacaaaatccttccgcgaaattcagttgaacagcatcgccatctctgcacaaaattcagcgaatcagcgagagaaggaccagttccaactccgaagtttacgcggtccacaaagaccaagtgcaccgaa

SEQ ID NO: 68066 - DNA, 2712 bp, Oryza sativa
gcagcagaacacatggcagacacaatgagaccttcaacaccgaaattgagaagaaagcttgcatattgcgtgtcagccaaaagggaactagctcattgaactcaatcattccatttggatcataagctgcagataagcaaatgtgagtaataataatttcacgtgcattatttacaattactggtaataatcaagaagagtacctggatggaaatcattctggaagatcttgccagtatttttagcaaataatattttgttaggagccctaccaccaatctgcaacatgtacgacatgaaacaggacagagccacttggattgcaaactgtttcttgaaggtccagaggtgattcccagttggtagaatcttatgcatgtattgagagaagatattatcattaacgatatttttagtaatttcattataggcttgcaagcgtaattccaccactgcttcaggggacacctgccctgagatggcttgatttagctgttctttgaaaattgtaataggtgaatcagcttctctattatgtcgggcacagttaatttcatacacctccaggaaagtgctgtacatcaaatcatcctctaccatccgaacctggatcaagggaaattaaacataaggccaggatattaccttggaagctgaaataaaacagctaaacatgattattatcaggtatggaagaatggaaggtatttcacctgtgaccaaacaggaataatgattggggtgtgaatagcaagatggcgctgcctcgactctttatgtttgtcaaacattttgtttagtacacggaatagctgcagcattctctcatcactccgggcatttggagtcaatgatgtctgaacaataaaatggcgctgtgaaccatcagagccaataagtgtcagacgtcggaagctactaccgtgcctccggacaataggaatatcaggtccaactctgtccaacttgacagtatgatcaggtgcaacctcctgcaaaagacaagtaaaacttaaaactagcacatagagaggtgaggaaccgtgcgagaagcataaaactttcacaagactggctaaccatccatatggtaagagataatgatgagtgacatattgacttcaatactgaggataaaaggtaatcactgtgaccaacctgatctgtgaagtactgcccgggaagttctatatcaacaacatggaagtccctgagaattttactttcttcctctagctttaaaattgcagggaaccgatcctcaacattactctgaagaacattcttccagtgcttcaatctctcagtgagttcagcaagtgttgctggaaaagtagtagcactttctgggtcaagatcacgttcaaaatcttgcttgtactccttgacaaaatcaacatgcttgttaacagcatcttgtgaaaagcaagctcggcatacaccagaaagttccttcttgagagattgtggaacctcgcctgtagttgcagttggatacttgtagcagcggtgaagcaatgcattaaccacagcaagaagtctttcctcgggaagagtaacaaatcttgatccaatttcagacagtaaaacctgaaaccagcaaaaataaaaatattagcatacttagaaacacaaacaacgaaagttctagcactagattgttgtttcttcatgtagatttcttcaagattctgtaatcccaacaattcaaatcaaatagtccctccagtcccattacaaacaatattagatttgttgtcttgtttgaaaatataaggcatacatttaaatttagtgcaagcctttcccccaagtctaaaagtatcccatcctctcttggactcctttaaacatttatgcttgacaaccaacacataccaccattttcgaagcacttaatggaagggcaataaagtcattctcttatggattcctacttcactttttgtccctggccaaaatatgccttactataggaaccaaagggcactgaatatgcatggaattctgttctcttaaatgccagctttgctacaaaataaaattcctggcaagcatgctaaaaatttctattgaaaaaaaggaatgggcaaagaaagaaatggcttattctataccattgtcatacacgttggcctgtatgtatggtaagactctaatttaataaaaaagtaatggtcgtagtcatctccaatttcctaaaggtttataaaccactttgttattacttcttacctcaagctcattggctagattggtatgcttgctcctaagagcttccattatatcctttgcagcatcaaatgcacttgctgcagaagttacccagccaagtccattattgcgtcttgctggcatttgcgaaccatctgcaccagtgaactcggttgaccttgatcatggccagcgcttgtaccaccctcaacattagatctgtctgactcttgtccttggagattacccccatcatgagaaactgccgcaccacctgactgggtagcttgatgaacttggttgtcagaagtcatgttcccacccccaagattagatgtcctcgcgttcccttcagataagttattggcagcattgtttgccagcatagcctgctgcatacgctgctgagctattcttcccatttcagtttttgtagcaacatcacgacgttccatcaagtatgtccgaagccaataatacaatgcctgcaagaaaacc

SEQ ID NO: 68067 - DNA, 4084 bp, Oryza sativa
agaaaattggagtcattcctgcaataatcctacaaaatcctatctcataaacaatctaattaaatctctcttttttatatacaatgttcttgtcaacttttattgtttaatgaaaagaagatttttattttgattaaacatgctaccaagaaggcgtagttcaaaaagcgtcgcccgctcccgcgtcgtcctccctcatgggcgacacgggaggcggaaaccgccggcgccgcctgctcccccccccccctcctccttccgccgcatcgccgctgcccaagcggccatcggcaaagccgcgcggccgcaaggacggcggcggcggggcttcgtcatcttcgtctccctctcccgtcggcggtggagggccgcgcagtagacagtgaagaccgcccagatccgggccgccgcggccggatctggtggggaggccaccggcggagggtcggcgtgaggtggcggcggcagccggcagttggtggtggtggtggcagggattgaaggtggtggggcggcggctgcagttggtggtggatccaccaaattaaatgaaaattgatggctagatgttttgcttttttcttagaatttgtaagatttattaaagcggcacgtggcaatctaggagcgtttgtaggagtctcacgtggtggctttagagtgtttatagggagtttaatggacttttagtatataatagatagattcattatcaacacatttgcataaggatgtttatttagaaagaatttagcatacaaactgtgtatatactcatacagctggtggtctgatctgatgatgggagcagcaacaaataaatctataggtagacgaagctaggagcatcagatcaccttgtcaattggctgatcatttgtctccctgaccaaagatgtcacatcttcactgaaatttgcatcgacaataatgaatagtgtttggtactccctccgtcttaaaatataagcgttcatagctaaaaatacttatattttagaacggatggagtatatattatacgaccatggatggatgcatcatacgtagcactcgtagagcttgatgtccatctgcagcctgaagtaggtgaagccctcgaaagcgtcggtgcggagggtggcgacgccgcgcgacatgaagaagtcgccggtgccgcccacgacggagatgtccctcgtcttctcggcgatgatgtcggcgcccatgaggttgagcgtgccgcggcgccccgtggagttgaacacgatggagaaggcgagccacgcgttgaacgcctccttgctgttgtagaggtagagcccctgcgccctcaccgccgtctcctccagcgacggcggcagcgccctcccctccgtcaccgggtcgttgaacaccaccacctcgccgaagaaggtgccgccggtcgacggcacggcgttggccagcgccgtcggcttggtggccgccgccgccgtggagttggaggtgctgttgctgtagtcgtagaggatgtcgtggaggtacagcctcatctccatgcacggctcgtcgtagctcctgacgaacctcctcctgctgctccggccatggacggcgacgctcgccgaggtgaggctgagcaggaagatggtggcgacgacgatcgtcagagacgccatggaccaagtagccgtccggcgcccttgcactgttatccaagcttagctagctagctgcagctgcctgtgattaggagctcgagatttgcacttctatttatagagatgagaaatggtcagggtcttcagctatagctgtttgagagggttctagctatttgctttcatgtacaatttagccggtatagctccatttagcccgctatagcagttttagaagctaaccgctaaatatcttagcccgctatttaaaatattgaaaatggtaggctgcatgcatgccaattatctggcaaaatgtctttgcaagctggagttgtttggatcaagagggatagtgagactaccatcatttcacctacaactatttattaaagaaaaaaatagtttgtgaatacattttttatatatgcatgtttaacaatttgaaagccggtgtcaaaaataaactactacgacaaactctaaaatcaacttcaaaattaaattttaatatttaaattttagggtggctgagaggcaaaccttagacttagaggggctgaggcacaactataatattgtcattcccttcgcttttcttggggtttgttgcttgaatattgctttgattccaatgatgatctgatgctgatgctcatacaggttaattactgtacgtacattcatgaacatagaggctgcaaaaggctagcttcaatggagggttaccaaaatatatatattataagaagagttggtgaattacatgaaagataagaaatgttacaaagaagatggatcacctaaaggaagaaaacaacaaaggaattatgctagccaagtgcttgattggttaatttctgcaaaacgccgccacacacgtgcttccacaaaagtccatgcagtcgaaatcattagtgaaatcaggccttaatttcttccttgttgtggaccaatcaatctgatttgcttcatcagggggaggggtctaatggattttattggggagcacgctaataagttcaacagtaccaattactattaacagtaatattgaccctgaaatttctaatttccgatattaatcggtatttcaaccgataatatttggtcactatgttcagtccaacccactaatggtttatttgacctcaccaccctacactttagcccactcatggtttctgaaatcaaaatccatatttgagttcattcctctgctcttcagttcatgcagcaaattgttttctttagcagatcatttcgctcgtatcagacggctttcaacaggtataaatttgcgtctgctcacatgaacgacgaacaaaatgcagaacatggcctgaaaaaaaaagagatcaaaggggatcggagtcctccgacccccactccaagtgcaaagctgcgaaaatccatctgaaaaagaatcatcaaactggaagagcgaagtgttgattcatgtttcgtagcagcagatgattttctctcgcttgtcggtctgtaggatttaaggaatcaaaatttcaaaccatggcatgatgacaagacaagtgtaaattacagatagtgtttgatggtttcagaactgtctagtactgttcagttattggggatggttcaatttcttttaataatggaaattatttacatctcagccatctgagaaaacaaaaattatcgtgtgatgggacaggtccccaactcctctaaaaaagatggctagctgaattaaaagtttaaaaaaatcacataaatattaaggaggatttttttaggtgctacgctatctaaaatgaagtacaaagattacaaaagtatagcatcattgtgcatagtattcccttctcctgtgaggcaggttcaattccaactaccaattacaaattgacaatgaaattaaaattctgaaacttgtagtttttggtacttatcagcatttcactttaaatatttggccattatgttctgagattttcagttaaaacctctactgattcatgcgaactcttccccctacctttaggctttagtcctctcatggttcctgaaatcagaatcgatatttgagttcattcctgtattcctcactcctcgcagttcgtttttttttttccgaataagaactcctagcagttcggcagttcgttgcttagcctcatctggaagactggaatgaccgcaaaataggttttctgttttaacagatcgtacggctttgaacaggtttaatttgcgtctgatcaaaataatgaacgaagaaaaaaaattcagaacgttaactgaaaagaaggagaccaaaggatgtcggtctgtcggagtttgaaactccaacccctttcccatcacaaactccgtctcctcgctcgctccggtcgctccactcctagctagtggtggaaaaaaaaaaagcttaggctcatgagctcagctcgggcttggctcaaccttggttggcttagctc

SEQ ID NO: 68068 - DNA, 1183 bp, Oryza sativa
attcatcatattggctagctcggtgcaatgacctggttaaatgcacaattactcaggaagaatttaatgttatactacctgcagaataatcttttcaggagcttgataggcctctaagaaatgacacacgttcacaaaagcccattgcttgctggaattatcttcacgtttgagatggttccaaccgaactttatgagttcctttcgatggtgaacaagatcgctctgtagatacttcagaagtaatgttgcaagctgaaggagttctatcctcaagggttcatcatattcagcactgacctaaaaatatatacatataaaaaagcattgctgtcatggggaagtaacaaagagaaggctgacaggtattaaggtagagtggttcacttcccacctcttccggaggatcaagaagcttgtcaacaatagttttaataatagatggatcaacaacttcccaactttgcccattttggaaagaatgagctagcattggaaggataagtatctgcatagcaacgactaaatgatcttgtccataatgctttgactggaatatgttcagaaagtgattaagaataattttcttcaaatttggtgcatagccttcagcaacctatatggaaaatgtaaaaatggtaagaaacagaaagaactggagagcgacacaagtaactgtcatgaattagaaaaagaaatggtgtcacctctataacataaaattccttaagaaaactataatcaatgcggctacggtacaagaatattgatagcatatcaaatagcgcaccaacttccgtacgatcatgccttagataatttaggaagcattttatgagccgcttgctttccatcacctgttcagaaagtaagattgttaagatccaaaggtctagacacttgattagtgcagtatggaaagatgcaaggatgctaagaaactttaataaagcaatttattgagatgtaaagcacagataacatgtacgcatcatgtcagcaaaacctaaatcattgaattcaaagaaatcaagcgcataagagaaaataagcacccatactaccggacagtgtttgcccattgaacagaacatcataaaatccagaatgataatcctactagcatggcagagataacagtatataacagatagtagcagtagtaaacaaagatgccaaaatt

SEQ ID NO: 68069 - DNA, 734 bp, Oryza sativa
atgttaactaaaacaagtcccaactccaactagattaaacatgattcaacttagcacattttatccggtgaacaagaacagtacttagggacacatgcattcagtgtttcaaaagttaaatgtagatatattcataactactttcatgattttacaaaattattgtgttgtggagatggtgtctctatccaaactgttactcttttgtgactacagcagcatgccacaaatattgcttacatgcaagcattgcatacaactatatgtaagaaacatgtgggtgaaattctagttacctgtttgacagcttcatcgaacagttctcttgcccgctctaacttgcttctctgataccttcttacaaactttgtgaggtaggtcacccaaatgtctttaacatggggatatttaaaaattttcacaccacgctcatacactttaaacgcatcttcgaaatacttgttttcctgtggaaagaggaaatgtcatgatattagcatatgcacgataaaatagtttactcgaattttggaaatgcggagttaacaaataatcctacctcaagaagatatgcataattgagaactatttggggagtggcaattcgtaaatccaatattctctcataaactgcacgagttgattccaatgttccaagactttcctccaggtccacatagaagctccacagtttcagggatttatgtactttcaattggacaggttcatccccc

SEQ ID NO: 68070 - DNA, 1362 bp, Oryza sativa
  unsure (1)..(1362): unsure at all n locations
cgattggttatgctgctcaactgtagtgtaagattactcaaattcggatggaagatggtaaatcaaatgattcgaaatggaaattgggtgactagtagcgcttaggtcgatcttaatcttgtaagttcagtttaacccagaactgtaatgagttgcggaaggattttgtgcaatttaaatctattcaatcagtgaatctcgcttgccatagtgtactattcagtggcagtggcacggatgatttagatggtgcaattagaggtggttttggcatgacatttcttttctttgtccctgttgcggctagagcagctagaatacgtncnaatattgttcagctttagagaatagtttccgtttcatattgtaagactttcgagcgttgtgtagaatcatatagatgttaatgaatccagacacatatagatacctagattcattaacatctatatgaatgtgggaaatgctagaaagtcttacattgtgaaacgggggaagtagcaaagaagatgaccaggactcttaattaattcggagtctggtattatagagttattgtttcagtaggatatgaagaatgcagcatttagagttattttgttgtctggttcttatcttatcatccctataatagtactaccacgagatggtctgtattcaaatttatcaggttgattccagcagctaagtaaaagcaaacttcatagggcaattgcgcctttgcatttgcatcacatattcacatggcaacccttaaaatgtatgtatgtctgtacttatatgttgcggtgggtanacttaggaagtagtcagctgctctatacttccatattgcatatgtgaattaaaagatctgtcatgtcataagtaatcggttttgtttgttctttggttatattagcatcacgggtgtgcatccaattaatattgattactgccttcaactgtaacatatgttcatggctgaattgctgcaatcaaacatcatctattttacaagtgacaggagatgttacaacgaattctgtttacttgatgtgcttctcatctacacagcccagaattatatttgaatttaacttctttgcaagtctcttctttatgtatttgattttctagtttcttatgtaacatatactgataccaaactttcttgacatcataggaagcagatggaatccggccttttacaatgcctcttatgaagcttgcttgcactgcactggaacgagttccattgacacgaaaaaaaataattgataatttgatgaagaaattccaccaagatttggtattctgccgttcacctgatgataatgagctgactgtaggagtttatcgtaagttgtttcctcttgactg

SEQ ID NO: 68071 - DNA, 1077 bp, Oryza sativa
acttcaagggattaaagcacgtgtttttgaccggctaaaaccctatgccggcaaatgggtgcaacaattgccatcagtactttggtctttgcgaactacacccagtcgggccacaggccagtcaccttttttccttgtctatggggcagaagcaatgttgccgagtgaggttgaatttgagtctttgtgctttcgaaatttccgtgaagaacgctacgaagaggaccgagtggatgacttgcaccgattggaagaagcccgcgaagcagctttaattcagtcagctcggtacttacaagggttgcgacgttatcataatcgcaatgttcgatctcgtgcctttctagtcggcgacctggttttacggaaaatccaagccacacgagatcggcacaagttatctcctctatgggaagggccattcattatctctgaagttacccggccaggttcatatcgactcaagcgcgaagacggcactctcgttgacaactcttggaacattgaacatcttcgtcgtttctacgcttaacttcatcattgtatttccctattttgactgtcaacatcaagttttcttcttgccgttgtcagtcgggggctatcatcataataatggagtatgattttttatcaattcagtttgcttacttggtttatcattgccttgtttggtttttctacttagtttgcgaggactgaaagtttttaatagcttctttgggttttaggctcaaccaagcttagcaaaaacttttaagaaatcaaaaacttcgcaagaatcatcaagcacagcataaatacaccagtattgtacaaattgagcctccatgtattacatccaaactcaatcagagtcagtcctttcgtcatcagagtcatcattactcggctggaggtcgttgttgcgaaattgttccacaacatcactcgcaattttgtcagccgcagtttgcgcactactgataagatctagggcagcttcttcacttgtcccgtctgcaaacccatcaatggtgtcgacttcaattctcgggtacaaggattttgtcatcgccaaggccatgccagctccca

SEQ ID NO: 68072 - DNA, 1174 bp, Oryza sativa
tgatgagcacatagccacacgtttgtagcgatttttctttgtttgattgaaggatataattaattaatccagtagccttttgcaatgatgtgtatctgattatctgatacgtacatttgtggttgtggttaacgtctcaagtctctcgcaacgaccatgcttacgttgatggcgatgcatggctgcctattggggactcttgaggaatatcttcttattgttattgtatatatactcacatagttataaaaaagtttaaaaggatgtattaacatgtaatatatcactttataaatatataatttaaaatttaacttgtacatctcgcaactaaaaacaaactaacaaactatagttggatctttttttgctgagatgagctaaagcatcattttttttccttcacttttttcttcataaaaaacaaactaaagatgttactccgataatttccaacgagacatagtccccattggttggcaagagcttagcggcaaaaataattaatgaaatttttttatatatccattacttatcgacttaaaagctaaataaaaaaaaactacattgagaaaactttgaaattaaatttaaaattttatagcgataggtcaaatgatgaggccctcgtcactaagcagtgggctgcttggacgtgatgcattcttccacgaacgccctgatttcaccaacgagcttccggtgatcgtcggcgaggaactccgggaagaagtagaaggagtggatggcctccgggaactccaccacccgcgccgccttccccttccgccgcagcatggcggcgtaccgccggtcccagtcctgcagcgggtcgagccccccgacgaccaccatcgccggcgggaacgcctcgtgcagttcggcgtcgtcgtcgtcgtctccggtgacgacgtgcgccgccgggtggttccggtcggccccctccggcaggaacgccttccacgacaggtccgaccgccgcgtgttcagcaccggcgccacgccgtcgagcgcgcgctcggattccgtccgctcctcgccgctgaagcacggctgtatgagtatcacgccggccaggtggacgacggggttatcggtcgtcgtcctcctcgtcctcgccgtggccgtccatcgctgggccacctggtgcgcgatgttgccgccggcgctgtct

SEQ ID NO: 68073 - DNA, 1719 bp, Oryza sativa
taaatgtagaaaaaaaaatcactcacacagattgcgtgtaaattgcgagacgaatcttttaaacctaattgcgccataatttgacagagtggtgctatagtaaacatttgctaatgactgattaattaggtttaataaattcgcctcgcggtttacaggtggaatatgcattttgttttattattagactacgtttaatacttcaaatgtgtgtctatatattcgatgtggcacataaagccaaaacttttttttttactaactaaacagggcctcagtgcaggacatgggggcaaaaagttggaggaagggaggtgacccgcgtccgcaccaattccatggggtgcggagaagaggcacggaacgccggcagtttcgggagaggtgcctgcaggttaaaggtgagccccacaggtgggctcttcctgttggcgacacgaaagaaggagggacgtcaattcgacttagaggaaaagggaggaggctagcgggcttgaggcccactagggagggacgaagccggccgggagaagagagaaggggacgggcccaagggaggcgaagtggacttagtccaaatggcccaaatagaaagaaggagatttttatttgtttttcaatttaattaattgattaagtgatgtttgtgcttttaaaaatacttcttgacctccaaaaatccacgggaaattctagagactattttagggcatggagaatattacaaaaatatttccagccatgattttaaaagtaaattttatttccctcattaaattcacctgttaaattgcttttaattttaatttaatttctagaaaataaattattaaatgatttttaatcccgaacgaaaattggggtgtgatgctatggcagcagcagcccattcaattccctggtaatccctctcaaaatatttagaggcaagctaggaattgagcaggcaattgaattgattagactttaagatcaccaggttattattcagcagcccttatctatcataacatgaactgcgaaacaatgaggactgaatctaaaggtcgactataaactgtgcatatctacatttgtgaaaagtaaatttcaagatttcacaacactgagccacgtcatgtattaattcatagccattggattaagaagcaaagaaaaggtggaatggatattaaccgtccgatgtaaaaggaggaagtcggtcaaacaattccacatcattttatcatctggagtcctccacagataacagattagcgggagagaaaaaagaatgaggaacagctacagcaatggaaaggaaaaggagggctgtggaagtgtagaggtacaatgggggaatggggatgtaatgacctttttgcattttagtcctataataaaatataatctacaaactaaccccataagttacaaaatgcatatatgtcaatgttattaaataattaggcatattctagagatataaattaatacctaagacatttagtacaacatattattataagaaatttggtagaatgcgcagatacatacgcataatatagaaaaaaatgataacatgatatatatgcatataggaaaatttataattttgttttttacgataaattccataggtttaatgtagccagagtaaataatttattatcattattcgattcatttatcatggatcaaaataaatttctctgtgtcatatctagacttcctatcaaa

SEQ ID NO: 68074 - DNA, 977 bp, Oryza sativa
tgcagcttgttcttcagaataagctcctagaaaaagcaaaaatcagatacaagataaaataaaagtgcaggtaatttgtcgtagcttcaaagtcatgctagtgctagtacagatgaggccgctgcaacagctgatttgagtcccaccgagggcacgaccaccatcgcttgctctgaaaccttatgagtgatgatcgtcgccgccaactgcgagcccaaaccgtcgcggactatagtagtgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacagttggcgcgccaggtaggggttgcgtcaagcttttcgccgatcagtgcaatgggtcccgtcaccggcatcgacgacctcgtcttcccacccgggcaggcgtttcggttcggcagcctcgacttcatcaccagcaacttcggcaagatttctctccttgactcggaatcgaaccagtcgggagagaaccggatctcagtcccgtttggattcccaaacgcggctgaaacctacttcaagaccatctcactcgagtcggcttcaaaccactcggccgagatcgcatcttctccaacgaca

SEQ ID NO: 68075 - DNA, 844 bp, Oryza sativa
ggggagctcggtaattcgagaaattgatcttgaggagaggcgggtgtctgtacccgctccgtcgactcaggaacctttctaatgttgtgccagcaatgcatgacgttgcggtaccaacacctgttgttatctctcctgtggcaacaatgaatgaaagtgaagaacctattctacaggattcaacagaaattattgccacatcagaggaggagctgcaccagcctcaaacatataatgtgccagaataggaggcccctagaaggcctgaaagagtcgcatatcgaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaaaggcttcacgcaacaagaagggattgattacaatgagacattttctccagtctcttgtaaagattccttcaggattataatggcactagtggcacattatgatttggaattacatcagatggatgtaaaaacagaatttctaaatggtgatttggaggaaaaagtatacatggcgcaaccgaaaggttttgtcatgaaaggaaacgaaaatatgggatgccgtataaagagatccatttatgggttaaagaaaagcttcgagacaatgctacttgaagtttgatggaacaataaagaaatttgggttttcaagagaatgtggaggacaactgtattgattcaaagttaagaatgggagactcattt

SEQ ID NO: 68076 - DNA, 853 bp, Oryza sativa
tcgaattctgcgtgtgattcgatcaattggacacttaaaaaaagaacaaatataattaagccatacggttggagctatgctcctggacgaactgcttcatctcctccacgagcttgccggagtcggcgagctccgggaacgcgtggaagccatggatggcgtccgggtactccaccacccgcaccgccttccccttctcgcgcagcgccgccacgtacctcgcctgccatcccttgagcaggtcgaacccgccgatcaccaccatcgccggcgggaacgcctccgccagctcgacgcgctcgccgccgcacacgcgcgccgccgcgtggtcccgggtggcgccctccggcaggaactcccgccagaagtagtccgtcctcgccagcgacagcgagaggctcgccttgtcgagccccacctcctcctccgtccgctcctcgccgccgaagaagggcgatatcagcacggcgccggcgagccggagcgacgacgacggcgaggtggtggacgccgcccagcgctgggccacgtggtgcacgatgttcccgcccgcgctgtcgccggcgaggaagcagcgggagaggtcgacggcggcgccgagctcggcggcggcctccgcgaggccgttggcgtcgaggtagcggagcgcggcgaggccgtcgtcgtaggcggcggggaagcggtgctcgggggcgaggcggtagttcacggacaccaccacggctccgaccccgcgggagatgcggcggcagagcgcgtcgtaggggcgcgacgccgcggagaagagcacgaagccgccgccgtggaagtagacgacgaccgggagcttcaccgccgccgtgttcgtgggcgg

SEQ ID NO: 68077 - DNA, 745 bp, Oryza sativa
ccaagttgcctctagttcaaatgcaaccttaagctgtggtggtcttcttgccagtgaatttcacagaaatttacttagaattatgaattgcttttcctgataaggacactgtttactatctcaaaatgactactatcacttgtctgataaggacactgtttacttgtcggatatttacaatgacacaggcatatttacttgtatgatctatcttctgacactcttccttttttcccctctaatttcagcaatctcctcagcacaggcccttctatggttttgggacaccaagtgactcttacggaagagtgttctctcatggtggatatttcccacaggccactaattatgggggccctttccctagctttggcctgaatggtacgagttctattccgatggaaaaaggccgcaggagaggaaggggcaatgctcttctttgcagctgcaatggttcacttgacttcctcaatgagcaaagccgaggcccacgtgccactaggcctaagaagcaaccagaggatggcggcaaggatgagaagccttctgcaggcgttgattgcgagttgtacaacaggcctgactttgttacagagtacaagaatgccagatttttcatcataaaatcatacagcgaagacaatgtgcacaagagcatcaaatatggtgtttgggctagcaccacaaaccggaacaagaaactagactcagcctaccgtgaagcaaaggagaaagaagagcattg

SEQ ID NO: 68078 - DNA, 2455 bp, Oryza sativa
tatcttgtttggtagagatgataaaaattgatagggagtttagttggagattaggtcattaataaaaacggatggctgatatttgcttagacaaagtaaaggaggaattccctcccaattactgcccctacccagttattgaaaaggagggagttccttcctcaattttccatccccatctcaccaaaattctcatatctcccaaccaaacaaaacacttaatagcctcatccctctaaactcccaatccttcctaaaaactccctccaaccaaacaggccgctagagtttcacgacatgataaccgaatcagaaaagtttggatctgtctctccatgcacgcggtagacaaaactggaaattttgaatccgttcgtgtcttccatatctcgcgcgcgttcgcgcagtagacctccccacacctacacaccagctgtatccactttgccgtgttcatgtcaaaaatcattttcttcacttcctacacaaatgctattaatattaaggcacatagtaccttgaaggtctttaggcagtggaagggcatcacgatcaagagaaatttgtggattcatgctgaacgaaataaaaattactgacatatagttctcacacatacggtttttgtaatgctcgttagatttactgtgaatctctagggattctggtttcttttatagaaaaacatgctatgggggaccttttctttactgaaatactacttcctaaaatgggggagtgttttcattatcaactcttttgatattgataccactttggagtatgtagtaatagtcgttttggaaatcatatggatttctttagtggcttgtacatgagctaagctgcgagccttggcagtattcagagcatgggtcctgtagtaaagatggaatgcttgcatcagttttctaaagtttgttggattttcatgtggataagaaaatttaacttcatgcttacattatatcaggcttcaaggacaagaacaaattactatgaatcacgttcaaaggatgctgatgagattgatactggtgctgttaaagtttccgaagatttcattgtctctgatattgccattcatccaagacatgcgaagcaaatgagaccacatcagttggaaggattcagcttcctggtcaagaatctagtcggagacaaacctggaggttgcattctagctcatgctcctggttcagggaagacatttatgctcataagtttcattcaaagcttcttagcaaagtatccttctgcaaggccccttgtagtgcttccgaaagggattgggagtagctatatttatggcgccatattttttaacaaaaattagtcggcatgtatttacattgtaagtccctaaattacatatgtatttttagtgttttcaatgtaagtcccaaacttacatatgtaagtcctaaaattacatatgctacgagaagaacacgttgcagaaattgcttaccttctttaaattgaagagcttgaaaacaggttttggaaaaaatcaactaggcactctacagcgaaccggtgatacaaggtagagttctcaataggaagggctggatctatgttggcgagcagggtgatgtcagaaaaaattacatatgtaagtcccaaaattacatactaatttacatttgtaagtggtgtgtaagtagggtgtaaattaggtacttggaagagggagtttcagtggtggcaagtggaggacataccactatatgatttctattctgttaaggctgacaaaagagtagagcaactggaagtcctcaaatattgggaagcccagatgagcatactatttcttggatacaagcagttctcacgaatcatctgtggtgatggagatggaaacattgcagctgcgtgctgggacaggctgcttatggtacccaacctacttatactagacgagggtcatacaccaagaaatcgggagacagatgtactggcatcactaaaaagacaccacgcaaagtggtcctgtctggtacacttttccagaaccacgtttcggaagtgtttaacatcttggaccttgtgcaccctaagtttctcaagatggaatcgtcccgtcctattgctagacgtataatgagtcaggtagcaatatcaggtatcagagtttaaaaggggttcatgacagtgcattcactgagtcagtggaagacaccctgctgaatgatgacaacttcactagaaaagcccatgttattagaagtcttagagaattaacaaaagatgtgcttcactattacaagggcgatatcttagatgaactatctggcctagtggattttagtgtgttcttgaaactcagtaacaagctgaaagaaattgttcactgttggaattaatagatgggctaaggcccattcgaaaattaattctttggaaaatcacaaaagccaacctcatgggatggcatgtatgtggagtt

SEQ ID NO: 68079 - DNA, 1418 bp, Oryza sativa
cactggagatggaagcgggtatggtaatttacctactattttttcagtaatcagtctactaattggtgggttgatacaggggccaatgtacatgtttgtgttgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgtagcatgtaccttctatcgacaggaatcttgttagtggctcccgtctgactagagacggatttaagttggttttttagtctaataaagtagtcgtgtctaaacatggatattttattggtaaaggttatgagtgcggaggcctattccgcttttccctttctgatttttgcaataagtctgtgaaccatatttgtggcagtgtggatgataaggctaatgtatggcactcacgtttatgtcatattaattttggcttgatgtctcggctttccagcatgtgtttaatttctaagttttccattgtcaaaggttctaagttccatagttgtgtgcaatcaaagcaacctcgcaagcctcacaaggctgctgaggagagaaacttggcacctctagaactcctacactcagatctctgtgaaatgaatggggtgttgacgaagggtggaaaacgatattttatgacgttgattgatgatgctactagattttgctatgtgtacttgttgaaaacgaaagacgaggctctagactattttaaaatttataaggcagaagttgaaaatcaacttgacagaaagataaaaagacttaggtctgatcgtggtagagagtttttttcaaacgagtttgacttattctgtgaggaacatggcattatacatgagaggacgcccccctattctcccgagtctaatgggattgctgaaaggaagaaccgcacactgaccgacttggtgaatgccatgttggacaccgcgggattacctaaggcatggtggggggaggcattgttgaccttgaatcatgtgttaaacagagttcctaatagaaatgaggacaaaaacaccatatgagatatggatttgggagaaaaccatcactttcttacttgcgcacatgggggtgcttggcgaaagtcaatgtaccaataacgaagaagcgcaaacttggacctaagactatggactgtgtctttctgagatatgctcaccacagcattgcctatagatttttaatagtcaaatctgaggtacctgacatgcatgttggacaattatggagtctcgtgatgctaccttctttgagagctttttcccaatgaaggatacacatagtagttctagccaaccctctgaaataattcccagtcaatcacaccaccagaacaaactga

SEQ ID NO: 68080 - DNA, 4590 bp, Oryza sativa
acagaaagaaacaaaaatccaattcaagaacaccatgactgaagcagaaaaactattcatttattcattcattcaagaatggttcgaatagctgcactggaaccaaacaaagtagcattaaggttgtgtttagatccaaagtgtggatccaaacttcattccttttctatcacatcaacctgtcatacacacacaatttttcagtcacatcatctctgatttcaatcaaaatccaaactttgcgccgaactaaaaaaaaacacagcataaaggctgcaaatctacactactacagttcacaagcaggggcaaggtctctctgctcgtgaacttgttgtttagtggcatttcaaatacagtatctgacttgttgttgttgctatgtccaaaaccttaatcttgtctgatgctcactgaacagaagaggctttgggggcctcgtcagtgtccccagagaaattctcagaaaaattaaaaatgagagagaaagaaggaatcacgatgacaaggacatcacgtgactgaccacgccctgacaaaacccaattaaccaatcgagctactccactccaacaacatgccatgccaatatgccactgccatcatcatcaagaatgccgacatcttctcaaccaaaatctctccccttaagatgaagtactacctctctatatcaaattgccggtaattaacccttaatcaatgcagtaaaaaaatgtaaaaagtgaattatcttctgtttgattgatttcgttttgtaagagaagatctacagatgcacgtggtggcatgcgacaaccgccagtgacggaaccggtgggtgggccccggaggtgtcaggcaggggatccaatggccggcggccacgtcgccgaccgccgcgccgcaacttgctcccctccggtttggtcacacccgggatcctgggccccacctcccagccacacaaaactaatcccgaaaaagccgagcatactactagtacacacccaacttcaaaattatttcaacttttatctacagaacgagaaataaaataaattattttacaaaaatagacacttttttacgtattccgctcaaaaacaaaaatgatttcatgtaccaaaaaaatatatactaatactagagagaaaacgctgacacgtggggcccttgcttggtccaccgcggcgggcagggcatggtggggcccacgcgggggaacagcaacagaatctcggggaaagcgggcgatccatccatccttccaaccaaaccttgcaaagcaagtcagaagaagaaaccaacggaaaggcctaggcaaacacacacaaattttccacggtttttactccccttcctaccaggaaaatcaaattaactcgaactctggtaggaggacacgagggaacacgtggctggcgcacgtctgacaccgtgggcccacccagtccacgcggagggcccacctcccgaggggaaggcaacgcgcgtgacggcgactcgggagccgctgctactactactactccagttcaacacgaaaccgcctagaaaatttccttatagtttgatttcgaaagaaaaaatttaagggtttgagcaggtttatgactttattcaattattatccataactgaattcttctagaattacaaaatactccgtatagtagaagaaaaatccatacattttttttaaggaagagaagggcccgatggtgataaaatgggggtaaatccaacgacaccggccaccgcggcccggtgcgcagaatccgccgccgtctacagctggcgccgacgcggcggccgctacccaaacgaacaccttttacgccccacgagtccgcatcgaatacccaaacacaaacgaacgcgatatacttttttttcttttttcaggtagaactttcttctttttttttgcctattattacatatacacaaatcgtaacagacaaggaaaactaccactactaaaatgatatagtgaaaaaataaaggaagagcttttttgaacggacctaaaaaatgcttcatcttggcaaataagctgaatttacgggtccaaagtaaatgtttaaatttctgttgagattaaacagataaacactatggtagtacgactatttttttctataataagtgaacaaaagaggtgaaaagcaaacggatttcgtcagaaaaatcgttgcaggcacatctcccatacacaaatcaaatcaaggtggaattttaagtcaaaaaagggaacttgtcgtctgatttcctaacaaaaaatcgttgcgagaatcatcacacaagcaagaacacagatcacaagcaaatcgcccgaggaaggaacttgaagagaaaaataaaagcgaatcgcacgaggaagggactggaagaaagaagatttcagggcacaagaaagagctcaagagttctgaatccaaacggaaacaaaagtaaaagggccaaaaacaaatggggaaaaaagtgggggggactcacctctgctttagccgctgcggcggtctgagcgccgccgccggcgaccaggcacggccgcttctccggtgagctgcacccctcgtcgccgctcgacgaggcgccgccggatccgcccgcccccggcgccgccttccgcttccgcgacgactcgtcgccgctggaggacgcgccggatccggtggtggcggcgtagtccagaggggtctctgggctagacgcctccatggcctccttcgccgccgcgaggaccgtcttgacgtgcgccctctcgacggggcgaggacgcggacgccggtcgccgccggccgtggaaggggcggatccggccgccgcgacgtagtacggcggcgactcgggcatccgcgccgccggcgtcggctcggccttcaccaccgcgcgtggcggcagaggcctcgccacgccatcccggctgaaattcgcgccggatcccgcgccggccccgtactccggcggcgtcgccggcccccgcgccgccgtcggctcgttcttgaccttcatcttgaacaacatcttctttctcgcggggggcgggagcggggccggaatcaacgccgccttctccccgccggaatccctcagctccaggccacacaccaaaatggccggcggcggtttggacttggaagtccgcttccgccggtccttccatcccggcaacttcttctcctcagcggcggcgcccttctcatccggccgcggaacccactccggccaccgcaccagcctcctgttctggaagctgaccagaatctcggcggccgtctccaccgcgtcgtccatcggaaacggaatccacaacaccagccacccgcacgcacgcacgccgccggccgccgcagatgggagactgctcctcctctccgccgcgagcgagagagaaagagagagagagagagagattggtggtttcttggaaagggagaggcgagagaggcgagagaagcatttatagggaggaggaggaggaggaaaaaaaaacctgaaagggacgggcgcttctcggccgccgcgtagaccgggtgttggtagacctcgcacgctgacatgtgggccccacccaccgtctctcacagtccggctcggtgtaaaggcatcggggatccacttcgcactcgggttggtagacccgcatcacttccaggtgggcccgggtctctcgccctgttggagtctgatgcgggtacgtctcgtctcgtcttcgtctgtggattgcgaggaattctcgcttttgagtttgtactgctcctgcgcctactcattcaatggcaggtaggcccggtacgtgatgcttttctttttttttttttggagagagagggaggaaggaagtgggagtgcggcttatggatcaatctccggtaagaaagtgaaaattatggatttgtcgcaaccgaaacatcaactacgaagattagctatttattgtaaatgatttttttatcagttggctttggtgaggtaaaaacaaaggttttcaacaaacccaacctatttctgaatgagttgtttgtttctagatacaaggtaaagacctatgttttaaaaatgaattatacttgggctaataatatttggaataagttagttgtaaagttttgggacaatttcattcttgattcgctgtagatctctttgcatgataaacctaaattttagagagaaaatacaatatagctcgtaggtggcatattcacagtttgaggagaaggggattgggaagatacgcaaaacgaggtgagccattagcacatgattaattaaatattaactattttaaattttaaaatggattaatatgattttttaaagcaactttcctatagaaaatttttgcaaaaaaatacaccgtaaacggtagtttgggaagcgtgcgcgtggaatacgatgtgcatactctccaatcacccaggggcgaatgcaccgtttaggctgtgtgtgtgttcttcccccattttcctaacccgtctctctcgttttccgcacgcatattttttaaactgctaaacagttgatttatgaaaaaactttctatatgaaagttgttttaaaaatcatattaatccattttttaaaaatagttaatactta

SEQ ID NO: 68081 - DNA, 2433 bp, Oryza sativa
ccctttgcctctccctaggggtcccttttatatcgtgggataccttgaccctcaagtaagacttggagatatgtaaaccgacacgatatactagagattttatcttttccgagtatgacttttgcaattccttaacttcgtggagatattttccataatttgaggcgaattcctaacggcgtatatggaaactaaccatatacataaaggtataccttatcggtatattccataagtcgtgggatagagggtatgccttatctgtaaccctgacataattaatcatgcaataatacgagtttcgttttgcgtgccgggaggaggagaacacagccgtagtatacatgagtatttgatgggaccttatggcataattttgtcataccaggaagagttcatatagtaacgtagcatttttatttttattaagactttaattgaaagaattattaagaaggtccaaattggcgcacgtaaaacgagaaaactattaacacataattaattaagtttaattattataaacttaataaattgatatatttgatcttttaaagcaacttatatatagaaagttttcgcacgaaaacgcactgtttagtagcttaaaaagcgtgctaacgaaaatcgagataaaatctgaatcttaatcagaaaagaacaaggcacgacgaataaatcctaccatgccatcgtagggttaacaacattttccctggccacttgccttttttatgggctgcaagtttaccaggcttcctttattcatgagcttccgatgagttgggctggctgagccattgaggaactttcagaattttgatagtaattactgtacaaatacggttaccgacaaaatggtcggaaaaaactccatcacatttccactaccatttccagaagatattaccgtttccatttccaccatcatcagttatcgataccaattgaaatggtcggtgcaaactgaaaacgacagctggaaatctcaaaaatttccgttccattttcaccactaatgccatgtgtttttgtattgtgattggtgccacctattaaggttatgtttttttctccaattttctatttttcactccctcatttttcgtgcacacatttcatgatatgttaaacggtgtgttttttaaaaaaaaatctatatgaacgttgctttaaaaaccatattaataattttatttttttaactaatacttaactaattatgtgttaatataccgcttcattttgcgtgcggaaggaaaaagttctcaagtcccatccattctaaaagaacacaatctaagaccaccatgatgaattgcaattccaaaaatagaaaattataagttataaaatccaatttttacaatcctcattgactggctactcacgatctgtttttcaaatctcgatatcctccaaacaaagctagatttgctatggcgttaaaggaaacagggtaaaggtcaagaatattgtttctttgtttgttgattaaatgattaccaaatggtttgtactagatatatgtactaccatctatgatcaaatcaataacatatgttggccaatttggtgccgaaatgatatttttcataataagaaaatagctaatcatatgcatgttatcttcatgtctaccaatcaacgctatacttgtatttgatgctatcatgggagaaacgagatactatgcgtggtgatgctacacttttaaaattggtagccaagggtattttatacaattttggatggagtagcacctatcgaattaatcgctataatttacgggatttatattagcttttaattctggtgatcatcttctcagagaagagggaaattgtcccatcactatatttttctctcattttcaattataaaatacaatggatgcatgtctgcttgtaggcagaggtcaaacatgtaaaccatttttattatcttacaaaaatatcaatcatttacaatatatgtacattatgcaaatacaatgtggcaggttcacattgtcttcatgtcctagagcgaccaggccgtgacttcaattgccacgtggatccaacgtggcaccattgacatgccagacgagccgacacggcacggcagtgccaatcagtagaaccatcacacttctgtggtttttgcctgatttacgccaacctttccctaaaaggaagtaaggttatattcgctaattacctcaacatgggacatttatcagctagccatacgtttctacttgtataaaagccggcatggtgctcttttatttgcaacgttacttatagttaaattaatttgtaacagaattgtcgattcatatgtgaccccacgagcagacctttttatcagcacaagcagatcacatttatggagttcatacaactaacatttatacataattaatatatactccatccgtcctaaaat

SEQ ID NO: 68082 - DNA, 5371 bp, Oryza sativa
ttgttcatgttttattatctaataacaataaaaatactaatcataaaaacaatttaaataaaacggacagtcaaacgttggacaccgaaacccacaactgcgcttaaaattagacggagggagtacgtaatatccattacataataataaaaaggtaatctttttacgtggtggtgttgatggcaaaatttagtaagatacgtgaagataaggatagatccgaagcggatttgaaggaattaacgtggtttccaaaacagaacggcgcatcagcagaaaactgtattggccgatatagagtcggattcggttagccgatataggcaatttgagttcatatcaaactcaagattaaggtttcaaagatattgcaaaataaggacggagtccgaagaagacaattgaaaacaatccgttttcctttatgtattttagaaatttatgttagagttcacaatgagctagtgtgtttatttttgtaaagtttgaattgtatccgatatggacaagttttgtactacagttataaatacatgcccaggaccttgtaaaaaaaataacagttcaataaactcttggcacatcaccccctttttacttttcgactttctcgacgagttcttgcttcaagttggggcatcggcttcgattttccggcaagaggtatggcatgtcacagtggtttgcattggcggattaggatgtcgttttagatgttctaatctatcttttgcagctactggttatcatatatcctagttaatctaaattgatgattctatttacttgtatcaaccaggcctttttctagggttttgttggtatcgactaaatcgttttgtcactttagattagctaaggtatttgccacactaaaaatcagtcacaaacttaattgtttagactttatgcttcttttcatacttagtattgcatcagttaagtttgatctactaaatcgtacttagaatcataaaaactagcatgcttcttgattaccaataggggtagaattggggtttcagccgatcttccttgatgtaactattttgctatatttaatttcttttaatcatgtttttcatgctatacctaccccttgtataggtatatcactctatttaaatatatcgatcttcttctcgatatatttacctagattgatattcttgtgtaaagctatatcgtagtattacctagattgatattcttatatctgtatcgtagtattagccgatacaatatcctttcttaacctaagtattggatcatcggctataatataaaaacgtgtaatctttagtttatctgatctgatccatactatctcgattaggttcaatctatgccgtttgcttgcacttcagagaaagattgaattagtgattacatgtttgattgcatctaaagctgatggaacatattttaggcttgtttatttttatatatcctataccttacaaccgattcgatcagagaacatcggctatacgatatgtcatcggctcatcggccgattggctatggtgttctaacttgattttactgtttagtcttgttggttacaggatcaaaccaactgacacgtcctgaacccaaaaagcaagatttgaacatacactggagctaagtggaattctcaggccgtcctgttttctcctcaataggtgggtgaatgggatgatgggtgccttttgtttttcaaatttatttatttactcagcactttgtaatgtacacacggtcgtggaaacttgttgtgctcaacatatttgaaatgaaattttaaaaacttttgaacactaatctcttttaaaatatgtagattggacgcatgaagaccatctgtataagtacatctcgtagtattacaactttgccagccattaaatattgtgtactaatacaaaactagcggtcaaaattatgttttttaagattatatcgatgccaatatatatacaacatattttttgtgacagaactataaaaggcaacttactagggtggtaagatgcaccagggatccagttgatttgacaaatatttgtgtattattctgtccaagctttccatttgatcagatgatcaagacgagcaatcttgatttattgttaataacttaattaatacgatctcttgggatattctgtgcgtgtaacagtacactatcactatgtacagatagtgtaaagtctgttgtccgtgatcaagtgaatttaccctcgagaaaagaaattgaggcacgagccctgttccactgcaaactgcaaccaccggatcacaagttacacatgcgacatgacctatacactttccagcagagaaggtgacattggcaactcccgctctcattttattatgttgccaagtaggatatgtacgtggttgatccgtgtatatccaacaatccgcccaaatccttatgccacataatgaatatcacgcttctcaatgatgccgtgcatcatcgtcatccactcatcctcctctgcatagttttttttttatataggtagagcatatccttcttttccagtgagaattatcttctcaagagtgcaattcattagttcatgaatcgatttttgttgccttgcgagagggatgtacagtactagcacagtaaaaaaaaaaaaaagctcgaggctcgcgagcagcttgagcttggctcatactaggctcgattcgagctcggctcgagctccaaacgagccgagcccgagcctgagaaaaactcgcgagctttaccaaaccgagctcgagcttctactgagcttgtttgtatatagattatattgtatgttcaccttattaatataataaactaatagataaatatatatatatatattaatatttatttacacaataaattagcacgtgttaacacaatatatttatttgaatcatttttctactttttattagtgtgattaactagaaaatattaaacttatcaagagattatcattaaaatatatattatactacttatggccgagctcggctggccgagctcggtagagctcgagctcgaaccgagcttgcctaaaagctcgaaggtgcaacaggctcggctcgagcttgtgtcgagctcgagcttgggcagacaagctcgctcgagctcggctagttgataaccctaaacagtactactacacaaacagcgaaaaggcgtttccgaaatcggttagacgccccatctccccccaattggagattctcacaggtggaccatccaaccgcgtgagaaaaaaaataattattctaaacggatctcttaactcagccgattgtgatactacatatattttcgcaggccactgagttaaacagctcacctggacagaaggtggctaagataaagatttcttgcctatttcaaattaaaatttgaaaatatatctcaaattaaaatttttcagtttttgagtggcattattatgtagtatagtacgataactaggggtagtgtgtaacatataaaaatatatactccctccattaataaatgtttgacgccgttaacttttttaaacatgtttgaccgttcgtcttatttaaaacatttaagtaattattatttcttttcctaccatttgattcattgttaaatatacttttatgtatatatatagttttacatatttcataaaaaaatttgaataagatgaacggtcaagcatatttaaaaaagtcaactgcgtcgaacatttaggaaggagggagtatttgtgtcaacaaatatattggatatgtgtgagttaagacatattaacatatgtttctaaattcgattacaaatgagccatctcggatcgcataacaatagtctcataacatatattatttttttgagtaaatttcacgaagctatggatatattgaccaaactataaaaatgtacatagatttaacacaagatttattgtaatggttagtgataatttggtcaaagtttgaggttagtgataatttggtctaataacaaaataaattacagattccgctagaaaaccaccagatgaatttattaagtctaattaatccgtcattagcgaatgtttattgtagcactatattatcaaattatagcgcagttaggcttaaaagattcgtttcgcaattttctaacgaattttgtaattggttcttttttttgtctatatttaatattatatacatgtgtctaaacatttgatgcgacagcgtgaaaaatttgtttggtaactaaagatgcccttatttcgtcttccggaccttttggcactcagccaacggaaggccctcacgccatctcgcctgatcgcgcccagatctttttcaccgagccggcgcttgcgttttgattggcaagcaacgcgagacctcgagacgctcgtgatcgagctcgtccgcgtcgcctttcccttcccctccgctgctctgctccgcgcgcgcggtgcaccgtgcacgcctctgcagcacgcattactaacgtgcggactcaagggccagaggcagcggcgctgcagcgcatgggcgcgcgaggcgtaaacccccacacccccatcgtcatgtgggcatgggcatggggaccctgcctgcccgtgttgaccttggaggtgcggtagccggtaggtccacaccaccaggccaccgtctcgtactagtactgcaagactgcaagccaagtggtttggactttggagtctggggctaacctgttgctgggctgtacagtagtacgctcagagcctcagatgcaacaaaggccgggagggatggcccacacacaggacggtgggctttcccaacggaataagttcattctaggtcccttaacgtgacgtccaattcaaattccgtccctaaacaacaatacatataacacgtcactcaatttaaaataccggcatactttacgttctagagcagtatagtctcccttttttactgacgtgatggctaagtcaacatagaccccattatcagcggcctaaattttttccactacctcacctctcttcccatctctttaggactccacgctcaacggctccagggctaggagctagtgatgagcggcgcgttccggcgaacggtggcgtgacaaagcaagcatgcaacactgggggcgctgcatccgcgcgtgcaaaggaggaacaaagtaggtagtgctggcgcagcgagcgaacaacaattggacaggcttgcggcggtcggcgggagaggcgcgtggcgggtagaagctcgacagtgacagacgacgaccagcagggagaagggtgtcagctagcgggagagactctcggcggtccccttcctcttccctcgccactagtggtcccttccccttcctcttccctgccctatcgatgggcttgca

SEQ ID NO: 68083 - DNA, 3929 bp, Oryza sativa
atgctggagctcgagaatatgtggtcacagcaccgatggctgacgacaaagcccaaggtgtcggacctccttgcccactgccttgactacagttgtaccacgaggaatcaaccctgcgtgtcgactgctgtccacctactccggcgttccatggcgttcgactccaccacatccctctccccttcataccactatcctcctcaccacctgccatcaaccttctcctcacacctgcttgccccggtgagatgggaacaagaggaggaagagagagaagtgaagaggccttgacatgtggggctcacgctgactcaacgctgttgacttggatcaaattgccacatcgaacagaatcatcagctatattaccatgggacctatatccaatttttttattaataataaataatattatttaaattaaattattagtaattagaggataacatttaccaaaataagatggccgctactagaaacagcgtccagatgtggacgctattaccattaacgtacagatgtggacgccaattggatcgacgtccaggttggtgcggtcataacctggcgctaatcatcgcgattaggaaaaaagaaaaaagaaaaatcccccaacgctagggcagggtgcctctgccgccgtccaaattgacgccgggagtctgccgccgccgccgtccgcctcaacctctggagtctgttcctccttccgactgagcgtagggactacccacgaggcaaatggcgcggcagcgctaaggcagagggccgccgccaccgccgccgccgtcgtccacctcgacgccgggagtccgccgtcgccgtccaccacctcaggaagaccacgccaccgcctgaatcgacttttgaagttctgagaggtggctgccgtcggccgcttccatccgtagcttgctgtcttccctggaggctgcagctgttgtctgcctcgactcctgccaagtgctgtcatctgttctcatcttggaagcttgcagccaccattgacgtccaagcccagaactcctacagtcaaggtgattcaactaacttattttgttgtagcctatttaataaacattttggaacacaatttatggatggtaattacaggagatgaagaatcaagaaccggcttcacaacttctaaaaaaaaagaaccggcttcaaaaatataacataggttcatcctaataagtctaatgtataatagagatctttataaaatatatgtctactacatcagagttgtcattggagttccaacttcggaactgaaattacatttattcacacagtagaattgaaatactgatttagcttattggttgttaacattttgtgcagctaaaaaatggctgatagtgatcggttcagtgatttactatggatgcctcatgggcagaacaaagtatctaaaatttcagaaaatgtgagttgtctacttagtttggtttcttgtcgatttgtaaatatattcatctaggttcccatgagtaattgtttttatctttgatgtagcctagtagttcaatgaatatacggcaccatcgcgttggaatcccttaccacccattgtgccgatcggctctacaaaatattggtttctatcaaattgcaaagatgaggagtatcaaaattgacaaatatttgatatctgctttggtagaatgttagcggcctgagacaaatagctttcatctactgataggggagatgacaattactttgcaagatatcagttgcctttggggtttgccaatcagtggaaaactaattgtgggccaatctgatggaaattggagtgatatgattgagaggtatcttgggattccaccagaagatcaagaaatgaagaagaaaaagaggaaaaaggaagatgatacatttgcactgagttactcatgatactccataactctgagcaaattgcgtgatcgctttcgtgccatgcccagtaacccaacacaacgggagatcgattggcatagtcgagcacttgtcttagaaattcttggctccattatttttactgattcatctggagatagtgtgcctgcaatgtacctccaatttatggataatttagcgacccgcactgaatacaattggggaggagctgtacttgctatgttatacaggcagttgaataatggtgctgagaaggcaagatcagaaatttttggccctctagtattgttacaattgtggtcatggtcacggttgccattaggtcgtccaaaaaatataattcaaaagacggatgaagtggaggagcaagaaaaaaaagaatcagatggctatcctatatttggggccaaatggtgtagttatcatgaattccccaccccacataattgtggtaatgttttacatatcttttgaattatgtctcattgtagattcttataacaaacaacatatatgtcaacatgcttatctttttatactaatattatacaggcactcaatagtaccgaaaccaaattgacttgattcgagaaggtactgtacaatgacaaccatatgaaggtctcatagagcatatgcctatccaaattcagaatgaccgtacttggtggtttgctagactacctctcatccatttttgggttgtagagttccattatccagaaagggtaatgagacagtttggaagaaaacaattaattacaccaccgcctccacatggtgaggttgagcttcggaagctacgcaaagtgaagcatgtaggaggaaaagggtgcgattggaataaattccatgccaaatatgtgcaacaatatgatgggattgaagcaacaatcgttcaagaggattgtcctttcgacgcagctagcttgaaggagtatagatgttggttccaagcaaatggtatgttcactgtgttttttgattctcaatgcttgggaggacttgaaaactctatcccataccctcgagataacatggagtggactgggtacatgcctagtggtccacccctagctcgcattgtaagttatagatttcttccaattactctttatattgcagtgacaacctagatctgattttaactcataattgcagggattgcgtgagattaaaaatgcagcatggggaatcaaatgttgtattactaatggatgcaagaagataggtaaatctatattgatcacatgtcaggggaatattagggatcttaacttggaatacaaattgcaaaacatgttgtctgaggctgaactaccaattaaggttgaagaaattccatctgatgacgatggcactactgcttgcacgccaagtcctccaaatgaaagttccgttgatgtatttgatgagtggatgatctcaggaaaatgttttagtagatatattgatctaggtgtggaaactactaatagagttcccacaacacaagatgcaagccaagtgactcaatgtttggaaaatgaagatctggtaaaattctaacacttgtgtgtatgcaaattaactttgtaatgtatttaatatatgatatactattgggtgacatgacaggtggcttcaagagaagcatcagctccactgcatcctggtgaaagaacgtcaagtcattcaaaaagttctatccaagtggttgattggactagtactgagaggactcctatgttcaaaaagaacactccaagttaggaagaccatatattctgttggatataattttgtagaacttttggagctatatgttctacatatatgttaactggaaatcagccactccaagttaggaagaccatatattcctgttgacatatatgttcttttcgaccactgtcttatatgggtgctatactatgtaaaatatggtcacgctgtcagtggttgaatggcgtgttactttactttgtactgacttactatattaatggatttttatgttgccaacttacatcccattt

SEQ ID NO: 68084 - DNA, 3660 bp, Oryza sativa
aaactatcttatacttgaagtccctcagtgtgtaaacctcatggtttccttgttgcattgggactaactcttgtcgacctttacctcatatattccaacttcatctccatacgagattacattcatatgtccagccttatttcctcgcttcactaatagcttatcaaccctttgagaccattgcttgccattgttaagtaaattaacaacatttcgccttctctcaacaaaccattctaagcactttgaaaatgtttcctccacaatggctgccaccggtaacctccgagaaaacttaaacacattgttcaatgactcagatccattgcttgtcatcattccccaacaatatcctccatccttgcattgaaataccttctcgggcttttcttgctcatctttatcttcctgcaagtgctttccaacctttttaacatatgttattgcctcaggacaaatatttgcaattgatgacattccttcatcaaattttctaggtttctttttcttcactgtccacttaaatgtcttgagcactatttcattgcgacaaaatttccatagattctcagctacatgctgtgagcaaaggcggtgcacacattcaccggcgctctcattccatccaatgtggggctgcttaaacaaccattttatggctttatgtcgatcagatataacacacagaaacttaactttccatagcctattacctcacttcgtagccatctcataaaccacccccagtttgcactatcttccttttccacaatagcaaatgcaagaggtagtagttgattgttagcatcatatccacaagcaatcaacaatctacccttgtacctccctaacaaaaagcatgcatcaacacttataactggccgtaggtagggaatggcatcgatacaaggtccaaatgcccaagcaacacttttaaatgctcgccgtccttcctgagtcgttggctttgacaaaaggacatactttgtacctgggtttttagcttttatagcttgtaagaaagggatgaggaggccatatgaaccttcccaactaccaaaaagttgtgctattgccttatctctgcctcgccataatttactataagatggcttcacatttctatatctctgttggactagtgacctcacattttttatactcaattccagatcatcccttaatgcatcacgtatcacattagcaatcatagaagatgataactgagcatgatcaaatctatcagccggtgctcgacaggtgtgagcatagggacatttccttatcatccaacctgaacctatctttgtgggagttgcatagagcctccacatgcagctattattcgtgcattcagctacaagtttagactgactacttgtgctatacttgatttctgaatttttacatatatgaaactcacctatagcaatttgtaggtgctcttttgaatcaaaagactttccttctgttagtgggttagaaaattgattcttacgtccaaagaaactctcgtatgctgttgtctccttcaacacagatatatcattaaatgcttttataggattttgtccagatgcacgcataaaaggaaatgcattgacagaatgaacaactcgtggttatgggggctcatcatctgaactattattaagggcaccatcacaatcctgcttgttgtcatcgtctagtccaaatctatcctcaccaacatatgtctcctcaccaacatatgtgtcttctgcagtattgtcatcatctatagttggttgtgtttcggaaaccacattatcctggttgataggtgaagacaactgaactgttgaatgcataccatctgctaaagtgggtacaacctttgcttgtgaatgaactgtacctggctccaaagaaacacctgagccattcctttccgaatgcctagttgatgcaaccaaggttgtactattaacctgacttaatcttgcttccgtataggcgcattcaacataaagctcaacaacctgcccacatgtcttctcaaatatcatcctccatcccctgtcttcataaataggaatcaattgaaaatattgtggcccaggatttccgatatcaaaccgagcttggatattcattgcacaatgatcctcaatgtatccaagggcctgaaaaatttcttttttgacttcctcaaaggtcgtagcctccactgccggaaaagttatttttggaggaatattatattctgcacccttagctccatattgtattctcccatcaacatatactagaacaataatcattttttctcagtcaactctgcaaaacaaactaaacaagttagcaaaacaagttatataattaactttaagttagataataatctgctgatatatcctttcaagttttaaaaaatgttgttttgcttattaaaaatgtcaatgaacaatagtcattttatttcctggttgtgtcttccaaacgaactcaacaattaacaaaggcatggtatatgtctactagttggataataatctatacatatattcaataaaacactaatgtcatatatcaagtataggtatgaacaatgtagtacatatcaattaatgctaattagatgagggtgagcagagacatgctataagtgaaaagacatgcatgcatgatataaattgcagggcaaacctattgctcacgacgagagagctgccaatgcacacggcgccgtggctggattgcaggattggtggcgccgtaaaacacggacaaatcgaaggccccggcgtcgacgacgagagtggcttggacgacgaagcggatggatcaaagtcgtagagagggtgaactcgtatatgagttacgacgatgcgtggccggttgccggcatgcgcgatcgagcgctcatcgctagagttagggttttcttttgattgtcagggttttcttttgattgttctcactctattcgtggcttggctgcaccagggaggtggacgctggttccaacagcgtccaagtatggacgttgtttacaacggcgtccaattatggacgctttctatattagcgtccatcctactcctataaatccccccaacgatttactaattgtttaatttaagggtaattatttattataaataaaaaattcgggacctatattgtgtttgttttaacggttaatggacctattatatagttatttcggttcaatgacgaaaatcaaactcactttcaagttaagagatctaaaatggacttattcctttccctgcaatcaacaattaatgggatggccgaccggtgtggttgtattgggactgggggcaccagtgcaccacctgcaccgcctcgtgctcacgaaacccgatcgatcggtgatctgcaccgtccatcgctccacacccaattccctccggccacaccgtatcgcatcgcatcgcatctcggaaaacggcatatccgcgtcccccccggcggggaagtcatagaaatcgacttggccgctacgaaacccagagaaacacaccccggcggcacggccccctccgcctctcgtctcccgatcccgcacgcggccagctacaaatacgcgatttgccctcttgcacgcgtcgccccgcgcaccgcaccgcaccccacccccgcacgcaggaacgaaaggtgggtcccccc

SEQ ID NO: 68085 - DNA, 13078 bp, Oryza sativa
aagaggccgagctcagcagatcggttgaagggaaagggcactgctgtcagggcttgtgaccgggacctggcaagtatgcgagtgatgggtctggatgctgtgatgatggtaaaggatgtacgcatggcaaacagattaagaaagggagcaaaggtggcttcatcatcttctcacctctccaggtcctggcctaatgagggtaggaagagcaagaagtatcagagtgtaccaggtaaaatgccttcactgttttctgttgttttttcttttatgttatccattgtcaaatatgggaaaattagaacaatcagcgggcaagcacatctcactatgtatcttgaattgaaaagtcgtagtgctaagactgccaagcttccattaatcatggaatgttcttactagttgtttgtgtatgttaataacatttaggtttgatttgttttaaagcttttaaattttttgtttcataaagatggcataaagtaagtctggttgtatgctattgtttccactttacagagaatttgagataatagctgataagtattgcccaatttccactctctttttaatagaagtcatgggctcatggcagatggtgtgtattgattttagaaaaatagcactaggttgatcagtgattatctattgtgtacctttttaatacattggcgcaactagcttgttgtgttacattatgattgtccgtctccatatggagaagtaactcaatgtagacctttcaaattgaaaagtctgcagggaatatgattatccttggaaagttcagcttcttaaaaagttgctcggccactgtttacattaatgctcttctttgttcacgtatgttacaattatattatgtttgtgtgcctgctcaaatgttcatgttctcattatatttaacctatattgcgatgggtttgtaaaattttttgtatgtgattcaggtgagaaaaagaagcatcggaaggaactcattgcaaagaagcgccgccaacgaatgctaggcagaggagttgatttagatcaaattaatactgtgagtcttatagttgctttcacatgaagtgaccttattctgaaagttatgcccgtatgattctaaatcatcatagcaggagtctagttattttctaattctccagctcaatcccctgaaaaaaaaggcaagcacacagtcattaatgtctatgatatggtataaagatattagggattgtacaaagttcagtgataaatgcaagaaaatagtagtaatacaacattatgtgaagagaccttttacattttgaaactcagggtctatgcaatgtgattctgtccattgagttttaaaccggaggatgttagtgtggtgctatctggattcagttttgtactctgtttgttaaagtggaggtacaagataagatgtgcacaatatggagaaatgcacatccctagagagagtttcatatccactgtagctcttcttatgctgtctgttttcctttatgttggttttcttaatcaagctggttatgggtaaactttgagctttcatactcgcataggatttcttatgctttctgttgttggatggtacttggttattttcccttccccattccttgttagtataaaatgatgtgtggcctggttctgtttcttatgtgcagaaattgaggaagatggtcgtagatcaggttgatatggtatgcttccaaccaatgcacactcgagactgttcgcaggtattagatgcatgtctgtctatcattgattgtttgtattgcttgttaaagcatttgtattcaagcgcatgctaattgtgccattattgttgttaaatttgtaggttcaacgccttgcatctatttatcacttgaagagtgggtgtcaaggttcaggaaagaaaaggtaagtgccatatgagtaaatttaccgatcctagtagcactcccatgtcatgttgaatcttgccacggacacattggtttgatacaacatgtcataatgatgagtcatttttcccatctcttcgatgatgataggcatgttagttagtttccttaactccttgaggtatgcttatgttgcagcgcggtgagtgataccaaacatcatcattatgcatgcgagttcatgtcatttcaatgtgcctggaatttttgcattgctagggctcaaactaaaatctttacataattgtcgttgtattaagtaatgccttactggtgtaggatcttgttctttccctataccccgactgctctgactgttacagatccatccttagttcctaaccgacttacccactcaaattgctcttgttttatattcgctattttattttactctttaaggtaggaaggtgcatgacctcctgcaacaaaccatctgtcctttatggacagtggtaaagggtgcagtggcttattaaccactcccctgttatgcatgggcactgatacgagagacgtaagacaatgacgtgtttccttgtcgtgttcatcgcgtaagcgatgtgtctgcgcatatagcaactgccataacctggttatctataccaagatggttatgtgttagttgtatgcaggacattgcacctcccaaccatcttgtagcattgcatttttatgctttctatacttacctgctgtttacctattttatatcaattatgacatgtaatggagataatggtagttgcaatctttttcttgtttaaaatcagtttatgttggctagtcaagcccatgtccatatgagaaaattgacatcatatgtggttttgcactatattaaaaatttagttggtgaggttgcaaattaaatggataccccaaatttcaattaacttgcattctaattattttgtgtaagtaaaaaaaaatcatatggaaattctttgatctgctgaatgcagctgcgttgagtcaaatgctaatacaacattcttgccgtaaagtcaataattctgtcttgcagatttgtcactgtgacattaaccgcggattcttctttaccatcttctgagggccaaatccgacttgaaaaggtgtgtatacactgctcatattgttagtcgccactctgttcaattttgaagtgctttgattcgttcagcccttcatgaattcacatcacatttttcctttttttatgcccctcggtttaatattatagtcactttgggtttgtcctaagccaaatatcgtcaagtttgaccaagttagacaaatatagcagtattttcaacacaaaataaatatactataaaaatatatccaatgatggatttaatgaaactaatttgatgtcgtaaatgttggtatgtttttctacaaacttggttaaactttaaaaggtttgacttaggacaaatctaaagtgacttataatatgaaacagagggagtaataaactatgtcgaatctcagtactgtagtatttctacatataacataaaacattgtacatcatttttttgtcttgatattcaccaaaaaacattttatttggcataattggtcttgatattttgttttattgcaatcatgttatctccttgccagtgttaattgttccaatcttctgtctaaattgcttttcttctatatttcagctcttgggaactgagcctgaggactttactgtcaattgggagaactctaaacgtccagcccaagtgaagggcctctcagctccaggaaagttggcaaggaatcagacttccagtggaaagaaatcttccaagaaacaagtatcatttgctgaacgtcctgtatcttttgtctcctgtggcactatggcggaatctgttactgagacaattgcagttgccacaaccagtggtgaagtctcatgtgagaaaattgttgaaagcgactctgtcaagctgggaacctttgagatgcacaccaagggctttggttctaagatgatggctaagatgggattcattgagggaactggcctgggcaaagatggccaaggcatgatgcagcccatccagccaattcaacgtcccaaatctcttggactgggagtagaatttgacagcgaggctgaggcaatcaaggcaaggtcagaaccaccaaccaaagcaaggtcagaaccatggcggaatttgaggaaagtggagattggtggcgttggttcctttgagaggcatacaaagggctttggatccaagatgatggcgaggatggggttcgttgagggctctggcctggggaaggatggccagggcatcgtcaaccccttgactgcggtgaggcgacccaagtcaatggggctgggagctaagaataagtattaataccatatgtgccttctatctatctatgttatctatgttatgtaccttttacagccgcttgagtttgataacctagttgtatatatgctaggagagcataaccccgttggccgcggcaaacagcacgcgaaatcgtgggttccgatgcccctggctgtaggcagtaggttctatcttgtttacattgcggcatttcacatttttcattccctgttgttttgttcaattctctggaggaaagttatttatttccatggtacgtctcatctagtgtttttgtgtcaacttgtctttctgaagtaatgtgaagctgcgatggatgccctgtgatctccctgtgatctttgcatcagcaggttgcattcgtcttgcgtctcgaatccctctgcttgtttgaacttgaaataattctaggattaagcttttatacttagcggttgtaacactaaaccctaaactagttctaaaattgaaaactgcatttggcttataagccaaatccaaactagtgagtctcttcatacacagaatggctggatctggtttctaaccagtaagtttaaacagaagttctctgaacgatgagaagacctagcaaattgtttgcctatctctcgtctcacgaaaaggttcccgtagacctagtaaagttgacaggttgaataaagcttaagcaaagctatgtgtagtcacacttgacacatggatagatcttaagcaaaggcagtggaagtcaaacagctgacacgtgcagatataaatacaaagtgaaatcttgtaatagtgctcctttaaaccaaactcaaactcgtttctatctagtactactacggtgtatactcatgaagtacaaaatggaaaacaccaaaacgaggaacaaaaaataataatcttattatcatgtagtaataaaacgcatagatcacctacataatgaaatgacgtggacagtgcggacgatgacgccatggatcagtcgagcttgacggcggagaagaggtagtagacgaaggcgaaggaggcggcgagcccgacggcgccggtggcgagcatgacggcgagcgccatgagcagcgagtagccgacgtagagcgcggcggagaccgggccgctgaggctgtgcaggtcgaagacgaggtagtagacggcgtagccgagggtgtaggccgcgacggagcccgaggcgaagaaggcgcgccaccaccacctccagtcctccacgcagagccccatgtaggtgagcaccaccgacacctcgccgcacacggccaccagcagcgccatcaccaccagcaggaacccgaacacgtagtacaccctccccagccacaggctcgacatgatgaacagcagctcgatgaacagcgtcccgaacggcagcgtccccgccaccgccacgaacacccacggcgagcactgcgccgccggcacctgcctcgcgatcttgttcgtcttcaccgggtactcgaggtgcccgacgcgggatgccaccagcccgccggcgagggtgagcggcacggagacgaacgcccagaggaggaggatcacggcgaagagcaggaacggcacggcgcccgtgctgccgttgtaccagagcacgcagttgagcgcggtgaagacggcgaagcccgcgccggggaaggcgcaggaggcgcgccacgccacgcgcttccacccggcgctgtccccgtgccgcaccgtcttccagagccgcacggcggcgtaccccgccgcgaagccgaggaggaggtagatgccgagcatgcccgtcacgagcgcgccgcgcgacgccggcgacatgaacccgagcgccgcgaagaggatggtggcgacggccatggccaggatgcgcaccccgtcgccgaccatcacgcagaggagcaccgggtgggcgggctcccggaacacgtccccggcgacgagcttccacccggcgagctcgtccgcctgcggcgccaaccccgcctcgcgccgtgctcgtcgtactgcgcgaggtcgcgccgcacggtgcgcagcaggatgacgagcaggatggcggcgaggaacgccaccaccacgatggagttgaggatggagaaccagtgcaccttggcgccgcccatctccaggtacgcgtcccaccgcgacggccactcgacgccgctctccacgaacgccacctcgtaggagaagacgagcggccggttggcccgcacgcgcatgccgaccaccgaagggtcgcacccggcggccgccctcgccggcagctcgtcgtacatcttcttgcccttgatcgccgccgcatcgtgctccacgctgcacggaacgacctcgaacccgacgacggtgtacccgccgccgtccttgctcccgccggcgaagctgatgagctcgacggcgtcggcggtcgccatcagggcctccgccctggtggtgccgttccgcggcttgttgaccagcacggtgagcttgaggtggttgtacacgtagtactcgccgtcgtcggcgcgcacgccgacggggaagccggtagaccggacgaacacccctggcgcggccaggttcttgacataccggacgacggggagcgtgtcgaggaggaggttgacgtggtaggcgtcgtcgatgcggaacatgaggaggtcggcggtggcggggggaagcgggtcggtgcggcagaggaaggcggtggcattcttgagcatggagaagcggtacggcgaggtctcgatgcggtcgccgaggaggagctcgccgaggctctcggcggcgcggttgacgccgccctgcggcgcgcagaacgggagggagtagtaggggaaggggagcttggacgacggcgaggtgagggagttcaccttcgcggccagcgcctcgccggggcggtagcggtgcgggtagctgcccgggagatagaacgcggccgccggagagtggccggaacggagcaggaggatgaggaagatggcgaacgtggagcggggagccattggcgtcgccatggccattctcgcgtgcaggaggatgaagaggtgagctgatcaatgtgtgtcgtgcaaaacctgttcttattgagtacacctgcttgattatcaaagaagaaaagaaaaaaaaaggtactttacttatcagttatcacccatgaaatgggagtttttgagagcatgaactgggtgtgaaaaatcgaataggtttacttaatgggattgtccaatttttagatgaattttggtcagtttttctcaacattaagtgaaaatctaaccattcttattatcattccccttattctctattgagtaaatttcacaaaactacgggtagtttaactaaattatcacaaaactacatattgaaagtgttacaaaacaaaactatatatttaatataaaatctatcacaaaactgcatatttaaaatcgaatattagatttaataccagagttatcataaaaataaaactacagattctatagtttaataatccttaccactactgctatgttacggttacaaatgttgtagtttagtactaaacatgaagctaaatttgtagttttgtgataattgtattattaaatgtatagtcagtgatctttcatcctaaatctacagttttgtgatacacctttttaaaatatgtagttttgtgatagtttcatcaaagtatatgtatttttgtgaaatttatactcttctctatttaaacacactcacttctatattttagataaaaagggtcaactaataaattgttctaacatatactaaaaaatatataagataaacatttacaactaaatacaaaaatattcaaactctacaaaaaaaagagaaaatatggaccaaagtccttctgcctagctacaacttaagtagaatcgaagtagagtagcaaacgagcaaagttaattagcacataagaccagcgttagaaattgatgattgcatgcttgtcgtacattttgactaagcaaagctagctagcctcactagcaagaaaacctttttgaacatagatcaagattccagcacaagaagaaactagcaggccttgtggtcgccaaagatgcaaccatggatatattggatttgtttgattagcaagatttgctccatgtaacagcatctccaatagcctctccaaatcggactctccaaacacttatatagtcagctttccaattgatttggtaacccaaactcattcctcactccaataggctctccatcaatactctccattacgagcctatgacactgggacccacacgtcagcttctactaccccttcttcctcctctttttctccctcttcctcttctcacggccctcttcccgtgcaagtgcgcgacgacgatcatgcagaggctgacggcggcggctcgcaacggcgaccttggcaatgacggcctcgacgatgacccatggaacggaggcggaggccgtgcggggccggaggccgtgcggggccggaggccgcatggaggcggcagaggtcgtgcccccaccccgaatccagtgggggcagagccgagcgaatctggcgggggcggacgccgtgcttggctagaggcctctagacttggcgacctcagtgacgatggcagcgaatggcgacgtagcagacgacgacagcgacggctggcgacggagacctcagcagcagtggtggatggcgatggcgaccttgacgacgacagtggtgatggcgctcctctgtgtgggtgcgggattggtgctgcaacggcgacgcggggatgacagcgacgcacaacgggctcctgcttaggcaatggcgacgccggattcactcctcgttggcctcgtccgctccacgctcccctcccttatgttgctttttttctgcttctcgttggtggcggcggtcgcggaggacagcgcgagcaacggcgtggtcacggcgggcaacggcgcggaggacggcggcagtcgctgcttcgacgcctcttcctttgtgccgtcgtcgacaccaggacatagcaagcaagccgatgcaaggagccgaagaggagatggaaggaggaatgtgtgtggggcccatagttggctagcgacttttggctagccaaatttggctagtggagggagggttttggccagccggatggggcttggccatccggttggagaggctgttggatgacttttttaagctggaatagctaaaatttagcttggagagtaaaatagagaggctgttggagatgctctaagggcatatttaaagatatagctcggtatgtaggctcttagtttatttagaaattatctttttataatggttaagaagacaaaagctgtaattagtgtaccaaaataattttctacgtattaatttctttccatttttccatctctattttataagcgctaagagtcgatattgagctattgctaagcttaacaacgatccttttgtttcatttcccatctctcttccatctcgatcaacttactccgatagggggagtattttgttaacaactctaagagctcaatattaattgtggttttatatgccctacataccctacagctagggaacaatgattattaagagcaagttctggaggctactacaacttattttaaccatgtcatctacttggtaattacctcaaatacacaaacaacaacaattttattttattaaacggcgttgctatatttgtggcgccacaactctcatgttatctcactttctctttgcatgagttcagacttgtagtttagagcagttacaggttcgcgctctcatccaaattaaatgtttgaaaaagagtaaattacattcacggtacaacaaattgttaggtgtgtgcagtttagtgcaagaacttaaaatttaagcgttaaagtacaccaacttaactaggcggtgcattttcaattgtagtgaaagccctgtgggattttctttgccccagcgggcaagtggaagccacacgacattttcggtcaggttttaatccctatatgctttgtggctttgatgtctacatgttactaactgcatagggatcatcacatgaaccgaggccatgatgaaggtggacatgtttgcattgttttttaagcgtttatttgttagtttagcaagtatgcaccgataatttactatgttaatcaatggagacacaccggtggatttgttgctgatcagtttaaggaagggggagatggctctcacgatatgtggatagtggatgctggtgagatggtgaatggttggtatttggctgaaatttagagattggtggtgtttaatcagtgccaatgtgccgctgatgtggcaaaaaaatccaacgagacttgcactttgactgaaaatgcaccatctagtaagttgattcactactcaaatttcaagtgtttatactgaagcgcacccacccgataaattcttgtaccgtgaatacaatttactttttcaaagaaaaaaagatttagcataccaaagaaagtgtactcgggtaggatttatgaagcttcccaggataccaaacaaatggaaaaagaaaaagtacatctaagatccttcatcttatcatcgaattacaaaatcgtccctcaattgaaaaaccagatactcctatagcatcccttaacttacaagactgggttactataggtccttagatggtattgaacccggttttatctgacgtggcaaccgagtcagcgtgggacccacatgggccccacatgtcaggttgaccatgtcatcaccatctctctcctctcttctctctcttcctcctttctccctctcactttgctccttgtctgggcgggctggccagtgggtgcggaggaggccggcggggtgaggcaggagagaaagaggtccaacaggcagtgacgggcgacgcagcagcggaggcaacacggtgttgcgccgacgaggatggggccgatgtgcagcgagagcaacgcaattggcgccaccatcctcccatagctcctgcagctccgatgccacttacggctggtcctccttgtcctcatacatcgcgccgcccttgcagccaacgccaccgacgcctcaccagctctcgcgcccatcggccggaggcgaggaggtcgacgacgatgcggcgtcgacgaggatagggccaacgtgcagctggagcaacgtgattgacgccgccatcccccactgttcctgtagctccgacacctggtccttcccgtcctcatccacgcgccgcccttgccgtcgatgtcaccgacggcttgcctactactacacctgccgtccgaaggcgaggaggtcggcggcgagcatgcacgaagaggaaggaggctgggaggccgtcaagggagatggggaggccgacggcgaacacacggggagaaggaggaggcggcgcgggagcatgccggggctccgagtccacctccacggcgcccaccaccgcaacgctcgcctctacaccaaccatcacggcgcctgcctccacctccgcgacacccggccctgtctccacctccatgtacactgctacgatgcccacttgctctcggcccgttgctgccgccgctgccgcgccgccacatcgccccttcccccacgttgcccgtcgcaggccaccagatctcctcccgcctcgacccgccgcccgacccgcttagacgaggaacaaaatgagagagagagaggaggaagggagagaagaggggagagagagggtgatgatgaagtcaccctgacatgtggggtccacgtgggtcccacactgacttagccgtcacgttggataaaattggggtcaataccacctaaggacctaaactgacccaattttataagttgatgaatgctatatatttggttttttggttggaggacgattttataattcgataacaaaataagggaccttacgtgcacttgttcccaaataaatagacctagcttgggcttagagccttagacaaaaattgttacccaaagtaacaaccaggcccaagttcataatagcccactaacgacgggtctacagcccatttatactccagtttcaatagatggaaaaaaaagcaccgaaggtccatcaatttgtcatcgagttacaaaatcgtcccccaaccacaaaatcaaatacaggacatccctcaagttataaaaccattcactttaggtccttcggtcgtttttgaccccggttttatccgacatggcggctaagtcagcgtagaacccatgtaggctccacatgtcaaaataccaggtcatctctctcccctctcttctcccccttcctcctctctctctcacttttctcctctccgcagggcggctagtgggtggggaggatgtcaccgggacgaggcgggaaagaagatccggcggccgacgacggcacgtgcgacctcggggttagaccatcggagaggcccgggaggtgtcggcggcggcgacgacacgtgagaagggaggcggcggcggctgcgatgcttgagagggagaggtggccggcagcgaagcaggggtggtggcgggcggagcgggcgccgcggcaggcgagcgcgcaggaataagctgtcttcggcgtcgttcccactctgctcaccgccgcctgttccgcccatcgccgcttgctccacccaccgctgcctagcgctcacacactcccgccagccacctcccccctccctctcaagcttgtgaagaagagagaagaaagaagatgccgcggagcttggtcgggaggaggtggccgtgggagaggtataccaccggtgcgcggatccatccacccccgc

SEQ ID NO: 68086 - DNA, 2724 bp, Oryza sativa
  unsure (1)..(2724): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaagagagaagaaagaagatgccgcggagcttggtcgggaggaggtggcggtgggagaggtagacaccggtgcgcggatccatccaccccgccctcgggcacttccggagttgggcggcgacggggcgtcgaccgcgtctcccttctcgggccggtggtagggatccttgcggagccgggcgggcggaaggcggcggcgacggggttatcgtcgcggttgatgccaatggaggagccatccggtgtcgaagcagcgacgccaatgccctcctccttctcctgcctcccgagcctctccgaccctgagctcgcatacgcggcgatgccctcccttctctcccgctgccaccgccgacgtcggcggccgtcggtgcggtgccaccctcctctcccacctcaccccaccgactggcctacaggtagagaagactaagagaaaggaggaaccgaggaagggtgagaagaggggagatagagatgacctgacattctgacatgtggggcccacactgactcagccgccccgcctaacaaaacagaggtcaaaaccaccgaagaagtgaatagttttattagtgagggatgttgtatatagttttgtggttgggggacggttttatatcttgacgagggagggattgtactttttcctcggtagatccacacctccgaaggaatcgaggatgtcgtttccttccccacctcagcgcggttccaggcggaccgcgggtcccacgcctggccgccgcgggagctgagcggtgccacgtcagcgcgcgacgcgagctccaatccacatacaccttctcttccctccacacacacacgcccgcacactcctcgccgttcgcctcgcgctcccctcgtcgtcgtcgcgcaaatggcggcctcctcctcctcctcgtcgccggccgcggcctccgctcccttcgccgcgccggggccccaccgccgccccggactcgcgctgcgcccctcgccgccgacgccgccttcctcctccttgtcctgctgccgcgcttcccccgccgccgcggccgtctcgtccgtctccgccaccgccgccccgaatcgcgggcccagggttcgtgcggtttcggcttggccctctcgtttgtccgatcgtgtgcactgggcacgctcgcggctgttcccatctggggctaaccgccttgtggtttggcaggggatgggtcttcgttgccgggcatcggagggagcggcggcggcggcgcggaaggaggccccgctcaaggtgatgatctcgggtgcacccgcgtctgggaagggaacgcaatgccgcatgatcgtcgagaaggtataatagaaaaaaaaaacaatcgacactttttcttaatgccatttcccagatattcacattgaccatttcttgtagagagtatggaaatatgggtttgttgaatcaaggctcttgaaaattttctagatttggtttccatttgaattacatgtatccatgtaggtctttgctcaatgttatgcatgtatgtgaaagtacaaacgtttcatatatgtttaggctacttcttctggattctttgtaaaatcattatattcagtgtgcaacatgcattctattcaagcgacttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68087 - DNA, 706 bp, Oryza sativa
ccaagcacgctaagaatgcatcccacaaaaagagtagtggcctcatcgaattctttctgctgatcagcattaagaacgcccataggcttgccagtacttacccagaagcatttcatagctgtcagccacagattgaccctgatctgccatctcttaaagtgcacactggtaaatttatccggcctcagtgcatcggcaaaaccagccatagtaaaatcacagcgtctataataaggtttttggaatgttgcgaatataggcatataatgatttaatatattccataaataaatcatgacattacagatgtatactagcattaacgcatcattagatctacacatgtaaactaagtagtaaaatatgaacagatcaaatatgcgcaacatgtcgaacacgtaccgaggtggcggaaagaccggttgctcggcatgaactacttgcggttgcgagcgtcgacgaaggcgtgcagcacgcgagcggagaggaaggcgaaccgtcgcggttgaacagggagcagtcgcacgaagcgcttcccaaaaaccttattgccgccttctcccggtgcaggacgtcgaaggcagaggttccggagacctgctctcccgatcgccggtgcacgctggcgagcgggatggagtagtccacgagcgacggcgcaacacagaggaggaggcaaaccctagattgatttcgcgtgtgttgc

SEQ ID NO: 68088 - DNA, 1922 bp, Oryza sativa
acactccttagtcaatttcataagcatacgcatctcttgatgcagactactggaaggaggatgtccgtagtgaaatggattccattatcgctaacgggacttgggaggtgacagagcgaccctatgggtgtaaacctgtggggtgcaagtgggtgttcaagaagaagctcaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcattcatcaaatggacgttaagacaacttttcttaatgaagagctggatgaggagatctatatggatcaacctgatgggtttgtagttgaaggtcaagaagacaaagtgtgtaaattgttgaagtctttgtatggtctgaaacaagctcctaagcaatggcatgagaaatttgacaaaacattgacatctgcaggctttgcagtcaatgaggcagataaatatgtgtactatcgccatggtgggggtgagggagttattctgtgcttgtatgttgatgacatactgatatttaggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttgactacattgatagtaagcattctccaacaccttatgatcctagcttgttgcttcgcaagaacaagagaattgcaaggaatcaactggaatactcctaaatcattggctcactgatgtacctggctagtgcaactaggcctgatatctcctttgttgtgagcaagttgagccggtttacctctaatccgggagatgatcactggcgtgcgcttgagcgagtaatgcgctatctgaaaggtactatggaattggggcttcactattctgggtatcctgcggtactggaggaatatagtggttctaactggatctctgatgtggatgagatcaaagccactagtggatatgtcttcacactgggtggtggtgctgtttcgtggaggtcttgcaaacagactattttgatgaggtcaatcatggaagcagaactgacggcactggatactgctactgttgaggcagaatggctgcgtgatctattaatggatctgcctattgttgaaaaaccggtgccggctatccttatgaactgtgacaatcaaacgataattgtcaaaatgaatagttctaaggataatatgaaatcgtctagacatgtgaaaagacgattgaagtttgtcaggaaattgagaaactccggagttataacgttggattatatccaaacagctagaaacctggcaaatcccttcacgaagggactatcacgaaatgtgatagataatgcatcgaaggagatgggtttgagacccatgtgagttatactatggtggtaaacttatctatgtgatcggagatcccgtgaattagaacctgggaagaacaaaccattagtaaactagaggagagtaccaatctataccctttctaagtgaagatgtatgtactctcgtgagctgcaaggcaggttggctatgccttaatgagttctgttggctttaattagcgaagatgatgtcctacagagcattcttgaaagaacttacctttgtaagcttgactgttggtcgcagtctatgaagattttgggtgaatcttctaggaagcttacgaaagacctaggagtatgacttatacgctccacccgaggagtagtctacaaacagtctagtaccagataagactctgagtgaaac

SEQ ID NO: 68089 - DNA, 2605 bp, Oryza sativa
ttccctgttcaaccgcgacggttcaccttcctctccgctctggtgctgcgcgccttcatcgacgctcacaaccgcaagtagttttgccgagcaaccggtctttccgccacctcggtacgtgttcgacatgttgcgcatatttgatctgttcatgttttactgcttagtttacatgtgtagatctaatgatacgttaatgctattatatatctgtatgtcatgatttatttatggaatatattaaatcattatatgcctatattctcaacattcaaaagacacgagatagaagcttatgaaaagttcaaaagaagtgcagtggggactgcattgtacattcatccctgcctgtcagaaatttcagagggtgatgctgcagatagggcgagcaacttgacagatgccactgttgacagcttgattgagtctatcatcattaaagatggggtgaaagccaagtttttctttaacattatgtctcttgctaactctgcaggagagaagttgcttgccttcagtcaatatatacttcccatgaaatttttggaaaggttgttggttaagaggctgggctggcatgtagggaaggagattttcatgatatctggtgatactagtgcagacgacagagaagtggcgatggatcagtttaacaactctgccgatgcaaaagttttgtttggttccatcaaggcctgtggagagggaatctcccttgttggtgcatctcgagtcatcattctagatgttcatttgaacccatctgtcacccgtcaagcaatcggacgtgcattcaggcccggacagcagaagaaagtgtttgtgtacaggcttgttgctgctgattctccagaggtgaagttccatgaaactgcattcaagaaagaagttatcccaaagctatggtttgaatggagtgagctctgcactactgaagacttcaaactgaatcaagttgatattgatgactctgaagatgaactattggaggctaatgctattcgccaggatatcaaggctttgtatagaaggtcagctatctctttctccccgtgcgcatgtgcaagttaaaccctggagatgctctctctgtcttatccaaaattgtcttgtaggtaacaagttatatgtggctgctgtacaccatgtacataatgcaatgctgatctttctgggtgatcatcgctgtgaagtaaggggatttctcgtgaatcattcttcacgttacaaaatctttgccccttattctgttctgattgtatgaccatcagctttttcgttaaccttcatcatttttcttccttcaggatgttacagtagccccttctaatgccggagttccgttcatgctaggatttatcgttaacctcggtcgtttccctacctatttgaaccactgtccgctttgttaacatgtgccagcttggcgcagcggttcgcgagctgatcctagtcttatttccttctgaagatctccaggactaataactatggtttctgccgttcctgctaacaacttaaataatgccactgtttccttacctgtcttttgtgcacttcaattggtcttcaaatttgccctttttgatagggtaaagatagtttctttctgcgcgtaacggaatgtaggttatccgtcgtgcatttgtgcatctcttttatctcctttgttgcagtacctggtttttgtgtcgaccattctagtttcaattctggctcccatgaaagatgctttaagactcgcaatgccaggatgcatactttttttttatgcatactcgatcgttggctcgttgcactcatcgactccagatcagttgccagcggcaactaatctctcaaaggcctggcggttgtgttcacctggtgctggtgcatccgagggtgacgacaaggacaggggaagaggagctgtttgtacttttgcagggcccgctttttttcagcttagaagcataatatcacctgattgttacgaattatttgcttcatgtttaagaataataatttctcatgaaactttcttttactttattgcccagaccacttgttttaaactacaactatttattatgtttagataatatgcaatatttaatgtattcatattattaatttatctgcaataaaacaaacactagcctagagcgagtaggaagagcgggctgctggagtgcttgcgggaaaggaattgggccgctgtggggttgacgttgacatatgcccactggtaggaataagttcacttcagatccctcgatttgtcacccagtccgatattcatccttgattcgaaaaactagatataactcatcccccaacttacaaaaccatgcaaacaaggtccctcggtagtattctctgattttggctgacgtagcacacacgtggcacctttgactaggtcttcgtctcacgtggcattgacgtggtgcttacgtggtagtttgataaaaaaaagaacaaaaattagaaactaaaaaataaagcaaaatatgcaggacccatatgtcagttaaaaaaagggggactcacatgttagtgggtcccacttcctccatctcaccctcttctcctctcttccaatcctctcattttctccgag

SEQ ID NO: 68090 - DNA, 3165 bp, Oryza sativa
ctatttgccacttttagatttggcaaataactatttgccacccctatctcaatgacatgtgggtccacatgtgtctatgacatgtggatccaatggcaaaaagttaattgccacatctaaatgtggcaaagccattgtgtttatctcttcctctcccgatccttccaacccactcggtgtgcaagcgtggtttaaccgggatgggatggccgacgggtggcgaggagagggcgttggccggcggggagaagggacggcgcgcggcggccgacgggagaggagcaatgcgggctggtcctgcagcgtagctgtggcggccgcggcgaggaggagggaggggagtagcagcagcgcggggacacccatggctgtcgcggcgacggcggcgaggtggtaggttggatgggattgggtttgtgctctgctctgtctcgtaagagtagaaatggaggtgggcgagccgcccttgcccccatcttgcctcctcgctgccatggtagcgacggcggccaccaccaccgttcacctcgccaagttgctcccgtcccatcccgcctccactccgccatggcaacaggggcggccaccaccaccgctcagctcaccaccctgcccccatctagcctcctcgtggctatctctccccctctctcgccggcaaggcggcgccctctttcccctctcccgccggcgagatcgaccgtctcctccctctcccgccggcacggctgaccccctccgaggatgcgcgcgtgtgttggcgagacacattcatcccaccgccgagatgccgaggtcgatgtcgacgtcgtccacggccaaggtcgcggtggccccgtcgccgccgggatggttcccttctcctcgtagctcctctcccgacggcccgccgtgcgtttccctttctccccgccggccaccgccctctccccgctgtccattgaccgtccaatcaggagagaggagagcggagagagatgaagagaggggagatggggagataggaggggagtgagaatgacatgtggggcccacgtggaacccaccgtttttaattattatttttggtgtaactgatatgtggacccgcgatttttattattttccaaatcaaattgccacgtaagcgtcacgtcaatgtcacgtgagacgaagatcttgtcaaattagccatgtaggtgccatgtcagccaaaacaagaaacaatactaccgaatgaccttatttgcactcgttttgaaagttggggatcctttatatctggtttttgggttaaaggatgaaaattggatttggtgccaaattaagggacctcaaatgaacttattccccaatggtactcttgatcaccacactcaaaagtggaacatagtctgtttcaaaaggagtctgtttcaaaaggagtaaattatgtttgaggtagttgaacttaagagataggtgtattttagctggaattttttaccttttgatccttttagaaaacctattttataaataggcccctaaaaaggtattacagaaatgatccttttcatgggcgctaaacgccattggtaccgtgatccaaatatatttgtaaaaaaaattacaaatatatctttgacgctagtgctattgctgtcaagaactatttgtagatatattttattcaaaataggtcattttctattacaaataggtcttgagcagcatcaatgacttagcttccaccgaggggtaaggggatggcggccgtcatgttggaccacaacgctaataatgtgacgctgcgaaaaggatctatttttggaatgattctttttaggtctatttgtaaaataagtttttcaaaagaattaaaaggtgaaaattccaatgtattttagtgcacgaatatgtaaaacgactattctaatatataaatttatgtggtacatagggaataagatcagaacggtgcaccattttataaagttctgtactatattttgtacccacattgtaaatttatgttccgccaccacaattttctcaaattaatactcttaatcaagactcctataaaataaagtactactccctccgtttcatattgtaagactttctaggattgccatattcatatagatgttaatgaatagatatatatgtgtctagatttattaaaatctatatgaatatagacaatgcttgaaagtcttacattgtgaaatggaggaagtacctgtgtttcttttaattattgttttcaacgtcaacacgatctctaacatacatgcctcctgattaattatatgtttataaaacattaaaaataaaacttttttcatgcaaatctattaatatcgttatcacatattaaattgtgatgttttaatttattaatgatttaagatattgatgtgacaacatcaaaagaatgaaggggtgcttggtttactatcatacgtttcgcacgggtattatatagagtgtcgcatggggttttcgggcactaataaaaaaactaattatagaatccgtcactaaactgcaagacgaatttattaagcttaattaatccgtctttagcatatgtttactgtagcaccacattatcaaatcatggagcaattaggattaaaagattcatctcgtaaagtagtggcaatctgtgcaattagttatttttttagcctatatttaatacttcatgtagatgttcaaacgttcgatgtgacaggatgaaaaattttagagtgagatctaaaccgggcccaaatcatgccacgcttatgtcatatcatagtttttctagctctgggtccacatgccatgtacataatttttttgaaacaatcgaagaaatacatatcattgacaaatacccaaattcaagaaataccatcgatgagtgtgagtatcgtaactaccatcatacaagtgatttttatcaaagaaataccattgtcgttagggttccattcatccgacaccattaaatacatgagaaatttaacaatatgccactccatagaattggctttaacaggatgccaccccatggaatgtccttataaaaataccagtccatagaggatgcttcttaatgaaattccactttggggtgattagagaatctgtgtgacatgtgctgcccgcaaaaaatatccacgtctactcgcccgcgtcctctccccccct

SEQ ID NO: 68091 - DNA, 7760 bp, Oryza sativa
cggacgggcgacggcagccaactccggcgggcgcgtagaagggcgacgaaagcgatggccgagcgggggagcagcggcgatgactccggcgggcacgtggacgggagccgacgccggcgggcgcacggacaggcgacgactcaggcaggcgcgcctaagggcaatgaaagcagtggccgagtggggaagcagcggcgacgaacacgcagccgagagaagtcaccctaaactcctaatgtgtgattaaaagcatctaatcattccaaagtgtgattaaaagctaatcaccccaaagtggcatttcattaagaagtatcatctatggagtggcatttttataaggacatcttatgaggtggcatcatgctaaagccacccctatagagtggcataatgttaaatttctcttaaatacattgttcatcctataccacttaacggaagacggctaacggaaccctaacagcaatgacatttttgggataaagtcacttgtacgatggtatttcatgaaacacataattttcgatgatattccttggaatagaacacttgttaatggcgtttcttagattttctctattttttttccaaacctttgtgatgtgtggccgccaaattattagccacgtagttgtcaatgctcatcgacgatttggctaggtttgcaaggatgggtggcaatgctatggagccatctaaacatgccctaataatctaatttgaatttcaactattgaggccaacttgagctgacactcgcagtcgcaactcgcaagtggatgagataggaagatcccacagtgctactactcctgcttcacgtggtgaacagacaacagtgtattgaaagccacattttgtcgcttaatttattaccagaacgcttaaactagcttgaacatgagtattagctgaggttcgtggagtactcctagatgacatagttttgacatatgtatatgtgatagtcccacatgtcatatcgagatggaaacaaaaggattcttttttttctaaagaaaaaaggaaaaattgaagactgatttctagtctacaccaagggatgtacgtaaccatgcattcagatcgagtcactaccacatactcccctccgtaaaaaaaaaatcaaaccctagatttaaatttggacatagggtttgattttttttaacagactagtacttctcaattttggtgaacctttttttttttacctttgaaccaactagctagggatttgattttgatatcttgcaaaaatggctaggtggtgtatactgagtgtgtgtgtagagttctgttattgtattgatatactgtttttgtatttggttaattcctgtaccaggcaagaacgtgcatcagttgattttaattgatcgccttctatgattgaataattaatatcattagaaggctaccttcgacaactcatgcatgtcacccttattttatcctgcactataagaggatatcatagttagctatcttaattaaaccgagaattttctgtttgattgttattcatgatcgcctggcagcagagatgccgagatacgtacttctacttggatgtttatatctatttctaacccagtgatgccggaagaggctgataattggatgcacttatcaagctaagataattatacgtttggtaaaattttacagtaaaagtacgcgaaattattcagactagtaatcatggaattgatcaaacatattgttcttttgcaaatagacaaataaaacaacattaatttgaaacactatttatttgaagcagcgcaaatagataaaaacaagagtaaactttacttgggccacctagcttttattatgaatgttttcacttggattgccctttaaccgatgctttcactttggatcggataatcttacattgtaacacttggatcaccctgactcttttctcaaccatataaggccatcaccaatgcgtgtctttgggttgttccctcgccgacagacgtctgcttttccatccgcgccggctccccacgatggagcgcgtcccccggctgagggacgagtctctcgccacttttcggctgagcgatgcagtcgagggacgcattggggggcgacgggctcctgtagacatcggttccccagctcgtattcctattccaccccttagcagagctagagtcgccgccggccgacgacgacgaagagggagagaggagcttcattgcgaccaccgggaccgggatggcttcctccgcgtcctcccagagcgcggcacagccgggacggcgccgaggcggacccataagagagagagagcggcaagcggcggggccgacgtatccgcggtggtggcgacggcggagtaggcggctctcctcgttgccctcaccaacgaagcttcgtccgtccgcgcggcgctcgccgtccgccgcctcgtccgcctcgcgctcaccgtcagccgcctcgaccaccgcgacccgtgcggcactcgtcaccgtgtcctcgatgtggcgtggccggcgccactccatccaccggggggctagatacggccatggcggcgccggatctaccgcctctggggtcaccgccgccaccttccacgggagaaagaaagggagagcggcgggagaaagcggcaacgggagatgcgggagagatcaaaggtgccccaaagtgaagactaggaaaaaaaagtgacatccatatgaaaagatctatctatttagatcactcgagctagcatcacattgatggtatttgtaactatggtttcttttgtttgtcctttattggaagatattgtttagaaatagctggataaaaccgttagttgctgtaaagttctatattcagcgtctcaaatgtaggtttatctcttactaattagttcaaggcatttatatgttacaagaatgataacaaacaaagcataacactaaaaaggagccatagtaaaagatgcacttttgaatctaataactaatcagctctaatgtggctagccaagtaaagtaatgccttctcttattctgtgcagaaatgccgctacttcaggacttgcagcagagtcagtatctaacaaaactataaaatgattgaaatgctcaagactttatctttggaaagagagagagagaaagaaatgctcgagacatggtatccaccaagtgtatcataagtcatactccctccattaaaaaaaaaccaacctcgcactaaaatatgacacatgctaatatgaggttggtttttttggacggatgtagtagtagagtagaaagcatcgtggccccattcagatgtttgatataaaaaggagaaagaatcaatcaagaagtcagcaatttagcggaaaatgcccaagatcaggggtgccgccaaaagaaccaacgctgatgtggaagtaaatgaaacatatgtatttaactacatgcgtgaatactttctttttttgttgatgtccggaatggtatgcctccacagatccacctaaaacattttgagaaaaaaaaattgcaaagctttgagcttggttttccgaaaggatgtccactggaaaattgttacaacaattttacatcggtaataataaaagagagctacgcacaagattaatttaaaagtgaatggatgcacagaaacaaaagtttaggctgtgtttgggaggtgtagttgggaactccacctcctcgcacggaaaatctaaagcagtccattagtgcataattaattaagtattagttttttaaatggatcaatatgatttttttaaagcaaatttcgtatagaaacctttttaaaaaaaatacaccgttaaaagtttaaaaagtgtgtgtgcgaaaaatgaagggattgagttgggaactcaaagaaacaaattaagcctcgggcaggttcaaactctaacgagaggtaattcgctactcttatcttgatcttggtggattgtatctgacagatgtcattgatacgttgatctagactatagttgtcgtgaatttagtgccactaaggagactccctgcgcatcttatataggtagaggcattgaggggcagggttataaggaggaaaaggtaagatacgactttaatttcctaatttatgcaatgtattattcagttagggctctacaccctgccttgtgtaaggcaacataacattcgagtcatactctattgtatatatcatggtttcggaccaccaccagtaccgtgtggatacttcttacctatttcctccatgcaacctctcctcaaaattgagaaaagaaaggccgtgtttagttgttttggcaaaatattttttgatgtatacgggcacatatttgaagtattaaacgtagactaataacaaaacaaattacagattccgtctgtaaactgtgagacgaatctattaagcctaattaatctgtcattagcaaaagtttactgtagcaccacattgtaaaatcatggcgtaattaggctcaaaaaattcatctcgcaatttacatgcaaactgtacaattgattttttttcgtctatatttagtgctccatgcatatgtccaaataattgatgtgacgaaaaagttgaaagtttgaacgaaacacagccaaagcatacccactggactaatgccatcctccatatggtggagtgcaaacgccaaacgatgctgagttttcgatttgcatttctgaataaaccgatcgtgcctgtcaagttctaaatgaaatgattatgcgtgcggttcatccatattttcaaatttatgttccaaatgatcatgtgatcggcgatccatgtatccctaggttgattctaaaatttaaaattgcctccgacttggctcacacaagcggacctaaagaaggccctgtttgagggagcttatcccagctgcagcttttagaaaaagctacttctgctagaagctactccaaacagtccacagcttctaagaatctatacactggtggagaaaccgtttgtagtcccggttggtaaccccctttagtcccggttgtccaaccgggactacgaatccgggactaaagatagctatctttagtcccgggtgaaataaccgggactaaagatcgatctttagttccggttcgtgttaccaaccgggactaaaaagatcgatcagccacgtggtcggccaaaccatctttagtcccggtttgtgttaccaaccaggactaaagatcggtgcaccattttttttatttgcatggccctgtttgctgcatggttgattttatatatatatatatatatatatattacacacacatatgtacaatttaaagcacttaacattttatgtgcatatatatatgttaccaaaatatatattaacacagaagtaaatgtgtacatatataaatatatatatatatacatgcatatatagtacaattcatttgttcggtagctatagctacgacttcgacgccggcgttgtgtcagaagaggaagaaccgacgttatgaattgtcgatccgtcgtagtagaattcaccgtcgggattaaggacttcttcgttgatgaatcccatcagttgttcttgaacagccgtgataaaatccttgtgtgggagattatccctcatgtgaatacgctatcgtttgaaaaataatgacgtatcaatatatgaaattaataaacaacttaacaaatcaatacacaatgaaattttgaatggtttatgtatacgtacatcgagcactcgtgttgtgcatatttggtttgataggcagtgggcatactcgcatacgtagtagccgcataagttagttccctggtcctgctttgcacactacatgagaaacgatgagagatttaatatactctttatattaaattagagattcaattcaatataattttggatcatgcatgtactcactggaaaatgaaacctccatccaagtttttctttccaagtcccacggaccaattgacggaaccgatcccaagccccacatatgcagttgcaagctatgattaattaattattacctgagatcaacataatagcaatagattccccgcgactttggaatagatggcattatattacctgtctatcagtttgaagaccttgtcaaaaatcttctcctctttattcattgagtcgtatacagtgactctgcatgcgtccaagtcaaagaataacaggacccagtggaatatgaaatatgcgtgagatgagatatatatgatcgaaaatgtacatgctatatgtatgggaataaaatttgttcgaacgacaataaaaactcactctgtgttgtacggcagtagtatgtacgtcttgaaatgctgctgcgttaggagatggacgagattgtcctctgtgtctttctcgtacttgtcgatcatttcggtgttgattttccgagggtcgatgaacccagtatcgtagaccctccgccgtcgggcccattgaatctccattctacaacgatgaaaggaaagtattattgcttatatatatgccaggagctaattattgaacgaaacaaatcgaactcaaagatactcacaaaatccatgcgctcagaagagagacgtcgagggtgtccaactggtacagatcgaagagatccttgaaatggatccagagaacatcttctccttgcaagaagtcggggtttctgatcctcgctccgaacatctctctacccttggcgctcatttccatgtaccgttcatggaatttgtacatctgtgtcgatagggactgcagctgttcaggtttgataagcggtttaccgagttcaaacttgtatgccacttccgccttcgggattggtgcgcctccaaccaactgatccacagttagaccggtgtctgaaatgaattccgttatgccaaaatcttcgctggtcaccaacggctcaacctcttggtttggttgttctccaagctgagggactggtttggacttcttgtgataggctctctgaagtgttcgatcatagtccgatatctgtaacgcttccttgtttgttgtggacattcccttgaagaagttcttcacgctcgggttaataggtatcttcttttcaggactccaaggcttgagttgcctcttcacctctcctgccacataagcatcaagctcctcttgactgcaatcgtacggtggctccttgtttttggtggcgtcaactttcgccatcttcgttgcccttgtgcgggcaggcggtggagcttggcgagaccttgtcttgggaggtgcaggcggacacggtggaggcggaggagccggaggagatggtgcagcaggaggtggcggaggagccggaggagatggtgcaggaggacgtggcggaggaaccggaggagatggtgcaggaggagatggcggagccggaggagatggtgcacgagacgccgcttatcgcccaggaaggatgatgtaccgcttgcgccatagtatgatggcgtggcttgtgtctcgtagatgcgtctcaccgtctcctcctgggtagtccaactcgaggtcctcgtacgcggcttccaccaactcaactacgaccctcgagtatcctgctggaatcggcttgcagtggtaagtcctggaagggtctgttgggatgaccattcccgacgccaccttcacgtgatgagaggttatctattaataatcaacctaagcagcacttgcggaatgtacaagtcaaaaatcatcaaactacgagtataccttgattgataagttcttgaagggaatatgcagctcacatggtgtccgttgc

SEQ ID NO: 68092 - DNA, 1932 bp, Oryza sativa
tgctgagctcgtagcttgataccctgtactcaagatctgcaatcttcgcatcggtatctctcttgctcctcatccgactcctgtacgtgtggatgtcctccttaaatccaatcttccagggaatcatgcctttccctcgtgttcgtcctggatgctcgggagtctgtagggcgagtgacagctcatccttctctctgtcgggtcggaatgtgccctgagaagaggctaccactgcgtccgttagtcgactggcagcctcgcgtatctgatcgctaaagacaagggagccatcaactgggttaagcgttccaccgtgagcatagtaccaaaacttcgatcgatccggccatttagcggtggccggttcgatacccctctcaatcaaacttgcctccatctcctcccacttcggcattgcgacgctatatccgcctgaccccaagtggtgatggtacttcttcttggcggcattgtctttgtttctagccatcatcgcttgccattgttgccctgtcttgtaagcaacgaactcgtcccaatgatcccttagctttgggaatacgtcgaagttcggtgttagtcccttcaggatgtatttcttgtagagatctcccttgaagctctggaactgttctgccattttcttcagagtccagtgtttcactatgttctccgtacccgcgggtagcgtgaacatctcgagcattgtggtccacagcatctctttctctgagtctgggacaaagctatcattatccccgcgtgcccatgttctgcgccagtacaccgtgctgacaggcacgttgtccctcacaacccaaccgttgtggcgtacaaaattcttggctgcttctgccggggcactaggtcggccgtcttcgtccacctcagttatgatgtgccgaccctctatcttcttcgcggcacctcgttgtccgcgtgccctcttctgtccagcggagggatgacttccactagcctcctcctcatcgttcccctcctcgttcccctccgcatccctctctacgttcccctcctcgttcaaatactggtttagatcgtcgttcccctcttcttcgttccagaactggctgcttccctctatgattgtatcgtatagtatctgttcctcatcgcaatcagccatctgtgcatacaaaaaatatttgttaggtatataggatgtatttgctaaccgtaatattaaaactctgctaatcttatattaaatctctaataatcttatattaaatggctactaatctcatattaaaattgtaatactcatatatatatatatatatatatatatatatatatatatatatatatatatatatatatatatatgctaagtctaacaatcttatattaaatctctaataatcttatattaaaattgtaataatcatatatgctaagtctaacaatcttatattaaatcgctactaatctcatattaaaattgtaataatcatatatgtatgctaagtataacaatcttatattaaatcgctactaatcttatattaaatctctactaatctcatattaaatcgctactaatcttatattaaaattgtaataatcatatatatatatatatatatatatatatgctaagtctaacaatcttatattaaatcgctaacaatcatatatgctaagtctaacaaacttatattaaatcgataacaatcttatattaaaattgtaataatcatatatgctaagtctaacaatcttatattaaatatctaacaatcacttctttacatcacttgcctgcgcgaattacttcgatggctagctaccaattcggcttgagggacgacgacgacgtcttctctgcaacattaccaggaaaatgtattactctaaacgggccaagttacatatataatcatatatgtattaccaataaaatgtatt

SEQ ID NO: 68093 - DNA, 1585 bp, Oryza sativa
ccggcccggcagcgtgcgggtgcggcggcggcgtgccacggcgacggcgtgggggcccagcggcgtgcgggcgcggcggcggcgtcggggcccggcggcgtgggggcgcggcggcggcgtggcaagctcgaggcggtggcgacggagtggcagtggcgacggcgtggcgttgcggtggcggcggagtggcagtggcgacggcgtggcgtcgcggtggcgtggcgtagcggcccggcggcgtggcgtggcggcgtggcgagcttgaggcgggggcggcggagtggcagtggcgacgatgtcgtcggcggcggcagccgcgtcgaagtcggtcatcggccgtggagagagagagagatatcgagatcgagatcgagagagagaggcagcggcggctctcacccaagagatgcggcggcggcgtctgcggcggaggcggcgaggaccgccaagcgatggcgagagacgacggcggtgtcggcgtggggttgccctaggcacggtggaggcgaaggagaagccgagatcgaaaaacgtctaagtgttggtggagaagacgagggcacaccgggaatatatataccctcggatctttagtcccggttggtgagaacaaccgggagtaaaaatatctttactcccggttcgtaacaacaaccgggactaaattctacgcagaattcaatgacctcctcttttccataccccttggcgatgcttgcctctggacgagcacggttacaaacatacttcttcagaacgcccatgtacctctcgaaaggaaacatgttgtgtaggtacataggacagagaataccgatctctttgacaaggtgacaaagcagatgcgtcattatattgaaaaatgaaggtggaaatatcaactcaaagctgacaagacattgcaccacatcattctgcagggcttctaatctatcaggatcgatgaccttctgcgaaattgcgttcatgaaagcacgtagctttgttattgttgcccggacattgtctgggaggatatcccttattacaactggtagcagctgtgtcatcaacacgtgacagtcatgagactttagatttgtgaacttcttctccttcgtgcttattatttgctttatatttgtggagtatccagacggtaccttgatgctctccaagcattcaaacatactttacttctctgccttgctaatagtgtagctggctggactcaagtaatggcttcctttctcctttggttccgggtgaaggtcaccgcgttgttccatatgcttcagatcattacgtgcttccagtgtatctttcaactttccatatacacctaggaagccaagaaggttcacgcaaagattcttagtgaggtgcatcacgtcgattgcgtggcgaacgtccaagaattcccaatagggtaactcccaaaatatagagttctttttccacatcaccgcgtgaccatcttcgctctctataggctggctgccaggccctttccaaacactactttaagatctttaaccataccaaacactgttttcccgctgcgatgtttaggcttcgtacggtggtccgccttatgttcaaagtg

SEQ ID NO: 68094 - DNA, 867 bp, Oryza sativa
gaaacattatttatcccaatagtgtgctaatgtttctaagcatggctaagcaattatgtctaacatctagctgaaccaatatataaagctcaactagtcaaattatcacccaaggtataaagaatagagtaaggaatgcaaagtgctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgat

SEQ ID NO: 68095 - DNA, 19322 bp, Oryza sativa
taacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgcaaagtggtcataacaaaggaataggttcacaccacccggtgacattccaaaataaatgcacagttgaaataaatagagaattttaatataggatcaacatgctcaaaggaattgtgtttgggatctgtgtgacttgccttgcaataatcggtcttcaattagtcttcttgaacacttccgacgcactcatgaaccttcgcaacgacggaaacgacaagctatcacgcaaaacaaggaaaaagactaataaaaaccaaataaacaatacatataaagtaaacaaacatgtagatcatgattttagatgaatttagagacttgaacgacctcattccgatttcatatgaattaattacaaatttttacaagattaaattccaattaaacctattaaaggaaagactattccaaattaattaaacaatttacaaatgatttataactgagataaaagattaaaacaacctccggaaaagattagattatattcggtagatgacatatattaaaaagaaataatatgccactgaaaagagagaacggatttatatcaattttggacggctaagattaatcttgaccgagagttgaccaagatcggatggcttagattgatctggcaagcgagcctcatgagatatcgactcaacgagtcaattctacgtgacacgggatcacccaaatgatcaaccgaaaccggcgaatggaatcggcggctctgaaaggctctaaactaaaggacgactccacacggatgaatgaacgaaacacggggacacctcgttcgaacgaacgagcgaacgactccacaacggctgcgactaaaccggtgggctagacagggttcacggtaaagccccggtacggcaaacgataggccgataggaacctaggaatgcacctacggctagacaacttggctactgagcaacggctaaagcggcggctaggttaaagcggcacaaagctgcgacacggcggcactagggcgacttggtttggctaggcggctagcacaacggtggcgacaagcaacaatggcacaactggtagcgacggtgcacaaggtagccggcaaatgacgcggcagcggctgcgctagggttagagcaacagcagcggcgacatgaccgagggattgaaacctaacccgaggggtcacggatagaagactcaccaaaccaaagcggtcggagagagatagatgacgacggtgaaccggcggcaacacatggagaccacggcaacgctagatagacaacggattagattgaattaagaccctagggaaaaactcacaggtgaacggcatgggagcggcgattgccagcgaaccacggcacaataacgcaaacggagggcaccgggagcgagaggggatcaaagtgacccttaccaccacttacgcgacgacgaacggcaacgaaagatggccggcgacgagcttcgaagggcggcgaggtactgtccacggaggcgacgactttccggcgatatgcggcgacaatggaggggtggccgggcttcacttcgcagctgcgaatccatggaggcagcggtgaagcttggcgatgacgggaggagcagcagggcttcgccggagatcaaaacgcgacggcgagcttcgggttgacggcgacaatggagctccggtggatttcggcttcggggagatggctgccgggcttcttctcactgctgcgatgccgacagtggatacggcgaggtctggcgaccacggagtcgacggcaaagcttcgccggagatcaaaacatggcaacggttcggccttcacggtgacggcgacttccggcggggttcggcgcaaaagaacaggtggccggggtagagctcttcactgcgaagccgagggaggtggcggcgctgaccggaaacggccggggcgacggcgaatggcggctggagcggcggccggaggtggagagagagggagagcgcggggagagcgattccggcgacggcggaagatgggacttgaggggataggtagaggacgactagggggtcctttatataggcacgggagctcgggatcaagcccacaatgacgggaaaaactcgggaaagtctagggttctcgccggaaaaaggaaggatttgatccgcgaaattggaaagaatttccatagaaaattttggggatttcttggggaaaaggaagagaagattgaggggatttcattcccgcaactaatttggaaagaggagcaacggggaggtcggattggtgggaggaggcggcggcactgtgcacgagcacggctggctcggctctgtctggaggaggaagatggagtactgtagcgccagggaggtaaatcagacttttttgccggctgagaggagaggagggaataggagggaatgggctgaattcggcccaagctgaggaggagaatttttattacttttccaaataaattaaccaatgagatgatctttcaattgttaaaaatactttcaatgctcaaataattccaagaaaaatcttgaacatacttggacactcaaagtatttaaaaatattaaaaccagaccatttaatgattaatttattaattaaataattactgaaatattctttgtattattaaaattaggaattgagctctgaaaaatccgagaaaatttcagagagtataattaatcatggagaatttaataaaaattaaatccaaccatgctttatatttaggaaattttatttcccacatttaacttcacttgtaaattaatgaacatttaatataaattcttttaataatttattaaattatttataaatcctgaaacgaaaatcaggctgtgacacatactatgtttacatatttatccgactttgttacttgaaatagataactcattattggttaatgaatatgtgattctttcatgagactctttatgttgtgtgttgctatttctaaaggatccctgatcaaatatcatatatagaataaatatgtttagatgatcagcacatgtattaattgatgatcatgtctcatgaatcatggtatagagataccaaattaataatatggacacatgttggtgaacatgttgttggatagacccaacatgagacactgcaagagccatatgtgttgtgtcatcagtgatctcatttagtgttggtattgaatccttagacctaagattatcatggttcccaacatgtgtagtagcttacttagggactgctaaacgttactccgtaattgggtagttataaaagtagttttcgggtatgctatgaaacatgtagtaggatatgaataatcaagatgagatttgcccctcctatggagagatatctctgggcccctcgatgttgtagattatggaagtgcatggccatgccaaaggtgattgagtagtcaatcacaagttatataatctatcaacaggttcgagtgaatgattgagctattagaggatggcacatatctagccttgagcttaatcgatatcgtgaggcaaaggggttcatataagtatacactagaggttcagccgatatgatctttgtgtatgcccggtaggtcaaaacgttctgctaggggccgctgttgacgcgtggaccgaaaaggagttttcgggttacagctgagtgtacatgaacctacagggtcgcacgcttaatgggccggaataagggcattggatggagattcaatatgagcttaattcggatagggatccgaataggagttctacgggccttggtggcccgggtgatggatcctatatattcgtgaggggtgtgaccggcggaggcattgcatcacgtgagaaaccctagccgtcacttccctccccgagcaaaaccctagccgcgcgcggatgctagcacatctgcgcgtggcgttccgtccctgtacgtgtggataccggtagaggcaccgctggtttgcggtgctaatcaacgtgggagtacggcgaggagaacgcatgaggaggagaaggtcgagccggtgcgatcgactacttcctctacatcgacgcgctctacttcgcgagaattctttcgacttctcagcgtcttcttccgctgcgcagcgcgtcgagtggtaacgatctatgatctaatacttgcatggttcctggtttacgcgatagaaaattttgatttatgttatcgtagcctatgcgtatcccaacaaaaccaagggacagttggcaaacaatagtttaatattgcaaaaatcaacaccattggattataattcagaatacacttaacaagtaggcaacagcttcaaactacagcagcaaaacaagtactctgttcctccaacatatggatggtgaccttgggtaaatgtcccagagattcaacacttcagcggatacatataagatatcttctactatttttttcttacaatatacaccacactttctaaattttaaagaattacactataaccataactcttatgcagcttgcaaggaagatttccagaagtaaaacatgtccaggtaaatattcgtgaagatccaaaaccagtaccagcaaatgaagtactccctccgtcccaaaaaaagcccatcccatactaggttgggtttttttttttgggacgaaaggagtacaacacaagataattgggatgtttgtccctttgaacagaaggtaaaacatctaaattcattaccacgtcactcctctctttgcaatcaacattttaaagtttaataaaccatctctactagtattcgttaactttcaggcacccagattccttcgtactgtgaccttgacaacattctcaacacaaatatagtggttcctctctttttgaaagtgcagccataattcagtgcgctacggttcagctttcggatgcaaggcacatccacaatgggtgtgtttggttgcctgcatttagcttggcttgcatatgtgtatgcaatttttggttgtttggttgcctagttgagtgtaaacactcgattcgagcttcacaactcagtttagcccactagatgcagcagcctgcatccatacatgcaaggttcgcacctgcgcatacaaggggcgagcaatgccacgatggggtcaatttgctctttcctcatttctccccctaaaacaaaaaaactagggtttggtgctcattgtcttcctcctctctttgccattgccggtgccagcttcctcgcctaccactgtcggccctccttcttgagctccggtgagctagatctggcaaccacgaggtcagatgaccgcacaaacaattgggctcctcatcatcgctgcctctccacttcttaccaccaagaggagaggacgaggaggaagacgccaccgtgagatctggcgacaacgagctcgctggccaaagatctggtggctccgagctcgtctccatcaatgtgattccatagaaaatagaacaaagtgtgttcaatcataactccattttattatatattcacctacctatacatcgaccattattaacaacatctatagataaacagttaattcatattgctcatgcaaaccactttcactttcactttcaagtgcaatttttcactttactttttcaaaaatattatgattgagtctatgttagttacattttctttcataaaaagagatactaatataactatatataatgcagatacaagatatgtgtcatgggaatcgacaactcagcttagcttgaatttgttctattttgtgatgttgcaaccaactcattaccaaacctagagaatcaatcaggctaatgtatcctcaacctgagcttttagatggcattttggtcctgatcttttggcctaatgccagtagttttgccggcaatggattggtccacgtggcataaggattttggctgccctctgcaacattgtgcgccctcccctgcatccgcctatgatccaccaacgagtgcctcactcacgaggagtcgagggtctggctcgtagagcaggtacaataatgtgatgttgaaagagagagaaaatgacattcatattgacaacaacatgctaattccaaccaaagaactccactgaaccaaggtttactctcctctgatgtgaaagattatgcactctaaaaatctgatcacactgttcttcccaataaagataagcatctagaacatcctttccagtaaactttggaacactcaactttacccgagcaacattatccaggtcatcatgatcatggcgaccacgatggtggcctccattgccaaggaccgcacctcggcgaggatgaacatgccgccgctacaaattgttctctgaaaaaaaatcatcattatatatcaccatattcctcctcatggtgatgatcatggggctcaaaacaaccgccaaagtgcgcacgggagccaaatcctcgcccgtgagcacctccttctcgtgctctagtacctccaccattggacggaccatggagtctgtcatcggcatcatcatcaaccgaatgtgcatccacaactcatcctcgggatcaacaagcggtggctgaaccaccccaccactggcagccggaaggcgtgcattcagcaaccgttccatcacttgaagaatattattccccatttgcaacacctcagcccatgtggcaggtgcatctggttcgtcatgattttcaccatggcaacttgattgagaacctgccatgttagctccaaaaatatatatagtggaataggtaaatttgtcttctagataagcttcctttaattgattaatgtccttaaccgaatccactaagaatctgactactggggactgattaatttcccttgcccaatttccggactctaaagccaatactaactctaggtcgatgatgacttcgggcttaccaaagtgttaacaaacggctagaccgctggcagctctagtacgaccgagctacctcattcagatcggtgtcagctctggcttgtctggaccgtcgagccatggcatccctgccggctccatgggtgcccggtcagaccaagctcagcctgatcatactgaccaagagcctccggtcagactgacacacaagccgcgatgaaaccggtatgtcccaatcggtcaaactagctacggtcccacaaaatgaaatagatttgaatcaaaccaaacaccctcatacatatgacctaatgtagcattttttatcatttcttcacctaggttaccacctctcttgataatacgtcaaagctagaagaaaacctaccaaatttgactgctcaataccttgattgataaaaaagaaaatttagatttatcacctttatctcattgctttgcatcatcaattttaattcgtggtagctgtccttcatatgcacattatgtggtactaactcaaaatatctcattcaaataaaatagttagttcataattagcatttgtcattaattaccaaaataaacgtcgtgggcttatatgctataagctagttaagtattgcatggtgaacttaatggtggcaagtggtatactagctagtggagggttgcatggtaaaactaatgctaatactacctccattccaaaataagtttaaatttcatccatcacacacataccaatacaaaagcaaaaaagactagaataccatcaaatgccaatgcaactattcatcactttatctactccgaatacatttattccctacttttacaaactcttactcttaaaatgaacttattttgggacaaatagatggagctaaaaatgaacttaatatgggatggaggaagtaggtgacaaggtagcatgctagttagagcattcccagcagcacatccaaatttcatcctccttatgcccatatggatgagcatccaaaaaagattcctcctttatatccatcccacttcaacagatcatccatatcgcaccctcctatattttagtaatatctttcaattaactttacatttgtatttttaagggctatattttgaatgactaaatttcaatggtgttatttaccgtgataatctttcgaatgagtaaattttaacgcatattttttaatgggtaattttattttctaccaatgctctgccctttcctctgttcaattccaacccatattcctctttttctctccttttctctatccttctctatcgttctgtactcttttttttttcctctcttctatcctgtccagactactccggaggcgtcgaccggcaggagcggatgtgcgcatgcggcggcagtgcggcgggaagccgtggaagcggcggcggaggctagcgggcgtggagccgagcaggtgacagcgccgaatgctcaggcgggcaggcaacgtaggcggccggtgggcgtataagtgaaggtggtggccgcggagaaaggaagtgacagcggtggccgacgggcgtggagccacacaggcgacgatggcggatgctgaggcagcgagcgcgcaggcggctggcagactcataagtggtggcttgtggcttgcgacggctcggcgttggcaacttgcggccggcatggcagcgacgacgacgacggagaggaggttgtgatggatgtccggatgggggcgggagctcgatccagatgcaggcgttcatatatggcgtgaggagagagaatcgctatatttggctaaaatatgctcgctttggcgcattgtgacatatttggcaggttagatgtcgtatctgttggaagcccattttcacctccagtatgccatattttgggtggaggaccggatggaggatctcctagggatgctcttagtgggctattgcattcaatttcttggaatggagtaaggcaataatgactatttttattgatcttaaggccaactcactttgctctatcttaacaactccacacatacaaaatatttccattaatatagtacatatggagaaaaagtaatcatcgacacccatgacggtgtcctcgtcgtattcggaattaatttttgaaagcacgtgtagagatttgaagttttacctacacttcagtcaccctttgaaacatagaatagaaaaactcatgaatagaagtaacatgtttttacaatcctatagaatttaaaaacacaggagaagtttgttaattgcaagcagtaaagattgatgttggtggctgttaaatgtcgattctatactgagccatcagaaactggaacatggactttgagggagcaggagaatggagaaaaatgaaaatcgctgaacttgaagaatggatagagaaggcttatcacaatgcgaagatatacaaagaaaggatgaagcactggcatgacaaaaggataaaaatcaagaaattcaagccaggagacaaagtgctaatgttcaactccagggttaagctttttggccacgaaaaattgcgcagtaaatgggaaggaccgttcgacgtcatcgacacctcttcgcacggggcaatcacactccgcgacaactcaggtaacatatttaaggtaaacggtcaacgcttaaagattttccttgaaccaaatgaaactttagatgaagaagtggatgttattgaattaatcgattatgaaccatgatgatctcatctagtgcatgcttaaaaccctgtatagttgtcatttctgcgcttagcttaggaattagtgggcctaggacgagaagtggaggcctgccagatccaccagggttcgttcggccgaaccagggcggcgcccgttcggccccattttcgaatagcaatctcccccgctcgtctatagtctgttgtgatgcgctttcggaggtggatcagtcgcatccaaccagagcacctgttcttcctcctccttcccactttgcaaacctcctctccatctcaacccgattcccttgctccatcacctccaattcaccaatggcaggcaaatcactgatcccattcattcgctcttcttccaattccacttacaatctcaccggagagccaacgccgacaaatcaattgattccggtagaagaatacacgatggagggggtaaatgatgtatgggctcaacccctcgcagctgtgccgggctcccctgcaaatctggagcccgacggcgagctccctggttcggccgaaccaggccctctcggccccgttcggccccccgttcggcagtgcgatccctctcccctcgccatgtcacaaggacaaaaatacggggggattcgcctgcgcgacggccgacaacgggagaactcggcttgttgaaggcgcgacgccttttccaagatgacgggaaggccgtgccgcctcccgccgagcgctatgtgggcaccctgttcaccaaggcaggggatgaggtgctccataagtatgtcatacccaccgctactccatccactccaatggaggagcgattccgcatccagggagtgcgaactcccggcggtgggtatggcaagggtttactccggccgttgacggcatcggagaaggaggggcagcggaatcccgtagccctccacctatgaaggtgaagcatcatttgacgccccctccaatagtaagggctcccgaccaatatcaagaagatgaggtgaagttgccagagccctcaatccataagctcgctgcgcaagtgaagaaactccgcaaggagaacatagagcttagggatcgcaacgcggagctaggggtagagcttgctgaaattagaaataatttcgatacccttagttgcggtttgtgcgctaagatcaagcgtgcattcgtagaaatgggaaaggaaaataagtattatgctaattagatgcttcctttcccatgaataaaatagtagtaggtgcttggttttatttttccaatcatgtaagcacttgctataaataatgtggctcattggtgttaaccccaatgttttccaaagtttgttttgtttcatgtttaataaaatttaggttttgaataagtgtgggggagatatcccagcctctgacgtgcatatgctctgaaaattgttgaatctctgaaacacctggaaggcactgaactctgtagaaaattgcagagggatcgggcatcaggttcggccgaaccaaagctggccccaatccctcccaattttcacaggtaagcaggtgagcacgtcttgtatctgtatatctctaccacggtatagtactagagctgaaaattcagaaaacaattggttcaagcataagtgaaagataaaatttccaactaatgaaattcttcatgtgattgatcttgtatattcattattctcagctgaacttgtgcttgtgaacaaccatccatgtttagggaaccttatgcatctaagtaattgctttatgtgagatgattcaagatgaagggaatccttgcaactcttgttatgactctttggaatttgttttcaaaataaaattgttttaaaagctcaatcctccaattgacttcatcttatacctaccaaggccatatgcaagtatatcattgatgaaccttgttatgcatatgactgcttgacattatattgagctttgtcgaatttatgagactcgtgttagatatctttcatattctcatgatcaaggggtcattaccatttccatctttttccacatatatataattaagctaagcttctacactggaagttggctttccaccgaaaaaattccatttaaataaactcctatattagactatgctttcttctcctggaaaagttcttggcaaaaagaaaaaaaatgggaggaaaggcatggctataaaaaagggggggggaggaaataaaagtttgctcccaaaacattgagcaatgttggaaagaaaatatagccatgccccttccatgatcatgccaagagaaccaaatggagaggaagtataggaaaaggggagaatcattttttttaattccaccattccacaaaagattttaccttttcattttccatccacaaataaagaccctgatctaggagtatgactgatgatcttcttgagtccatatttttggctttgcaatatatatgatgcaggtatgccccgatttatccctaccaagctccacatatcagccttagaatagggatgaattatggcacatttttccttggtaagaatccaaaaagaaaatatacatctgtgagaaacaagagggaaagtcaatatgaggaaaagagctggtttgtgaaaattcataaaaaaaatcccatgagtttgacggagaagcaagaaggattggaatcgagatcattccatttgtcaattacttaagatggtaagatagccactgataaagttcacaggtgcaggtatggttgtgaatgatttatatgcttgattcatatcttgaagaaattcattatgcactaacctttactcagggacgagcaaaggactaagtgtggggggttttgttggcggctgttaaatgccgattctataccgccaacatctgcataaagttcggataataaaatatccaacatagtgataggtgcttaatctcacatattccacagtgttggtgtatatttgtatgcaggtgataaactccgatgttgagaggaaatctagactaaagtgaggagaaatatgtatccatacaaggatgggttgtgaacttcgtagaaacaccagagaatcagcccaaaacacctaagaatggataaaggaggatcagaggaggagccaggccaaaggccaggccaggggggcccagcccaggttcggacgaaccctggtgatcaccattgatcccaggttttggcatggacgtcccagatcactccctgatggcggttgcggggcacttcggacattgccccttcgatcatcatacctacccctatataaggacatcatctcactcactttaacacacacttccaagcttgagctgaattataagaggctctattgtactatattatatactagaataggaagagagtagagtagaaggagtcggaagaaattcggagttgtcggtaatcttctcctattccttttattctgtttattactctgaattcaatataatattcttcttgagtaatttagatttattttgtgagaattatctcttggttagttcctaaatagcatacgggattattgttcactataatcaactaaaatatagtgattgctttggtgagttataaacactaaagtagatagtaattgcttagacgtggtgtttaggtaattgttatccagtaattgttgcatatcccacagtacgtttgaggtgggtgtagaggtggttacagccctcaagatcacttaagtccttcctgtccgggtacgtagtagagcgacatctgggaacagtgggttgccagtgcatgaagtatagcattaggattaaagttaagctttccctagacactgtttctcactagtaaatcctctctatcctggcatatcatttgcttggtgtccttggatgaaccggaggaagatctgaccacacacgttcccttatattcgatacccttggaatactccgtaggggaagtgctacatcggtatacccgtgcgcttgcggattttgtctgtgatcgtaaaaaataccaacaattgaaccaaaggaaaattttcaataggcttttatcttttacttatttttctatgaaattgacgataggatacaatcataaagaaaatctcatatatcttctttccataattaagagaaatcatttgctagccctcataattattaagcttgcctcgctgaaaaaactaaatctttatactgtgcatatctcaggacggtcatgttgaagctcgcatcactgaaaaatactttaaaagaagtcatctgtccaatagtgcctccattaactagcaaccacaccatcattgtgaaatggggagttactaggagtgatgttgtacacctggtcagcatcggcccacctgtcagtccccaccatgtggcgctatcccctcggccacctagctacctactactccctccgtctcataatataaggtcacatcccaccaaaatctgttacattatggatggaaccctatctagatttatagtgttaggatgtgtcaaccaaaattcttatattatgagacggagggagtagcaggcatgtcatggcagcaaattccgtttttctctcctttccttagcccggaaattcacaccaacgcccctacaaccctagcgcagcagggggagggccacctccaggtgggccctgcacccgcgcgacgtcagcgtagcgggtggcaattggccctgctctccgaaacggagattccccctgctacaagaatcgccacggtttccattccacccaccagcgagtacccacacacgtgacaggcacgcatgcgctctcggtctcggtctcggtctctgcccctcacgcgctctgcccccggcgccgcggccacgccatggctgccgccgcggactccggctccccccccttccctccctcccctctcgctctcttctctggtggcggagtccccggtcgggttattattatgcgctggttccggtttttttttcttttcttcgccatttctgcaggggcggaggaggggtggggggactttttggggggttggagattgtggtacattgcgttgttgggcgaggacttggccgtggccacgattcgtcgttcatgggggatgcttgggatttagggttttggtttgggtttcgagtggggatgaaattcctttcattttgagggggctttcttctccgttcgctattcgtcgcgtaaggcgcttttgtgtggttcgggcttttctcggtgataatatgtggatggtaatgttggctcgcgtccgttggtcgaaatctcctgtgatctttttttggatcgtgatgtcatgcattaagcacctgtacatgtacacctcgatttgagtagaacaaggtctgtattgtgcttggaaatggtcgggaagagtgatttcctagccgtgctcctcggaaacaaactatttatgacatttgagggcttttcctatgaggaagaagaagtgcttgttctactcctacctcatttgtttgcttgcttgcttgcttgcttgtttgtttgtttgagtgaactaggttctggattggagcttttttgctttgctttggagcctgcataatgtttctaaaacgctgactgcagaggatctcaatccagcggtggggggcacactgagagttatgtcgtgatttgagattctcatggcgtacaagggaggtgtttgttgagagaaaataaccattctaccatcatcgaaacggagattcgctaaaataccactccgcatttgggattcaccagaatgccgctctcaagtgtggggctttaaatgccattaacttccattttttagaactaaaaattgtttcgtcgcttctctcctatgtttaatgaccaaaatacccccgattgaatccatcaaaattcctcattcttctttcctactcgagcaggagcagcggcctgggagttaacttccatttttgagaactaaaaattgtttcgtcccttctctcctatgtttaatgaccaaaataccccagattgaatccatccaaattccccattcttctttcctactcgagtaggagcagcggtctgggagctagggttggccccgtgccaccttgccgttgccgctcctcttctcgcggcgtccccgacccccgtccctacgcgccaccgccgctcctcttctcactccgccgccgtgccagtactcttcttctcgtgccaccctgttgctggcccacctctccactgccaccgtccctcccctcttgtcgctcgtcaactgctcccacgcgctcttcctagatgtgtgagctcccacttgattggattcaatcgggggtattttggtcagtaaacataggagggaaaggacaaaataatttgtagttctcaaaaatggaagttaatggcatttcggcgaagccccacacttgagtggcattgtggcgaatcccaaatgcggagtggcattttagtgaatccccgttttgatgatggtagaatggcaattttctcgtttgttgatggcacttgggaagtgggcgtttgcagatggtgcatataaagaggagtatatttcacaatactcttttagtttattatgccaaaccatggtgatttatgattaatgacatctatatactctaaactattcgaccctacgaatttcaattcatactaattttcttgtcatgttgagccatatcatcctgaatcatcatggttattggatagttgttctgtgtctgagatttgcaaccagatcagaccagccgctctattcacatatcgagctcttatgtgatacttgccttatgtgcttgttgatgttgtttcagtattgttcgctattatattatagaacatcctaaataactttctgttctaaaattaagagttgtgcattaagctgaccattcttcttgacatttgcacagtttcaatgttttgcagactgaggggctattcaagcatcatttggtttccttcccaaccaaaacctgttctttcatggacctaatctgttgttttctcttattataacttgataccccaaaccacaaccaacatctcctctgatttaatcaatctgctgtctttgtaggaatgtattaccgcaggcaaaggaaggcttcttctgaggccaacgccaatgtgtttatgcctgggggtccaaatggtatctcatttcctgcatcaaatagggctcatgattggggatatggcggtgttggcgaagaatgggaaactagttatgctcgcaaactccagttgatgaattttctttctgcactgcatcaacgcgctgcaaattctttggtaaccactagaatggatgcaaaaacagaaggacagctcagcaataatagttcttgattccgatgatgaggacgaatacacggaaggatgtgaacagctcacatctgagaacaataaagaacaggcaccatctggacccactagtccttacacgacatggattgtatccagcacgaaagaccaagtaaatggaaccttgcatgttgatggagtccaaagcactcaaattgttccatatggtcaaaatgcaccgttaataaatcagttccctttgcaaaccagctggcaaccatctatccaatatgaaagggttatattgcagaaaagacctgaggagcaacgcgttcaagatctggtggtatgtatctttcacttgaaatttttcaatggactatccacttcgacatattggtacttttactccattacatacctgcactgataaaccaatttattgcatcatgtcttgtgattgtattttgataaatctgaagagcattatgatatttcttgtctggaatgttagaatggaaatgtttgatgtttgttgaatctatactcttttgaagcttaaatatcccatatttgaactttaactcttgttgctcactgtaggcagcaagccatgcagagaagatagcagaaacacaagttctccttactcttcctactcttcctactgagagaaaacgaaggaaaacagaacccaccaccctggtagatgttgatggtggaactaacctaggaaaaagaaaaaggaaaaatcatcaaaatcaagcagcagttgattcaaacttggatttgcaacaaaatgatgttccttcacaaagctacaggactatgatagaagaggagaaacctgtaaaagaaagtgaaggtctcgaggatctttggaaagatttttcattggctgctgatgtacaaaggtacaagttgtaatcacagatgttttttttttacttttattctgcagcattataaaattgttggttctttttccatctgactgctaattgtactcgtaaatacatgctataatctttattttttgtttcaagattgaataccactgtgcacaaagtaagtttcatggcaaagtgtattttataagataagatagagtttgaaaaggcattcatttgtcaaatcatttaaatatgtgtattatgacaaagttttgaagcatttcaattgattatttctatctgatttgtgtctttttccaataaagctcacgtaatattctttgtccagcttgatacaaatgaagacatgtccaatgaaaaagatgtggatgatgaaaatgagatggatgatgactgcaatcatgacattcggattcatgaagatctaggccacgtatgccgtatttgtggcatgattgttagaaaggctgaaacaataattgattatcagtggaaaaaggtgcgtaccatgtttaggacatgtgattcttcaaagttttcaaaactgtgatgtctatgattctagttttactttgaggaaattataagcagacaaccaactttgggaattgttttttcataaagaaactgcaagttaattatttacatgaaacccctcatgtcccatacagcgtcaacttttaaagccccaagcgttagatctggttatacttgacactacacaccaagagggtctagtatatgaatgttcgctattggacagtcacgcgaacggttccgacaaccttcgtcttactcgtacgtctaaccacgcctgcatgcaaatatctgttactaatacgtgttcacatgagagttgctctaagcctgccttttcaaagaccaagtccacctatgcttatgttatttgattttcctagaatcgtacacatgttcaacgtatgacgtatgtcaacagtaaatgttggttctgttaacagtgaaatttggtaatcggcaaaaacatcatcggcttagaatcattattggctgcagcatctcggaattagccgatgggagttatcaagtcaccaatagttggattcctgctatattcggttaaggaaatcaatctactaaagaaagcttatccctaagtgaccgagtttaaagaggatgcggcatggtagtttatctattaattaggaatagtttgttagtttccttttatctttaggaaagtgtgtttagtgtccgataaggacattatattttccttttatctttaggttagtttctttcttgtccgataaggacttatatcaacccctgggtataaatat

SEQ ID NO: 68096 - DNA, 7669 bp, Oryza sativa
cttgcagaaactccggattgaacgaggagtctgccatgggtgtggtcacttggattttctccatggaaattgctagccaagatgttttctgtatgtgtagttgttatgatgagaagggagtgatttatagccttgaacttgataaacacaaggtctttgctacctcaatccaagccaagaaaatgaatgcaatggtccactagctagcatgacatctgtcaccattaattttaccctgcaaccctccactaactggtatgccacctgtcattattaatttcaccatataacacaccactgactaatatgccacctgtcaatattcatttcaccatacaacccaccattagctggtccaatcagcacaaatgtcaccagtcctccactatatggtatgccacctatcaacattaatgccacgaaccctccactatatgatatgccacctgttatcattaatttcaccatataaccctccactagatgatatgacacatgtcatcattaatttcaccatgcaaccctccactaacttgtatgccacctgtcaccattaattgcaccatacaacccatcactggttgtatgccacctgtcatcattaatttcaccaaccctccactatatgatataccacctggcagcattaattttaccaaccctctaccttatggtatgccacctatcatcattaatttcaccaacctttagggatggcaatggggcgtgttgagggcaagttggaccagaacaccctagtagggttgtcaacgagccgagctcgagcgagcctgcttatctaggctcgagtttggaatagacttgaaccgagcctcatcatgtctcgatctttatgttaggctcgtattcggctcgttcgaactttgagcttttcacaagctcggagtattggcatagctatattataggcatgcgagcttgactgtttgaagtggtagtacttagtagcagcgagcttgactgcttgaagtagtagtactactagtactttccttgcaggctttatagcaagtacaatagcaggctataagctagctataaacatattttaaagagataaaggaagaaagagaagagcagcggactacagatctgtagctagctgcagcatggactccaagacgtaatgtgtatatgacagatgggaccatatattaatagtatagtaagcaattattgtatgaattggctattacattggctatagatgatttggagctagtagtagactatactattaaacttgctcttatgggaaagatgatgcaacaatgcactgcaccgatggagaattggagatgcaccctattactgacaagtctaccatgcaactttttgttggaaaatgtgctggatggttggcttcgtggagaaaactagctgttgtgaaaaattaaatgaagataggttcagacttgccgtgagcttgtaacgtgtggcaaagtaacaaggtgtgcttttttaattgtaagtgatcagttgggctcgtcgagccgttcgagctcgactcagtgaggttcgcgagcctcggtgtgagagctcgggcttggctcgtttgatgttctagtcgagcttgaaccgagtctaagacgaatcgagtttaagtagcttgcgagccttgagcttttctgacagcccaacgccccagtacctgacccccgacttcgtcacccggccccagccccgatctccaaattgggggatatttgcccccgtccctagcccttacgggtccccaccccctaccgggtcctcggtggagaagataacaagaagatgaagccaccacgaagctgccatgttagaggagcaccgggtgccgctgttatgatggagggagaggagatcgaagccagttgccggctagctggcaagctggaacgtacacaaggtagcggctaggtggactatcgagaagaggtggacgaaatataacagaagacctcaccagcggtgaactaggggtgcttccggtggcgaggcgagaagcgtcgattccactagcagcgccatatgcgagcagcagtgtcgggagtcaggatggaaaggggccatgtgagaaagcgagaagcggcgaatgtggcatcaggatggaatcacgagcgcatgacggtgtgtgctagtgggagcgaaagggattgagttaaagatatcgagggttacttgaggtgtactttccttgggcctagtgggctttatttgtaatgggctattaagtgtttatcttttgttttgtattttcgaggccccttaggtcacccgggggtaaaactacaaacacgccccaggcctcgctcaagatcagggccccgccctgactgccccacgggtagataatttgacccggccctatccacccctaccaaccctccactgtatgatataccaactgtcagcattaatttcaccaaacctccactttatggtctgccacttatcaccattaatttcaccaattcttcactatattatataccacctgccagcattattttcaccaacccttcacaatatgatataccatctgccaatactaatttcacctccactttatgatatacaactttcaaccattaatttcactaatcctccgttgtatgatatacaacctgtcagcattaatttcaccaaccctttactatattatacgccacctgtctccattaatttcataatgcaatcctccactatatgatataccacctgtcagcattaatttcaccaaccctccactttatggtatgccacttgtcatcattaatttcaccaaccctccattatatgatataccacttgctagcattaatttcaccaaccctccactttatggtatgccatttatcaccattcatttcaccaatcctccactgtatgatatacgatctgtctgcattaatttcaccaaccctccactatatggtacgccacctgtctacattaatttcataatgcaaccctccattagatgatatgccacctgtcactatgcaaccctctaccagctagtatgtcacatgtcaccaccatggaaccctccatatatggtatgccacctgtcacagttaattttcaccagccttcctctatatggtatgtcatctatgactattaatcattttggcaaaatttgctacatgacataaaaaaacgtgtaattagctaggagaccgtaagaacacgtatttgttttagggcatcacaaaaaaatagtaattagctcctggacacctccaacattattttattattttcggaggaataggagagagaaatagttgtgtaagtacggttctataagagagagaaatagctgctatgtaagtacggttctacccttcgaatttttttcattttctttattctttcttattcttttctctctttctctctctactatatcttcaagtgagcccgagggcagtggcggaggacgagaaaaaaataggcaaattttgctacaggacactgtgacttcgcggttttagctgtaggacaccgcacgaagtgacttttggggaagacaccttataaacgtggtaatttgcttccgcggcagcgctggccgtggcctgcttccggtggtggtagtgggttcaggacgacggcggccacgtggctaactggctatggtggcgcccttgtccctccagtccagggagtccggaagagcctcgacgccggcaatttaatcgagattcgctagatgtttctctctcgtggcaagaagatggagaatcaacagaactccaaaattaacagctcataggcttaccaatgaacaatctttcccaaatttaatgagcacaacgatgagaacagggtattagcagcctaattaaacagcaacagtgccacatgatacattcatcaggatccaccggaggcggcagggcgtcgacgacgaggccgcgcatgccggccttgagctcgttgtcgcagaacctgcggtactcggcggtgtcgccggccttcttgcacacctggaccatgacgagctcccgcgtgagctcgaacaccttggaggagatggcgagtgcgcccttatgcccgttccgcgtcgcctcgatgctcaccatgccggcgatctcctccagcttggcgatgatgtcggccaccagcgcgccggacatgaagtgcatcctctcgccgcgctcctcaaacagctcagacaggtcgaagctcagcgacgacgcgatgatgtcgaacgcgttcaggctcttgggccgccgcatgcgcggacgctgtcgtggcggtacgcctccccgacgtggcgtcctctgctggcgagcctggtgccgaggtaggtggcgcgaaactcgtcgttggtggcgcggaactcatcgtcccacaggtcgtacgtggcgcgcgcttctgcctccatccgcttcaccatccccagcccccgcacgccgtgctccgtgttgtacctgatgatcgacatgatgtccagcggcgccgccgctgcgggggagcgaaggcgacgaggaggaagcaggccacgaccagcaccgcggcggcggacttgctgccgccacctgcctgagagagaaaaacttgtgggtgagagagagaagagatgggagagctaacacgtggatccaggggtattttcgacatttcactcaatttctctctccccatttaccgaaaattattattttaatgggtgcggtgtccgctagcaaattaccacgtttatatggtgtcttctcccaaaagtatagatggccaaaaggcccaaggcccgacggcccggcccatggcacggtattttggcccggcccaagcacggcacggcccgacggaggtcgggcccgtgctggcccggcccgaccaccgggccgtgcctgagcccctccaccggcacgttgtgctggcccggcccggcaagatgggccgacagctaggcccgatacacaaaaaaaataggggactaaaaatagacatattatatgccatggacgaaagaaaagggacctaaaatagactttttttatctatacatatgtcagccaaagaggagggacagagaatagacttattttagctatacatatgtcagcccaaagaggagggaaggaaaatagacttattttagctatacatatgaaatagcccaaagaggagggatgaaaattagacttattttaaaaaaggcccgataggccacccatgccttcgggccggcacggcacggcccgacaactagtgggccgtgcctgggcgggaggtgcagcccatgagccggcatggcccggcacgaagtgcctattgggccgtgccggcccgatggctgctgggccgtgcccaaccgtgcctgggccgggccgtgccgggcgggccctttggccatctatacccaaaagtcacttcgtgcggtgtcctacagctaaaaccgcgaagtcacagtgtcctgtagcaaaatttgccaaaaaaaaaataaggtgtggcagcaaaaacaacataatactttgtaggtaatatggtatagatttgcaatgtgttcccatgcatatcgctaaaagttcttacaaaagttgttttgatgcaacaaatcatattgatctgtgttaggattcaaaattcccgaatgaaattttccaaattttggaaattttcaaagaaaacttttgaatatagcaaaatctatccaaatttgatcaaaatttgttcaaatttcaaattatttcagaaagatagatattgccaaacatatagattaaaccttgatctgggttacatcatgtaactagcttacagcccatgcttatacaaccagctaatcacaaggagtgaaaagaagatactaggttagttgcttcacgtaactaactacaataacatccaagtcagctaattacaatgaatcattgaatgttaatcatgcaagcatagtctccaccagtggctaatagaattgaggtatggcgagtgccatatctcgccataccggaagctccgccgctgcccgagtgacggagcgtggggctcctcaccgggagactgcgcaggcccccctttgccggttcggccgggggcgctaagtgagattcttcgccctcgatctaaggaacgtcagcgagagaggaagcgcacaagacacgggcgacgtagacaggttcgggccgctgagaagcgtaacaccctactcctgtgttctggtggatctgtgtgtgaaggaatacagagagctcgagagcgagagagaggtcaggctcttctctcccaaaaatcccaaatcccctctctcctaggcctgggcctcctttttatctggtcaggggtcaccacatgggcctctcgctgcctaagaaaggaaacatgctttttacaatgagggctagtctacagccggaagtgacctctgacaagcacagcacacgtcttctgctccgctcgtcagctctcccggtggacgcccgtttcaaccttcattcaatggccagcgactttcttgccatgcttgcgctgaagcctagaatggatctgaccgggactgacataccaactccaggagtcagcacgccagctccagctagagacgagagccaggaagctctcatcattccgacgggacggggcgaggcgtgcgacaggacgcctgttgccacctatcccgcgatctgaccggtctgtgaccggtcacataccgcgactagtcacggaccggataagcatgcgctgcgccgcattgaatgcggcgtggcgcgctcgtctaacccgctataaatgcggttaggtgagcgctgctgtgctcacctaacccacacacgtggcgccaacaccacagggggtcggggcgccccagccctcggggccgaaacgggagcggcccgacccctcggggagacagagggaggggtggccatgtcgccctcgggcccgacccccccgagggggtcaggccacgtgggtgaccgcggctacctaagcctctagtcacgatacccccggccccatgacaccgacagtagcccccggcgttacgccagggcgatcgcctccctcgagggaagcgcccgggcgtgacgccactccttaggcccggtgacaggtggggccggtccctacaggcgagcagaaacccagcggtcgcaaatcgcgcgcatcagcaagggaaaaccgaccaacaataatgagcggcctctttaagaccgctacattactcgagcagcgcgcgaatcgggacgagccggttcgtttcacctggaggcatgatgatggaacaatctaccccgggagggggtcgtgcttctgggccccgcgacgggggcccggggggcagccgccctgccgacgcccgggggaagaggaagcaagagggtacccctcctccatctcctccccgagggggcggggcggtgcgtgccagcagcaggcgcccggagggtgccgtgccgacgccgcagcccgagggggagcgaaagaagaaacggccccgcaagatgggggggattgtgccatgccgggggaacctcatctcacccccgaggtggtcgtttagccgacctccccgcaggttcgtccccgcgcccaccgcggccgtattcattctcccatctcccaaggcgagttttcactcacccgtttctttttgtcttttggtttttcttctgcctcagcgagatcccgtcgcgcccccccccct

SEQ ID NO: 68097 - DNA, 3093 bp, Oryza sativa
gcgggcgaaggagctggacgcgagagcgcacagcggcggggcggccgcgggccagggcgacctagccgcccgcctcgcagccgccgaacacaccatcgccgagccgcagggcgcactggactcgtccgccggggaggtcgaggccctccgcttggcaagcgaggtagggcccggcatgcttcgggatgccgtctcccgtctagaccgtgccgggcggcaggcgggcctctggggcgggcggtacgcgaagtacgccgccaaccaggggggcctcgcccagcgcctctcagagatggccgggaccctcaagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggacggcgcgcgcgcgcaggtccgggacgccgccgaccacatcgtccacagcttcgagggtacggcccctcagctcgcgttcgccctcgactccgacgaggagggcggtgacgatggtgcggacgacagcaacgacgaggccggcgacccgggcgcgtcggagtgagcccccaggcccccgccaatcttaataacttttccttcttcttccgaggccttcgggcccccttcttgtatagactgatttaatctgcaatcaagtaaagaggaaacttctgtgtcagttctatttattgtgtgtatgagacgaggatggtctgtgccgcggtccttctgtgtcttggcttgaacaagggctcgtgcccaggtcccagcctcagacggcgcgggtcggggctagtgcctggggagatccacgtgtcgagactggccaggccgggagcgcggtgaccgagggttatggatgacccgattgtgggcctttgccgattcccccccggagttcaccacgccccggggcacggctcggttctgggccccgtttggcgattttagccggcccgggccaccgagggcagggtcgggcacaagcgtgctaattcaagccaagattcttcaaaaggaaacgatggcacagacacagtcctcaggaaatcgaaaatgcttttattaaaatacggaagagaaaaaaggtaagtatatgcatgtggtagcccccggccaaccctgcacacccgggggggtgcggggttggcccgggcccgagacatgatacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggtgctgatggtagcgccgcaggctctgctggtagcgtgcggctcggagggccgcgcgccgccttcgctcttccaaatagtcgaggtcgtctcggcgaagctgatcttgatcagcctcgcaatacatggtgacccgaggggacctcagggtgagctcagatgggaggaccacctccgcgccgtagacgaggaagaaaggcgttttcccggttgctcggcttggcgtggttcggttcgcccagagcaccgctggcaggccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacgggaggccggcccccgtgcccggaccgaagtggcgctccggacgaggaagcgccctccgttgcgtgggcggcgcgacgagcatcgcgctggcgctcgatatcgaggcgggcatccggccccccacgcacatcttcttgggtcggaggcgttgacgagggaatggcggacggacggcgggtaacggccgccgctcgccgcgccctccgcctcgacgacatggagccggcggcggcagcgccagaggcctcggtggcggaggaccgcccgccggcgcctaggcgctgctgcgccgtcatgaccaagtcggccacgtcatccagccaacgccgggctggagtctctggatcggggacaacgggcgggtgacgcaggagcgcgcccgcagcctggagcgcgccctggggcgtgctgccatcgccgtagacgaggcggcgacgtgccccgtctcgccatcctcccccgtcgcccgcgggcggcgaagtcgcggatcctccgacctccccgagcgcctccccccgcccaagatttcggcgagagggggacggtggggtgcgagcccgacagcgcgggttctgctccccgtcgtcaccgctagcgctcggagagaggctgtgcgccactgcccgttcggccattgggctgagcgggagaagcttggcgcacacgaaagaggacgagggcttcgaaagacacgcgcgccccctacctggcgcgccagatgacggagcgtggggctcctcaccgggagaccgcgtaggcccccctttgccggttcggccgggggcgctaagtgagattcttcgccctcgatctgaggaacgtcagcgagagaggaagcgcacaagacacgggcgacgtagacaggttcgggccgctgagaagcgtaacaccctactcctgtgttctggtggatctgtgtgtgaaggaatacagagagctcgagagcgagagagagttcaggctcttctctcccaaaaatcccaaatcccctctctcctaggcctgggcctcctttttatctggtcaggggtcaccacatgggcctctcgctgcctaagaaaggaaacatgctttttacaatgagggctagtctacagccggaagtgacctctgacaagcacagcacacgtcttctgctccgctcgtcagctctctcggtggacgcccgtttcaaccttcattcaatggccagcgactttct

SEQ ID NO: 68098 - DNA, 3115 bp, Oryza sativa
atacaacacaatctaccaaatctaccaaatatacacagaaatatcacgagcgtagtttcataatttcattcacaaatcataaggcacatttggagtcttggagatggaacaatacctctaactctctgtgaatcgccgcctatgcgctgcaacctcaccgccggccatgcctgtcccctcgccgcacccttgcctgtctcgccggccgccgcaacctcccgcgcctgctttcctgccgcgccctgtgcaccgccgccggcctgccgccctgtgtgccgccgccgccgctaactccgaagggagaggtggagctagagccgccggatgccggaggggagactggagaggaggggaggggagatggtggcttggcggctggcaggcgcaggcgaagccagcgacaccgagatccagaggccagagcgcgcacagccgcctccgcctatttctatctcacgggaggggaggggatgtggggaggagagagactgagactgaggggatgtgcatgggctagggtttagtaacttttttagtgggttgggctttttgggccttctttgatctatattttgaagtttatatgtaccccggggccccgcgggtgaaattagtcccccgtcccctccccgcccaaatgcggggccctgtacctgacgcacccgcgggtcaaaaatcacacccacccctgcccccgtaagggcgggtccctgcaggggacttggccccgcgggggaaattgccatccctacccaacacccactataggtggccaaataggccaagccaccccatgccagccgaggcacgtatgaactgttcatggtcgaggaatgacccagccccgacccgttaggctatgctagcatgtaccacctagccgtgctatgctcggtgtcgatatttcttaatgacattactagaaatataattcctaataatggcgcataaatactcctggtatattatggttacagattttatccgcaagcgcatggatataccattgtagcatttcacccgagagtattccaagggtatcgtatctgtttatcccgtgggaagattataagggagagaaccatactaataatttatatattacttgtaataaccattgtctaagcaggggttaatataagcagagggtagagtgacacacaagcataagactactcactctcatattaaattatctgagctaagtggaaagaaaatagaaaaagaatctattcctatactttctaatatactctctccgtttcatattataagcctttctagcattgcccacattcatatagatgttaataaatccaaacacatataaatgcctagattcattaacatatatatgaatgtgggcaatgctagaaagtcttataatatgaaacggaggaagtacatattatacatacatcctcgctataagattaactctagctaataccctatttccgatgccctcttggtacttcgagaagccacccctgactgccgagtttcttacggcagcccgtcatgaccattcaaccggggctaaatacggaggaataccctccccaggaaattaacttaggattatatactcgcgcggaggaatacccatactgagctgtcactatcagcggcccaccgctcttccacagcatataaccccaaataatgatacccagtaatctagacaccacgcctaaactaccagatactactctaatatcatcgtcatggcatagagtaattgcataagcaaacattataccgcaccattgcatctcccagataagctagcagtataatcaacataacttagatataaagtaaagttggtatttatatactcagaaagtagcacaatactagagttgtatacagaagaatattctaaataaagtacaagtcttacaaaaagaagaaaggagagctgctagagccatatccgaactcttctgaagacttccggactcagacttctattctattcctactccactagcttgagaatattaaactaatcttgagagagtatgagagagcttgcttgaggtgtgtgttgaaatggaggatgagagggctttatatagcttgagaatgacagttatgacggttggaatggtcggtaataccctccaaccgtcattggggagtcatctcaaccgtccatcctagccctggatcaaacggtgccacggcgggttcggccgaaccaggggccagcccaaccagcccaagttttggctggcagcctcctttcttgatctctttcgcagacttgtgaattttgtcccaattcgacatgtcatttctgagttcttggcccattcatgcataagtctaattcccgacatcgtccaattgattgatcgtctgttttgatgttgattctcctccatttgtgttcattctctgcaagaggttagtaatcctagtgctagtgaaatatttattattctaacacaaatatgcattgcaagcataactagttctcctttattttggtagtattgacggtcaaaactgatcgctaacgaccatcaacacttgggccgccaccatggaccacgtgttggcaagatatcgttgtaacaagctgacatggcgcactgggtcgcgtggcatggtagcgagcggtggtggcaggcaccaagaatagagaagaggagacgacatagccttggctgttagtgtaggaatggagggcaggaagctttttggtggtgaccggcgagagtggagatcgtcgacgaggagtaagaggccacgggggcatggagcttacaggaagtggcggctgggcgacacaaccaagatgcccaatgttccacccagtccacagagcttgcttcaagctgccttgcagggcggtgttggcagtagaggatgcggctggtggcgtcagtgacagaggatgtgggcgttggaggcggcaggaaggatataggagttggcagtggtagcggacgatgtgagagttggtggcagtggtagcggactatgtgagagtcggtggcggtggcggaggatacgggaggtggcggcaagcaaaaccctaaccctagttgtatctatgactgaacttttttttagcaatcgtccgagccttatacgagctaat

SEQ ID NO: 68099 - DNA, 9126 bp, Oryza sativa
cagctccacctcgctgtcactactttcttggtctcatctcatggcacgtcctagatcgggtgctgctagctggatgatagggaagggaagagggaggagagcttgagagttggatgacatgcagctctcacgtgagtcccacatatttgttgggttacttgtctaattggactttcacttacatttgggccttacgtatttgtttttatttttgtctaaccggactgctgttttttgttttttatttttctcggtgccatgtatgcgccatgtagaacgaagatcaagccaacaagatatataagcgtcatgtcagtcaaaccactctcaatattactgagcactcaattcacacttaatttctcgttacatcagaagagattgattttttttttggatgaagggagtattttataatttactagtaaagaggctctataacctggtttgatggtttgaggatgcgaatcaaactggacatataatatataactagaaataaaggcgcgctacgctgcgcctggctgacgatgaatttgaatttgtaggaacaacattgtgaatagctataggcatgtttactttgacgttcaataatagcttaagcataataaaaaatcatgtacataatatatttatgcacatagatgtattaaatcaaagtcgatttccaattacattggtgttagaataggcagaatgaacatgtgtgtccaactcccttatttagccatgaccagggcaccgtaagaaccaaaaggtttagctctattatccttttcattgtgccagcatcatttatcaaagcatgatctgccataccattcagtacacaaatatatcatcgacaaccccaattagatcaaggatattgtcaataggaagaagggatagataagtgcggtgcagggtttactgtgtaagcaaagaaaatatagacctactaaaaaggcaccagttagcaatatagtcaacaaaagatagggaactcaacagagcaaccagtcagtcagtgaataaatataatttttcttttgtgcaagttaacatccaacaaaaaacccattggatatgcaaatcaagctatttatacaaagattaaatcaaatgtaggaaccaatagttgttttagttgatccacgtaccaggaagatgcatagcatggaggcataacatggcataatggtgtaaccaccttatgagaacgtgaacaggaaagaatagaacccgattacaccggttgtttgggaacttcgcccaagaactaattattaccaaatgataaattcatcctttgtaagttgaaatcaactaaatctaacattaatcgataatatggatgggtaactatgtaaatggttggctcagctattttaggtgtagttgaattgtgaaatgcaataaaacggactgactttttgtagagtgaccataccagttgcctttactaatttcggtaggtaaagagttaaattggttttttcctcttcaaacactaacattaggattctgtgccataggaaatatccacataagctacttcaattggttgtgatcaaatggaagcattgttgaatcaaatagctgttgcacataataaaggaattaagacctcattttatatttaggatacattttatatttaggataaccgacatatctaaatggtatggtacaggtgagttgtgggtcctgctgtactaaaattaagttatagtatatgtggttggtgtgctccttataagccttagtttggtcaattaattgattcaatcaaataaccacaactttttggctaagcttatgtgattgtaactaattaagcttgattttccattatccatgtccaactggatcactgtctaccttctctttatttaggccaaatgaaacattgccacatcatacgcatagataggaaaaaataaaactggaggcttattaaacttactttgagtactccaatttaatagcacgctcattggcaacgatctactcaatatgaaattaagatggaatgtatgagaagtcaattcttataaatcggcaatacttcttctgacagcagcagaacacacctcttggaataagaccctgtgttaaatcttctcaacaacggatatttttctgcaacatattagtgcaagataatgattaatgtaatgaaatttataacctttaaacaacaaaaaatgcagcgtacaaaatgaactttcaatacattatttccatcatggatcaatggtagatatggtttatttaaatgtgcctattcggtagagaaaagggagatgcaaacatttttgtaatgaataagcataactgaaattcaaggaaaaaataagtcaatgaacatatacagataaatatagtattttgttccacaatgctgttggcaagcaaacttgagttggtattcccagagtcgataacctgcagagatcatgtacagacctatttgcctcttcagatataacatggtggagaaaatctgctcagttgtctgcatcctatttcctctaaccgcaggaagaaatatatgagaagctatatccaaatgtaggggaaacaataggtctcacttggctaattgggagggggaaaagcaagaaacacaaacacacatacaaccattagtttgaagcccatgccatccacatcgaataaaccagaaaaagacagttagcagccattaaaaccaagatcgaggtagccatgcactattttgagcggtggtatctgcaattaaaattatatgtgcaacatacaaattagaatatcaaacatagcacaacaccataattatcaagagatggaattggataccgacaaaagcagaatgtgtgagtaaaggaagatatggccaaacaatgggtccaatcgcatcaatatgcatgcacaataggagggggagaaagccccaacctcaccttcggtcctctcacagaagcagtggtcgctgccggctcccgtgaaaccccttatcatgtgcgactcccatgccagcgagctgaggaagatggagagggatcctctaacatgtgaagatgaaagaggagaaaagggtggtaacggctgtcatcctcatccgggtttctggatccgcctgtaaggaggacggggtcgccggacctggtggtcccgagctcctcgctgggagatgtggcggctgaataggagggaggaacgatctcgtcgtggcgacgactggtgaaggatcgtgaggcgacggcacctacctacatgaggcaagcggcggcggcggcgacggtgacaccagaggagacagcaacggaggtgaaatagggagagccggcggaatagagggaggtggcgacaacggtgaagatgacgtggcggtgacgctggcggagagagccagagggcagcgaagagagcgagatagctcaagcagtcgacgccgtcgtggtcgtcggggtcgcggaagaacacctctggcaccagcagcgcgcacacgatgtgcgcccaccgcgcgttcgtcgtgtgcttcatagcgccgcccctcgccgggcagagaaagcagcgtggccgcggagatagcgagagggcggcggagagagcgagaggcgacgccgtcgcggccgtcggggtcgcggaagaacgcctccggcaccaacaacgcgtacacgatgtgcgcccaccgcgcgtccatcgtgcgcttcatcgcgccgcccctcgccgggcagaggcagcagagagggcggcggaaagagcgagagggcggcggaatgggctagagctagggttttgtttggtggctagggttcttggcaaatccaggccatcaattcctgatccaacgatctcatgatggtggaagagcagccacgctgggacacgtggacggccagatcgtccctcgcgcatgatcgaacggacgatagcggcgggagccgacgcacgattaacaggaagtacgggggttttttttgcaaaaaaaaaacaatggagtggcgcacctagttctccagaacctgattaaccataggtgaggggtgtttccgaaaaatttgatgatgtggcgagctaattctcagctattcccacggcgtttaagtaacctaacgattttgtttcccctatgaggtaaaaagaaaattaatgaacccgcaaatatcggcaaaacaacaagtattgttaaccaaggaaaaaaaactcacgataaagtgataaagacaagatacgttttgaccagaaaagcccgtgctcgattattttgggcacaggcttcttcggtaaagaggaatcacacgattcaagtggaattttttgtaaacctatattcagggaagtagagtggacatttctttttttccttttcaatcttccgcctcttcgttcaaacttcaaaccaagctttggcctttggccccgggggctcggtggcctcggcgaaatccgccgaccttgcgcctctgtccgcctccgccgctgccctccgccacctcgggggaagggaaccgtcgggccgccgccggggttgtcggtgaggggggctcgctccagtcccccacaatcccaccgttccccctccgtcgtcgagatcttcccgactactacgagcggaggcccggcgcgcgcgcgcgatgccgccgaggaggaagaagggcgtcgccgccaagcagaagccgccggagccacccgccgccgacgcgccgctgcgggaccggctgaggtggctcaacgaccaggaatgtacggcgcctctaatccctattcttcatcccctttcacgaattttaggggttttttttttttggccttgtttatgtattctatagacccggccttgtaattactgtaagttgggggcaagattggttggttggttgtgcgttttggttggtcgattaataattgcttggctatgcttcgattaatagtgtagtgttatagtagatgaatcgcatggcttgtttctcattatttagttctgttgggaattaggttttagggattttcttaagtgtaatgtaactcattcccctccaaaattaggagccattttggagacctgacaacaacatagggatcattatgtaaactaaatatagctaatttgaggtgtgctattgacttgagaattatcagaacagaaaaaccaagaactaacaatcataagaactgcatggcaattgacaacatgtgaagcagaaaattactattttccatggctggtttggagatacttatctcttttgaaaagcatagcagattttatagctaagcacccaatctaggggaatgcgattttatagcacatccatggctgctgattttgatgtttcctttcattttgccgtagagtttggatgttctagaacatatttgagagtgaactatcaaattactttttttcccttttcttttgaaatggtataactttcattttcccttgtggaaacaaagactatcaaggtgtaggtaacataagcctgctaatccagagagcaatgaaacaaatagacataatttactagagagttaaacagaaaaagggactgccaaaactgaaaacaaacttgcatcgtctcaagtaggcaggcctcaaatctcaatccatcagatccactgctcctttttacctgccacctattcaatcctgaattgctgacttgcaagtcttaacccttgtattgagttggtgccttacctcattagttgcaaccaggtatttgcaaacctgctcggtacccagtgtgagaaacgagcaaactttgtactccaccagtcctggttctctgattgctttctgatgaaactaatcatttctggttctttgttgaggtagatgacatgtaattccttacttgtagtaatctaagtaatgtattcctgatctctatatctgaactatcaataatttgaataaaacttgcatagtttctctttaccaagctcatacaacttaagtgagcgatttaggtcaaatgcttaatcaacttcctctcatacaagaaattgttcatccggcatcctattgttgactgtggtttggttatttctttgtttctgtactctgtgatagcttttctaacgtgctttgaatttgaagagtaataaccccccaagaaattgattaaagatgctaaaataatcaatccctttagcagttagccctgttccagtcttattttcttaaaaacatatatcacattattactactctgtagaatgcaattgctcaaactaacaagaaactataattgtgtgttgaaatttgagtttggagtcgagacagctttcaaggatttaccatccagttatctgtaatttcttcaaaggcataaccagtgcattaccattatcttacaattaatgctgaagattgcaatcaaatgtgaatgaaaaggcttaaaacctggagcacacaataatgtagcattgactcgtaatctattggctttaggatgcattattcagcacaagatgccatcttttgagggagtactcccaattattgaagatcattacctgatcttcctgcttatccctagtatttgataaaccaacaataagtagtataggtttgttgtcaatttgcgtaatgtgattatcatgagtccactgctaatccagtgcccacaataaatagatgaacatcggagtgctgccattaaagctattcaagcagctgagattgagagtatactttctcggttgcgtttggttgaatcctacatttccaaggagcaacaagagggatgtgccttgcaatattttcaggagaacttacccaacttatcagttgtccggaatgaggagcagaatgagcttgagttgaaacgggaagattgggacaaacgattaattggagaccactgtgatgacaagatttttcgggcttcagtctcttcgttaccaaatgttggttatgttcaattctcaggggattcaggttcgagcatgctctctacctattgatggttatacctttattggcatcaaataataaatgactgttttaaatgtttttgttaccttgtgtgatgtatgcagtgcggaaaagctttattgagagcatgccttttaattttaatgactttgtaagtgctttttgaatattgatatcagctatttcttctctagtcattactaatctcacccctctgttgcttccaaggcttggggtgagctacctgaggatcaactggcaggaattgcagatgctttacagacacccggggtagcattttacgctgtccatatttattgaaatgatatatgagtagcaaatgaatgaatcgattctgtgtttccttttaagcttacctttacatgttttaatatgatcttgagcaggctgtgagtactcggctctcttttggtatgacaccaaaaactttaaggttgcccaaaaagggcgagatgctcttatctgtgcgtggctcacctcttggagtgtacaaagaagaaaatctggcagctgttcatggtatttatcaccttttttttcttggctcttcacaagcatcccttactatggtcctgttaacagttggctaaccccccaaaaattgcagaatctacaaatggaagtgaagatgctgcctcatagtaccagttgccacatatagcatactaaggatgctatgtgatctatccactcttttcgtttagtcgtgtgccccatggttgatatgttttgtctattgcagggacttatcaacccttgacttaacctttgggatattggtgtttttctttttcttacctaagctgggatactcacccagaatcaagatgcaatcactagttcaggtgagttgcagtatctatttgttatccttgtgtagttggcagtccgcacgtgtgttgttggatgctgatttcattcaggtgaaatcgtgtattaagtaatgtgtcaatgtgtcaccgttgttaactttgctgccaaggaagtgggcaaaagcagtctaaatgcgcgtgtccgtgcactcgtgattgtcaatgctgtattagctcattaccagagatgagacaatgtgagctgttgtaaaaccgaattgaaattgtgaatcatcagatttaatattcaaattgcttgcaaataattggtaaatatggaattttagagtaggaatatgtaaaatttgtccaataccctcctggcttatctatgtgtttttcttactgttgacttttaataattcctttagcagctgtttttatataaaatgcaggatcttgtttttaagttttaccaattccttcctctgatttaccatcaacagaaagaagactacattaggatctatttttctgaggtctttggttatgattgaattttagggatagttatagttgctgtcttgcagagccaccaagtttgaaaacctgtctcacatgaattttggagtaacatggacgtgtactgcatactccactagtgaatgtgcaccaatggtttttccatgttagtactccctccatcccaaaattctagatttatttttttccaaaataagtgtaattctaccatgctacttattacatcaatcacatataatttgaatttatctccatcctacctttaaatatcctctcactccataccatctcttatttaataggggatgcttaggtaattttctctccctcttgtttttccctctcactataaaaaatgcacttatagggggatggagggagtagaaacttagtcacattttagtattcataaaaaaaagaatatatgtgtagaaacaaacacttgttggttgttgcattcaaatcctatattttgaactcaaatttgtagcaatagtcaaatttcacaaactgaaatctattatatactaaaagtttattaaacttcctacaaacactctcaagccgtgacggagctcgtggcccctcaccgggagaccgcgcaggcctccctttgccagttcggccgggggcttagggtgagatctcaagctctctctgtatctctctgtatgtggaaagatcacccgcccgcaagacacacgagacacggacgatgtatacaggttcgggccgctgcgaagcgtaataccgtactcctgtgtttttgtggatttgtgtatggacaagttacaaaggattaacttcctttcccctcagccttctcccagggaa

SEQ ID NO: 68100 - DNA, 3207 bp, Oryza sativa
tttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccgaataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagatttgtctcgcccggagatacggtaacgccgcttcggtcggcgagcgtaattaacgcgcgcacgatacaatccatttcgattgccacaaccgcatatccacttcatgcgccgtaagcgggcgaatgggattagtggaggcgtgggcacgggaaacgagggagcgagatagcgagatacgagggagcgaggtagtgggcgcgagaaacgaggagccaggcccagcgatggcaagggtataaaagcatcgagtaaaggatttgctcccttcctttcgccattgttcctcttgccttcgccgcctgagctctaactctttctctgctacgccctactttcgccacacgcgctcgttctcaatcatctcttcctccaccaccatggcacggggctctgctctgcacgacggcagcgtactaccgccttcccgcatcgtgagcgagaggcacgccggactgccgcgccgcttcataccggagtccgccaccggtcgggagatagtgatgctgggcgaggggcgcccggcaccagactacccggggcggtccatcttcttcctccccttcgcaatggctgggctggtcccgccattttcttctttcctcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtccttcgcaagaagtgggacgactggaagagcgactggttctacacccccctcgccaacgaagcgcgcctccgacttccaagtcagcccccggcgcaggtctccagctggcgggcgccggtagatctggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagttttttcttactcattttgttcgtcttctggtttttttcttctgcttcagcgatgtcccgtcgcattcctcccgccaccccaagtccggccagttcgaggccgaagatccagcggccgcagaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccctcgggcaaccctcaggcgacagcctccggggaggcacgcgacgaggccgcgggcacatcgcctgggcccacctccccgggcgacgcccaggatcaaacgggtccgggggacatccccgagcccagcacgtcctccgggggggccgagccgcatcgccttctctccaaggcggctcttctcctcatcttccgtcgccccgctgagcgccgagcccattctgcaggccttggccgccgcaaacaccgcggtgctggatgggtttagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatgg

SEQ ID NO: 68101 - DNA, 26602 bp, Oryza sativa
aaacgccagccgggaggcggagctgaaagaaaagctcgacgccgcccagggagtccttgactccgccgctgcccgagagcggcgggtaacagagactgaggcggcgtcccggcggcgcgaggagtcccttgaggcccgtgctatggcgctggaagaacacgccggcgccgtggagaaaggcttgacgggccgcgaggccgccgctactctccgggaggcgacgctggcggcgcacgaggccgcctgcgccgaggaggagtgcgcgctccgcctccgcgaggacgcactcgctgagcgggagcgagctctcgaggaggctgaggctacgaccaaacggctggcggacaacctgtcccttcgcgaggcggcgccggaggagcaggcgcgccgcaatcttgaatgcgtccgcgccgagagagccgcactggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgccattctccaccggggaggccgaggcccttcgcttggcgggcgagattgggcccgacatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcgcgggtcggggatgctgccgaccacatcgtcaacggcttcgagggctcggcccctcggctcgcgttcgcccccagctccgacgaggagggcgacgccagcggcgaggacgacggtggcgacgaggccggcgacccgggcgcattgggatgagcccccaggcccccgccaatctccaattttttctttttctttcttctttttgtatagatcaacttaatctgcaaaaatgatgaaaaatttctatgttaactttattttgctatgcatatgagttgaggatgatttgtgccgtggtccttttgcattttaacttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgatttttgctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaagctgtgcatgtgtggtagcccccggctaaccctgcacacccgaggggggtgcggggttagcccgagcccgaaacctgacacccgacccccccccccccttcaggggtagaagcgacgaaggtgttcgatgttccacgggtttggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcgaagggtcgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggtttgcccagagcaccgctgacaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccatttagtgaacttgtcgatcgcaacatacagatactcaaacccgcccggggcccgtttgaatggtcccaggatatcaagcccccagacagcaaatggccatgacaatggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtacgtgaggcggaatgggctccgcactcgccctcatggatgtcagcaagaagctcaacgccttgtccctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgtggcctggactccgacgggcctcgggggccggtcaggcgcatccgtctcccctaaggggtcgggtcgcgccgacggctgggtaagcctttcttcaaaggcgcccggtggggtctgggctcgcgaagacgcgagccgtgagagttcgtcggcaaccatattatcccgtctgggcacatgccgaagctctatcccgtcaaaatggcgctccatacgccgtacttggcgcacgtaggcgtccatctgcgggtcagagcaccgatactccttacagacttggttaacaaccagctgagagtcgcctaacaccaggaggcggcggatccccagcccggccgccattctgagtccggcaaggagtccctcgtactctgccatattattagtcgctcgaaagtcgagacggaccaagtatctgaggacgtctccgtttggagaggtcaacgtgacccccgcaccggcgccctggagagacagagaaccgtcgaactgcatcacccagtgggtggtgcgaggcagctgagaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaaatagacaggccgctgcacctttcggcggggccgatccccttcgctaggggccgtatccccggggcgttcttcgtccaagtggcctcttggggggcacttgtcttctgtgccgatgacctcggggtcggaggatgaaaggggcggccttccctcagtggcctcggggccgtcctgagggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcagaaggcgttaagtgcggccttcccgcagtggcctcggggccctcctgagggtcgggggcacctagcaccgtctgacaagcgggcagagggccggctccggtcgtcaggggccgtaggccaccgtccgactcgggggcctctcctccccgctcgctcccgggccaagttagcacagaatgggggtgcacaaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgttcagcttcctccgtccaagtaaacggccccgagcgcttgaggagcttaaacaagggtagcgccttctctcccagccttgatatgaaacgacttagggcggccacgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggaactgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcagaggggccaagcctctcgtcaccaccctcgggcttggacgcagcagcgaggcggtcggcgcgctgctccatgcaagcgagcgcgactttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcaaaagccgcgggggaaaggatgttgagggccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcgtgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcgcggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcaccagcagcctgaagcgcaccctgaggcgtgctgccgtcgccgtagacgaggaggcgacgctccccatctcgccgttctcctgcatcacctgcgactggtgatgccacggacttgtcgaccctctcaagcgcctccccctgcttagggctttggcgcggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaagcacacactgagccccctacctggcgcgccagatgacggagctcgtggcccctcaccgggagaccgcgcaggcccccctttgccagttcggccgggggcttagggtgagatctcaagctctctctgtatctctctgtatgtggaaagatcacccgcccgcaagacacacgagacacggacgatgtatacaggttcgggccgctgcgaagcgtaataccctactcctgtgtttttgtggatttgtgtatggacaagttacaaaggattaacttcctttcccctcagccttctcccagggaaaagtcccccctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccgaataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacaagccgctatgtaggattcctacaaacgctcctaaaccgccacatggcgctctaataaattttgagaaaaaagaaaaatatctaaccgtttatttttatttaaaacggtggacccgataatactaaccattagattaaatccaccgaccataatttgttacgataaaaattattagatctatttttaagtggaactttaatttatatatgaatgatcttggtgacataaataaacaattacttttttagccgatctacacatttaatttaagacacgcttaagcgaagccatccatgataaatcatttgtgataggtctcatcacggatcaaaacatagcatgtttgaaatatgtctgtagggataatccatcatagaagtaagatcatctatgacaggcgtagttttgacgaattatgcatatgaactaactgatgataagtctccgctttccacttcctctctcagttttatagcaaatgagataaaaaaaataattagatggctaaatatttttttaacatatttgatttttagtttgatccatattgaccatgttttggtatgtaagattatacactaaaagtctatgaaaattcctacaaatgcttctcagctgccatgtgtaccctataaatgctcctaagccgccgcttggcactttgttagattaaagaaattcttaaaaattctaagaaaaaaacaaaacatctaaccattgattttcatttaatccgatggacccaataattttaaccattatatcaatctctaaaagacaagtgcgtgggccgcggttgaagaacgagacatggggcctcttctgctctgcgcaccacatgggcagctgtcggatgggagccacggcgggcgacggcgccgtcgatgtccgctgcgagagctaggaggcggggtggctgtacgtgtgcaacagctggctgtacgtgtgcaacagctgcgtgctgcccaccacggtgggcgtaaaccccatgatcaccatacagtcagtgcgtgtattgcgtcgccaatagcatcgctgactccctgtccggtaaaacgaatttctgtttggatcattagtccctggtggaagattgagaaggaaaatacctcactttaataattcaaacaagaagggaaataccatccctttaattaagaagggaaatacttcactttaatttaaattcattttgttagacctgttttcgaaacgtgcccgcgtgaatgagcgggctaccttcctagttgaagttaaaacactcataagttgaaaaataaaatctgtttccaaaacgtgcaattgtttactctaattatcactagtttataaagtcacgcgttcgcgcgactataattttcctatttatttagatgtgtgtatatgttatttaattagtttaaataagtatttatgaaacatgctttgcaataattgtagctataacataatagatttatcttgattcttttgttaatagtattattataaaaataaataacttaccagatttttatgaacgtatcatttgcagtaagtagacttgtaatctgaaatgccaattcttctttcggctttcagtggtgagtgtaaaggctagggttaatttctattcatctccaccattgtttgtaattacattttattgtaggactgcaaaaaggtaattacatctatcgtcacctctcctaccctccacacttccgcagttctccttttcattttcgttgctgtagcttttttttctctcccactaatcctctgtttgattgccttcctctttttacatattcatataatttagaatgtaggttgtccttctgctcattcatctgcacactatacacatttgagaagaaaccacgtggtaccgcgaacgatcgctaatttataatcgcactatccatcaactgcttaatagttgcggcaatttcggtagcagcccaagtcgttattgttgattagcacaagaagtgtccaaattattttccagtctgcctttttagctaatctgttccggacacggctcgccatacaaattggacacaagatcgcttaaattactactcgtttttttcccagttgagatttacaatttttcgtcgaccgaagagctcgatcgatcggtcgatcgaccacagatcatggattcccgtaacctatctcgtcgcaagcagagagctcgcctggaacataagacggccgacggcgacgagcgagagaggagcgaggaagggcgccgccagatcgccgtgcggttagccgcggtggtctccgggtccctgatgctcgccgccgccgtgctgctggagatgcacatgttgatgggtggtctccgggagctcgacgccatgagcttctcgggcttcgtcatgcagcacgtcgtcgtcgtgctcgccgccgccggcctcctcctcgtggcgttggctggctgcccgccgtgggacgacgagcggcggcgctgacggcgcatctatagctctctgatggcgatagcttcgaaaaaaaaaggttaattggatcatgctattataaattcttcagttttaaaatataccatttcaactatttaaaggtatgccattataatttttcgggtattgaaaatataccattacataccctttggatgtgtttaataaaaattttggaccaaattgtcctcgtcttcttcctttgcctcctcccatttctctctgttgttcatcttcttccttccattgcttgctgctagaagacgtaccgttggttggttgcttgcttgctaccgggcagaagctagtggaatgtattttggatgtttgactaactcgattcggctcagaaaaaaaaagattttcagattgagattaggagtacacagtaacgatcgctttgttttgatcatgcacagggcgcgctcgtcgacgagcacgtaatcggtggaccacgccatgctggccgagaaaggagatggggaggaagaatactagttgccagatccaaaagggaaagaaatacatactgtgtgtccaccctcatcttctcccttcgtcttctcccttcgtcttcatcttctcccttcgtcttcctttcccttctcccctctccctccctagatgcagctgcctgcaacacacagtatgttggtgttgcccacattcgcgaagagcctggctgaaccgctgccccagccatgtgcgtaaccacgacgcgcgcggtcgaccattctcagctgcccgaggaagttgacgtacgtccatagcatgccacgtggcagacctcgtgcggccaatgccagcaccattactcttgacttaagatcaactggacaaaaggtcacaatttagacctccattacgagtttcaaagttagacgacctgtatcattttctccaaatgcttcacactttagtttcactgcaatagaataggtcgctttgcagtgacatggaattgatcaggaagataaagaagaggatgtattggtaccttactgcttgaaatcgtcccaactatcactgaatgtcaacaatgcatcaacaaaagccatccctgcaattgccttcgcttgttggcaatgttctttggaattggaggtctttagaattggaggtcccgcgtaggcaatgcgatagtgaaaaccggcttcctctccgccagcgtcgagctccctcttcagcccttcctcatcggtgggccaccgccgttgcctattggagccgctcctccacttggcagtggtgttgtttgagtggctgtcacatgggccatacatattttgttttcatttatcttttcatttgattgatatatggatcctatattttctgtttcatttcttaattttctaatttttgcttctagtgacaagtcaacgtcatgtgggacaaggaccaagtcaatccagccacgtaggcgtcacgttagccgaaaattatcttgagacctcgtttgcattgattttgggagttgagggcacgttatatccgatattaccgtccaaggatattatttaaacttgatgttaaaagataagtgacctaaagtgaacttgttcctcaaccttttcatccctttagtctgatactgaagcacctatccatgtgcacccaggcttcaattgagcccatcagcccttccccggttttcgtttgcagctcaaatgctcgtactattgtagattttatttgaaactgttctattaaaacccatatcaacgcacatgatattattcagtttcagtaaatgatgaattgtggtaagtcttgcatttgtaagatgatttgtacttagaaccgccacaaccgtacgcattcgaaaagttattttcgtaacagtacgtgttagaaattatcgtcgatattaaaactagacaggttcctacgaagttcaatagtgtacgaacatacggggaaacgatatttttttttgtgctttttgcaaatgcgtgaagccgtgaatggatattcgatatataactcggaggcaaaactcgtacgttgcccaaagccccaaactcacaaatccatacagtataattctttcagaagacgaaaacgtagagatgtcttgctagctagctaaaatttacaattgatattaacagattatcaaagcgtacatatataaacaattgcaaagaggctattaagcgagccattcatcatgcatgcctagaaacaccaacacgtagacgtagttcatgagatcaacaacttggaggagattgtgcaacgggcggctgcggcggcggcggcgcggcgaggcgggcggtgccggcgatgaggatgtagaggggaccgggcgggtaggtggcgccgaagaggcggaacccctgctgcttgaaggcccagacatggacgacgtccttctccttgatgccgcaccgggcgatgaagtcgaggtagccttcccccttgatgatggcggcgccgctgctgtcccaccgcgtcagcagcagccgcttcatgccgccgcgcaggtgcaccagcgtcaccggcagcccgccgtgcgacctccccttcttcttcttcttcttcctcccgcccggccccgccgtctcctcctcctcctgctgctgctgctgctccgcgacggcgacggcggtgtcgctctccggttgcggcggagttgttactgcagcttcctcctcctcctcctcctgctgctgctccacgacgacggcggtgttgttctcctccggttgcggcggagttaatcctgcagcttgagcttcatcctcctccttgcgcaggaagctggcagcgatggcctcgcggcgggtgagcatggggatgaggctgcggccgacgccgccgcacgcgaggcggaaccgattctggtgcgagtcgaggtcggtgcgggtcaccgttttctcctcgatgaacaccagcggcaggtcgtacgggagccccagccggtagaacactatcttccgtatccacgacggctcgttcggcacttcccccgccgccagcgacgacgacgacgccggcgccacggcggcgagcgggaccgcatcgatgggcgcagacgcgaaagccgccgccacgtacggcaccagagcgccggccgccgcccgcttcttcccccgtagacgatcttcctcccccgccccgccggcgacgagaagccgcttgcggccaacgacgcggtggctgttgccgttgccgttgccccccgccggcgccatcgtaggctgtgcacccccttgctttttgccggagcacatggccgccggtgaggtcgtcgtcgatcggagatggatcgatcgacttgagctgtgtcgcgaattcgaccgagatctctctagcaatggagacgcggggttgtggatggctctcatcccgcaatgcgcagcgctggatttatagcggcggggaatgctcgtcgactcctactcggactccttcccctacgcctatctgatctgatgcattcgtcgtgttcgtcacggaatgggaaatgcagttcgtgtaaaccgacttggaaaccgatggcccactagatcgcatgggtgatttgggcttaggcccactcgctggtattgctcatcgagtccgagtcggactccaaattgtctaatgggctaccggcccaaaagtacgcgtccactttagtatgggcctcgtgtccacagaagcaacaccacaccaccacgcacgcctccgccgccgctccatggacgccggcgacacatccgccgccgccgctgtagcccctaccccggcgcggctgcgggaagcgctcgccgccctctccaaggtaatcgcgcaagctgagccctaggatctccttctgccgtgtaccctagctaaaccctaggatctccttctgctccaggcgttcgagtccggggattgctccgatggatccgccgcggcggccgtctccgacctcctcaacgccgccgccgatgcagctgatgcggaggccgacgccgaagacgaggcggcggccggggtcgtcgaggagatgctccgggaggtgcacgcgttcctctcgtccccgtcctcgaatcaggttcgatatcctgtgcttgcgtgtgattggtctctccgcgtggtgtttcatgttgcgattcgcggggtgggacgggagtaattttggtgatctcctgacattgttgccgtctcgtaatagttggccatagatgctctctcactagagctggtaaaacctgtggcgaagctgggggcactgatgaggaattgctgggacattgccaacgctatcattgaattcttcgtgtcaaactgcaacccgagggacatgctctccatcctatgtgaggtcagtcacgcgtgcgtttattcttgataaatcctggcatttggctttacagttgcgtcttgcaatgttgatgaaattcagaatatagacccatacagaggtaacctgtgtctcctttaactctgaaagatcctgtgattggaaagagttctggtttttattttattgagggatgaaggaaaaagtccatttacaagactgaactatcatcaaaatctgaaattcaactcggaactttgaaatgtgacactattctttaccctttcaaatagatctggataagttttatagttttttaaatatgaactgatgttccattgtttatttgttgcatccagtccaaacttgcacaatgccagggcactggaatgtccattcataattgagcatattttcattttgcattcaatatttccagacgacaatatatctctacctccttccctcgcttctgctctctgggttcctatggtatattgctcacctttttgtcatgacattatgttgctttaatacaggcagtagatgcaccattggcatcaaatggctcagtgtactttgttcttctattcaaggagctagccaaaggtatatgtttttatatgaagatttccacagccatctctctgctcatcgtttggaaattttggtttctaatggatgaatttccagataggaattgagatacttaatgctctatgcctatatatatataagtttagatatattcgcttgacatatgttacacaccttgtgtgaatattaactggttaacatttgtattattaaatatgttttttttctattcttcctagctaattgtgctttgggctagtgcttgttttgattcagaggaggcatactgagcaagtaaaagtcacacttcctgctgtccttcgagttatgaatgctgttataccagaatgtgacgaggaacatggaaagatcatcgttgatatgtacaatgcagcacttagaattggcaatgccattcaagaaatgtgcaaaaaaatggtttgttgagttaaaatgccattcaagttgaccctgtgtcctaaacaatatgcggtcgccttttcatttgtcttttctgattaattttgcattattgtttccatcaccaaaaggtaaaccagacgaatgaagaactctgttctgtacttagtctatactcccttcagaacatagtaagtacaaaactgtgttatttatatatgttattttcaattagatttagaaagatttattttcttaatatgttattaattattatacactcctatcttgcaggctcttgtatcaagatgcaaacaacagcatattctctctgcttgtggttcagttgttcttcagcattcaaaaattctgacattttgtgggttcacttatttgggtcttttgactggtaatgatgtcacctcagccaccgataagatttcaaaaggtgtttaacttttccaaattatttttcacttggaaatattgtattctgtttgcttgattgtcaactgatgcatttgtttgcaaagtgatgtagatgaagatgcggatttgctcgagtgcttttcttttgcaatgaatggtgcaaatcttgcaggtttgatgatcattttgactacactttcattggacaatgcatgttgtttagataccacttggtcacatgcttgagctttttgcagttatctggacctatatggatgatgaaatctcaaaatatgctggcgctgagctggaatcagcgctgaaagatgttaagggcaaccatacgaggatgtggcaagcaattaacattcttagatatgtgttgtcttcaactcattacccatgggtaataaaatcccacagtttggacttactgctgactatagctaatgaaagtcgtattgaggaaatcaatgatcatgtagatgtttcatcttctggtcctcaaatttttgcaacactcaaggtaatgttacgctttacttatatatttaaaaatatgtcccaatctactatatcaacaatttaagaacattcacaggccattgaaagtgtcatgatttccgccccagatgcattaatgcggaagaaagcttttgctactttgaaacaggcaagtatcatatatactgttgggttttttctttctctttgttttaacaattgtcatgaatatatttttgacttgtgtttgtatatgtctgtaagataatatgggcaggatggtaacatgttccttcttcagtctgtactgtggcatttcttctttttcattttgaatgtcacttctttataacgctgaaattttatcaggttatttcaatggtgccatcctctcagagattcaacatcttacaggctcttataaagaacagcatcttcccttcattggtaagaactaagaacacaatctctgcatgcagtttaaatggtattctctctatcccaaaatatagcaaccaagtactagattagatgtctcgtagcactagtggtgtctaatcttgtactaggttgctatattttgggacggatggagcaagtaagagcatcctgttgatgcccaatatacatatagggaaagaaaggaccatacaatggatctcagattttcagttaccgccacctaacattttctggtgtatgatgtgcttggattgatagaaacatgcagttttatgatttttaacttcatttttcaactccatcctttaaatcgtgaattatgttttttcttctagactgcacttctcctagatctggtgaaggatgaagtttcgagagagattcgtcgagctgatcaggatattgttgaatcggatcaattacaagatggtggcgaatggccaccaccttggttttctcatgcacttgagttggtggagctgatcttgaagcctccagaaggtggccctccttgtcttcctgatcatggtgaacaggtaccctctttttatgtcactactcatgaggagcataaatatctgttggaagaactcaggcaacagcaacatagatggaatagcattagttgatacaagatgcctgtttccgtattaaaataaaaggaggatgactgttgggcaggaatagatctagataagacagacatgaacttggagacttgtctaaatccacagaaggacgtcaaggactaggagagttctgttcatctttaccttattaaatctcagtgaaccagctgtgtcatcttaggctcttgagaaattagcgaatgattataacaaatggcttcaatacttataaagatactcttaacaactgaataaaatatagaataattaaagtctcaactccaatccaaaacattgaatatcgatctatcatttttcctttttcttttcgacttaatttgtcagactctcgtaatctcatttttgtaacttttaacattgaatgaatttatactagtaaattgagatgagaaatgcatgtaaattttgtgggaatatttcatgttaaatttgatgtataaatcaaagctggattgcgtgaatatctggattcaccttatatgttgcccacttgtgttgtgcttcgttattcttatgtgtcctgctaaagtggtaattttgttttacatcattttatggcttatgcctagaaaataatctgccatggttcacttttttttatttgtatgcaggtattatcagctttgaatttgctgcgatttgttctgataatagattcaagaggtaatctacaaaaaacctgtgcttaaaattatatgtacttaactgaactgtaacaataattgcatggatttgctattgcaaaactaatgctacatgatcacaccatctataagactataatctgcaagtttctctgtggctctcgaagcttaatgttttcataaattaaatatttgattaaacataattttggttatcaacgtgctggtgcatggttctaatgttcatttatctaaccaatagttgtctaaaacactttcttctttttcattcttccaaatgtcctttaataaagagctgtaacattgaaactctgttaatgtgaacctatatagtgtactaatcccaagtaatgtgttgaaaaaattgcatatgtcctttttagtttccaagcttgtaaacccatagaatcaaagatggctcgagacataaaaagaagtggttgcatcttatttgaacaaaagatgcatggtgttcgacttcatgaatggattaaggctcatgtgatttagtcctgggattaatgtgaatcgtcagtttgatatatttttcccattttgtccaggatcaagatcaagaaaaatgtttggggaagagactatgaggaaggtgtactcagagtggctgatgccattaagaccaattgttgcaggaattcaatcagaaagtgaagaggatggtagcgacgttgcaaatcatatcatgtgctcgttaaatcctgttcaattagtattgtaccgctgcattgagctggcagaggaaaagatgaaaggtttctaacgttttcagttcactggtttttgtacaatatactgctgtctcgaggcaaaacatgaacaagttgtgaatattatcccaatgatttgaagttgcgtttttttatgttgtacagtgatactgtcgtccttcataattcattttgctggatggtctcgttcgctttttgcaaagctgcaccggccgagccgtgcccgcgcgccacgcatggccgccacacggctccggccgatccgtgcccgcacgccgtccacgcgccgcatggccgccgccgccgcgcatggccgccgaccgggcgcgccattgacggggagaagaaaaggagagggaaaagaaggaaagaggaagaagaaagaaggaaagaaattagcggctttgcaaaagagccgctggattttttggaaatcacgcgcataactcccagcatggaaactttttgcgcataggaccctagcatttcggaaactcccatttctaaccatcgactgcatggaaacttagaaataggcccttaaactttgcagatttcgcttatatttcattttggagcatattatgtcttagtgcaaattttgaatttaaatttattaaggcattatttactgttaatgaatattttgaatttttcgttttcagtatttatatgaatatatgcaactttttcaccctttttctatgtatgtatttgtacgcatttttaatatgaactctagtatttctttattgaatatttcacatttcttattcgcattgcctatgaataaaaatattggaaaaaccatgaaatatttgcattcatatttgcgactatgttactagaagtaacttatgaatattttgtcactttttgccacagaatgttaggaatcacgaataaggagttcgccaaactggcccagcatggccagaactacctgacttgagcatccaatgtctagatcgtccttggggccaagaagctccgccagacgattgggatgggcaccccgcaggaccgtgcgcctacccctgatgagaatgatcaggcgctgcacttcctgcggcaccacctctgcaccacgctcaagaatgagtacatgggatttaggagcccactcactctttgggccgcactcaagaagtggttcaagaagttgaagtacaccatcctaccccaagcagagcaggactaggttcgtcgacttcaaaagtgtctccgagtacaattccgcgatgcaccggatctgtaccaacctctccctctatggtaaggttatcacggacgcggaaaagatcgaaaagatgctctccaccttccaccctagcgtcgcttagagcacttgtaactacaggcaagtgtcatacaaggagtatgacgagatgatcgacatcatacaggtgctcgagtctcatgatgaggttcttcgcaagaactttgtctcccagacgcctagcaagagtgttggccttgaagttaatgcttaattagtgttgactcgacacacgtgcatatcccacaaccataagggctccctccgaaaaaaatggaaatttttagcagaggtacaagtgtagcctaaattccttgacaataagaaggattatttccagtcattcaggggaagagaaataacccttaaatgatactccctccgtcccaatatatagcaacctaggaccggatttgacatatcctaggactatcaaatccggtcctcggttgctatatattgggacggagggagtaaatgttaggaaaaatggtcaaacaaaggatgcacattttaccaagcaccagcgaatgcaaagtatgaaaagcacacatgagaattagataactgcctatcacttttgtgattcggagagcatgaccaagttgcattactcgaatataatacactggaggagggtgaaataccgaagaatgcaaaggtatacctcatcttgtctagaggcctcgaaaaaaaataggacaagaactctggctccttaaatctctaaagtaactggagacgtttggtgaaaacgggacgaaaatgaactctcaagctcatagtcactaaaagtaaccccagaatttgagggggagccagttcagagctggcaaatagtatgaaacctcaaaacatgcataccacatcttcccatcaaggaagaaacccagcagtcggagtgcacaccaacactggtaaaatgaaatagtcatgcccatatcaaagaatagaagcataaaaaaattgcatatccccatatatccatggatactcgcataagtgtcacatacaagtatacaaaccaataagaattggtaatgagacatgctatggacaatattctcttcatatagcaaatcagtggcagtcaacccagagttgaaaatcaactaaaagatcaaccggcaacgctgacctatagttgacaatgaatggctaaagaaattttggattgggcactgcatacaagcattaaaagtcccaaactaagttgataatccgaatatcatcacataaagaaagaaagctcattctttccgaacgagtttgagataaataggtagaaacctatgttgctttggcccgtaagcctacaacacatgaagaagcgaaccatagtatatcagaatgtgaaaatacataggttccttggatatagttcaccatttttagcaagtaacacggttcgagctttgtccaaaccccaaaatcattatcaaaaagataatgatatgtgcatcgcaccaacactaatagactatacaaacactataagttatgggaaaatcatgcaatatttaaccattagagcatcactcgaactatcttttgaaaagatacgagcaacgagttttgatggttcacacttaaaagagatacggaattcaaggggagaattttgccagtctattaacaaaagcttgaactgaagagtcaagtacccaaaaccaattaagaaaatcgatacaagaatttggctaggttgtactctttttttccttgcataagttttcatgcagtttcttattaaggtttttaatgaggcaatctatgcgacatatctgcttatgctatatactatttctccaatttttcccactgggtttttatgaagttttaacaaggcatggacatcacatggtgagtgtccaatgggagtgttaagaaactttgggctcggcccacgaaggcctggcccaaatacacttgggcctatcaccgaaactttcatatttaggattgcactatataaagagaggagggggctactcttttacagttgatcgaagaattggaataagaaaaaaagtctcacctcaactatgtgtcttcactttatattcttagaattatacaactccgttggactaccccgtagcaagaggttgtataataaatttaactgtcacgagtacacgccaacatgtttcgtgagtacacatgctaattatgctaacgaccgatttaaccatcttgatgtccaagcttaaagacctaaacttcggatccgtctccagtctccgccgatctcgacaccaccacgccctcgacgcgtcgcccctctcgacctcccactcctcgatccaatcctcgccgtccatccttccctgcgtccaatccccaccctccattcgacctccttcttaactttcagcgccgcccaccgttccacatcgaacctccgccatgagaccaccaccaccccacctcctcctcctcctcccccgccgccgccgccacgcctcctcctcctccgccgccgccgccgccgccggagagctcgtcggcgccctctccgccttgccctcccccgactcggcgcgacacctcgacgccctcctccgtcgcatcggcggcggtggcctcgccgccgtcctctcgtccctgccctcccctctccccgcggcctccgccctccgcctcctcctccacctcctctccaggacctcctccacctcctcccgctccgaggatgacctcctcaccccgcgcgtctcggcgctcctcctgccctccctcatcgccgatcgcaccgccatccggacggcgcgccgcctcctctcacgactcctccacgtccacccgctccgcaccgccgcggaggcggtcgagacgccgcctccaccccctcctcggacttcctcatccacaccttcatcacctccccggcccaaggctccctctgcagggccgccgacgcgttccgcgttctctcctcgcgcggcgcgccgccctccatcaagacctgcaatgcgttcctcgaagcccttgttcgtgcaggtcagctcgatgccgcccgcgaggtgttcgacgaaatgcgtgaaagcaggaacgtcgctctgaatgagtactcgtataccgccatgatcaaggcgctctgcaaggctggaaaggtggatgctggttttgagatgcttgcagagttatggcgggctgggcttcagccaacggttgtgacgtacaatgtgcttatggatgcactgtgtaagagtgggagggtggaggaggcctttcgattgaaagggaggatggaacagggagggatgacaccaagcgtggtcacattcggtatattgatcaatggtcttgcaaggggcgagcggtttggggaggttggcattgtattgcaggagatggaacagttaggggtttcccccaatgaggttatttacaatgagcttattggttggcattgtaggaagggccattgctcacaggcactcaggttgtttgatgaaatggttttaaagaagatgaagccaacagccgtgacttataacttgattgcaaaggcactgtgcaaggaaggggagatggagcgggctgagaggatattggaggatatgttgtcaattggaatgacagttcattgtggtttgttcaatacagtggttgcatggcttcttcaaagaaccagaagattggagtcagtggtaagcattacaaatgaaatggttacacgaggtatgcgcccaaatgatcctctgatgacagcttgtatgagggagctttgcaagggagggaaacatcaagaagcagttgggatttggttcaagacattgaacaaaggtttaggtgttaatcttgcaacttccaatgcgctaattcatggtctttgtgaaggtaagtacatgaaagaagctacaaaggttatacagaccatgttaaataagggaattgaattggatagcatcacatataacattatgattcgaggttgctgcaaagacagtaaaatggaggaagctattaaactccatggcgacatgaccagaagagggtttaagcctgatcttttcacatttaatactttattgcatgcttattgcaatttgggtaaaatggaggaaacctttcatctgttggatcagatgaaaactgagggccttcagcctgatatagtgtcatatggcactataatagatggtcattgtaaagcaaaggatattcgtaaagcaaaagaatatttgactgaattgatggatcgtggacttaaacctaatgtgttcatttataatgcacttattggtggttatggtaggaatggtgacatctctggtgcaattgatgctgttgagactatgaagtctaatggcatacaaccaactaatgtgacttatggtagtcttatgtactggatgtgtcatgctggtctagttgaagaggccaagaccattttttcacaagccagggaaaacaatgttgacctgggagtaattggttacacaattatgattcaaggttactgcaaactaggaaaaatggttgaagctgttgcatactttgaggagatgcgttccaggggtatatctccaaataagcttacttacactactcttatgtatgcttactctaaatctggtaacagtgaagaagcttccaagcttttcgatgagatggtgggctcaggtgttattcctgacaatattacttatggtacactaattgcaaggtgttctgaggtaaattcattggataaggatataggacatactgctgaattgtcctcaggcgctttaacaaaagatgatcgtatgtataacatattatctaatggaattaatgctccttggtgccagaaagaagctgcttccagtgttgaatgatgtgtggtcaaggaaccttagggcacaccttctttgttctgacaagaaccgtccaagaatgaacagggagtagggagaacatgtggccactgattctgcctttgatcttatgaattttacatctcctaacagttccctccaattcatttggtcatggtcaatctttgggagctatccagcaacagcagaggttgttctgaacatttctgctcaagtttacatgatcatccacctactgtcttgggtggggtatccaacag

SEQ ID NO: 68102 - DNA, 2324 bp, Oryza sativa
agaataaccctggatattaagctaaattgaaaaggatcccaataaaatacaacagaatgccacgaattgatcttagtattatggagaagaccgtcgccacagtggttccactcctttatacaacggtacaacctcggtccatgatcgcacggcagcacgcaagatgaaccagcacgaaaattgccaaatttctcgtatgcgctagtacatatgcacgcacagcacatggaccaaagttggactcctcttgttgaggctttggcccaggcagagactccatgcacgcacatgacttctagattgcaccgtgactgcgtgatgaaaaattgagaagcacaaccattcgctatttttccctttttcctccacgtgtcgctagactatttggctgccactcgaccaatcagctaccaggagacactgctattttttatatctttttgttcttacataattcggattttatttgtgagatcaggggagacacatggtctaataggcagctggcaaaactgccagcttgagattagttgactaagaaagtgttggacaaaacctgttagtgatatgtcctataggcaattatagagatgattgtatcttatactgtcacgtccggaaattcactagtaatttccgaactaatttgtgcattaaatcctcattcaggaatcagcggaggtacacaaactgacaatttaatatacagattcatcaatataataacgttacatacttacaaaagaaaagaaaactgcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacaacaaatatgcaagtgcacaggataccaaaggatgacataatatagggctcatttgcgaaagcagcatttagcaaacatttaagaattgcaaaacagtagagtaattaatcatcaatattaatcaacactgaacagcacatccatgctgatcaggcccaaccatcctgaacaaccatacccggctgcacagatctatctccaaaccaggaatgtaccattccaaaccaggagctaaattaattaccatcaattatcacattattattaatgagtagtgtgggactaatcacgaaagacattgttcgatccgcccataaccgcgggcacggctattcgaatagttttactctgctagaggtgtaccactgtacccacaagacacaaccccacaacatgtcaccatgcgcctcaataccaccacggtacctcggaaaggagctgtgacagtacccctcgcacaacacaatccaccacagcgcaccgttcctggatcataatcacccccttataaacaaggcatggactccccagcgacccccgtgggcttatctctgccacttctcagtctcgtgctccgcaatgaaccatgctatacaaaaagtaaagccgttgcccatgctggcttgtggttggcacggttaatgtttcacaaccgaaactcgtgaaccggtccttaattgttatgagcacgaccatcaaaaccatgtgctcacaacccaccattatcaagttttagttggcacattaattaattcacaatcacgattgaccatcgtgagctacaattaaatatccatcattaagtaatagtgaaacattatttatcccaatagtgtgctaatgtttctaagcatggctaagcaattatgtctaacatctagctgaaccaatatataaagctcaactagtcaaattatcacccaaggtataaagaatagagtaaggaatgcaaagtggtcataacaaaggaataggttcacaccacccggtgacattccaaaataaatgcacagttgaaataaatagagaattttaatataggatcaacatgctcaaaggaattgtgtttgggatctgtgtgacttgccttgcaataatcggtcttcaattagtcttcttgaacacttccgacgcactcatgaaccttcgcaacgacggaaacgacaagctatcacgcaaaacaaggaaaaagactaataaaaaccaaataaacaatacatataaagtaaacaaacatgtagatcatgattttagatgaatttagagacttgaacgacctcattccgatttcatatgaattaattacaaatttttacaagattaaattccaattaaacctattaaaggaaagactattccaaattaattaaacaatttacaaatgatttataactgagataaaagattaaaac

SEQ ID NO: 68103 - DNA, 1993 bp, Oryza sativa
ataattagtgaaactctggcacaaagcactccaataacgcatcacagacaagcacaccagttgcatcccttaccccagttcagagagcttgaggtgggcctcggcgtaatccgcaaagaaggcgtcctcatcctacatatcaggcaacaatcatctactttttaagagatcaacgatgatccatttctcttatttcttttattttaaaaaaaacaactctttagaaagaagacgagagaaaataatgcaaggatcaaggggtgtaccgcagcatatttctccaccagtggacggaaggctgggtcagccatgagggctttgtcacttggcagctgaagaaggccttccttctcgccactcacaagctcgctgttgatcgagaggagattttggttttcattctttagcatacaaggaaacaagctgtggctggctgtttatcaacagacaggatgcatctttaaaaagaatcagagatcacgcacgtgaagtaagagttgtcaaagatcaaagggttggacgtccaggctccctcaaagccagatctctccttgtggcatcttccctacagaagatgaagtgaagctgcatgaataacccttccggttacaagatatgagaaacacactagggcaattgcacaagtgtaccaaccagggtgtgaccaccagaaagagcaactatgtccttgtcactcaaacccatctgcgcagaaaagacctgccttaggtggtcagaacctggaccaacagccagaagaccatgacatattagttatctcgcatccacaaattggcacactgttaattaaagaacacacaggtaacatgtatgctccatataagaaagaagaataaacaggaacacaaaacaaactttagtaatgtggtttgcataaacagggttggaaaattttagtcttatgtaggttacacaacttacttaagcatgaaagaattctggtaatggacttgcaatatgaactactccatcagtagcacatacaaatgctggtcatagatctagaaaatttaatcaccaacacattgggaaatgcattgtcataggggtaacttaatacagaggaaatcttaataccttgtgtggcatcaggaagacggccttcaggaggaggctcaggcttgtcctagaaacaaacacatcacatcatcaacattcacaagacagtggagaattcagggaaaggaaacagcggcgtacaagatgacgaaagaaaagaattgacttaagaaaaataccatttgcatctaccagaagaagaaagaagaaggggggagagagagggagagggtttagggatgggaaatgtgattctgacctgcctgcccggatggaaggggacctcaggtccgccggtgacctcgacggccacaacgccagcaagctgccaatagagagggagagactccaattaagaggttgatgagttgagaggaaggaagggaggaagggagggaagtgaaccttacctggtagaagtcggcgtaggagaggatgggaagttggtccttgatggggtcgagaagcctgacggcgatgtcgaggccggcgttggcggcgtgggactgctcgccggggttcttcatggtgccgaagggcccgccggtcctcgacgacacatcgaaggtgccagcagagtgccacctgcagccagccagccactgcaattcaacatctactcctcctactctatcttctggaaattaatcagtagaagaagaagaagaagaaagttacgcgaggcggagcatgagtggggcgcagttcttctcggcgatgaggccgcggagcttgcgcttcgccttgcccacggccgccaggtactcatcgctcaccgtcgggtacgacttgctgcccatgctcccctgcttcttcttcttcccaatccgaatcaatcaatcaatccccaactcaactcacctcacctcaccaaggagggatgagatcttcttactagtatataaaggcgagg

SEQ ID NO: 68104 - DNA, 4193 bp, Oryza sativa
atggtttgcatgtaaatcgcgagacgaatcttttgagctaattacgccatgatttgataatgtggtgctacagtaaacatttgctaataacgaattaattaggtttaatagattcgtctcgcagtttacagatggaatctgtaatttgttttgttattagtctatgtttaatatttaaatatttgtccgtatactttaaaaaaatttggcacacgaactaaacacagcctgtatattatcccttattattattattattattactcccctacttgacgacaactagtactttttttgcggggagacggcgactagtattgtactccttttttcattacataatcgtatactccctccgtttcacagtgtaagtcattctagcattttccacattcatattgatgttaatgatccgtttcacaatgtaagtcattctagcatttcccacattcatattgatgttaatgaatctagacataacatcaatataaatgtgaaaaatgctaaaatgacttatatttgtgaaacggagggagtaatcatcatcatgtaatcagataagccaacggatctatggtattacacttgcacggtacctgccactgccagcaaggcacttcctacatcaccataatgctaggtccatccgcgtttcacgatttgcgctgtcacagctcttcaagtcacgttaggcccggttagtcctccaaaagttttttcgaaaaacattaaatcaaatctttagacatatgcatggagcattaaatatagagtaaaagaaaaactaattacacagttaaaaaggaaatcgcaagacgaatcttttgagcttaattagtccataattaaccataagtgctacagtaattcgcatgtgctaatgacggattaattaggctcaaaagattcgtctcgcggtttccagacaagttatgaaattggatttttcattcgtgtcaaaaagggagaatagccaatatggtccctaaagtttcgctcctaggtcattttagtccttaatctttcatattgtccaaacaagtcctttaaatttgtcatgtgggctgatatagtccttggtcccaccaaaatcaccacatagatatgccatgtcaccttactatgcaaaatatatatgatttgtccaatttacccttacatatatcatagaaaaacaaaaaacaaaaggaaaaatgtaagagcaaaaatatacctcaaaagggtgaaaaaaagagatgtattttttcctatggttatgtctaattcaaccttatatttatttttctatgatatacgcaagggtaaattggacatttcatcatagattttgcatgaatgatgacatggtatatccatatgataattttggtggacccaagtattattctagaccttatgacaaagtttaaggatttctttagactatttaaaaggttagtgactaaactgatttctacaaagaaactttagggactaaattagctattctcccataaacaccttccgacatccgatcaaacatctgatgtgacactcaaaaattttcattttgcgaactaaacaggcccttaatctacttaaaaagaataggctcttccatgactcatatgccccggtttgaaacagttttttattcagcaaattattattaaaataattacttgataaatcaaatataatttacagcacatggtttggtacaaaagtttcttttaagaatacatatttttagagacgtggagaaaacaatggtccccatcgtttggcttatttcctaataagccaaaacggcttattaggaaataaaaataaatttgtaggtaaaacttttataaatatgttcttggtgacttaaaagccaatgttgaaaaagaaactatgttgaaaatatttcaaaatcaatctcaaaattaagcttgaaaatttaaaatttggctttttctttggctgattaggccatccgatgggagccaatatattgtactaataatccaatgaagtagccagaaagaacgtgtggcttcctttcctctaaacccccctataaagtgcaaacaactatcatgtcgactctccctcattgtctattccctctggatccgtttggttgggtaaagttttaggaggggttgggtttagagggattagactattacttattctgtttggttgggattggttaggagacatgaaatttcggtgggatggaaatggaaaattttctaacacatagataaggggtggtaattgtcctcctttattttgcctaaactaaactccttattgttttctaccacctctaccaaacaagagattgaaacttaaaaaaataattaaattctcatgttaatctcaccgtcaattctctcgtcaaatcgtcttccctcaagttaccaaacaaaccatatgtcccataaaaaataaacctagcacaggtgacttcgatttaatttttttacgaaccgaagagagtattttgctaaaaaaaagtcaaatcttattgttgtcaaggcttttctttttcatttttttttgaaagtcctgccagccccaatcttttcctttctctttctcgccagctcccacaatcctttttcacgaacgcgcaaaaggattgcacgtcaatatattagaagaaaaagaatttttgttacacaacaccgacttataccaagggaagagagaaaaagcaaagccaaaaactgaagcccagctcaatcagccagaacaacttacgcaagggaagggagaacccaaacaaccttggtgtcttagtacaaaattatccgttatttaatatagcttgtagaaaatcaataaaatatgaagtgtacgctaaattttctactaaagccaattgaaaacatttggatcgattttcaattttggtaaacacgcatgggcacctagcagttgctatagtagtcggttcaacgtcctaaaaccagacccctttcttaatcgaccgcaaaagctgacattgccaaagataggagtatcgtccagcaacacggctaccaatcttttctttaccctttctctactagtaagcggtgggttctcagattctgcaacgtcctggcaccataaattaaagcgctaaaccaagccattgcgttatggacaatgcaatgtgatgaaccattttacgcatatacaaggctcttacttgatccattgaaaaatccacaagacagaacgtgtcattcgtggttcgtgccacagtggttctgacgaggtttcagccccagcaaggattcccacaatagtcagctacatttgctcctgaacaatgttgtaaacagatatcaggatctccacactaatcaaaattatgataagccattccagaaaatcagacttcctgttctgaaggatctcttgaagaaaacgaatgttgtgctgcaggttaaaagtacggtgaataacataaggacacaatgcaaatatttacaatgcaagtaaataatcaagtgaattataaaacgttctacattacatgagccttacctcaacaaatttcaacttaaaatcaaggttcccaaatctttgggttaactcatattcatctcgaaggtattcccaaatctgagcatagtttgcgttcttccaagcaatgtctgacctggaattgacaaagttctacagtaagtatgtgagaacagataaagctttctaaatagtggcagcaaagataaagtttaaatgcagaactccaaaagattgatccaatgcatgtgagacagtgctgggataaaaagtaataagactgagctaacaacctcagagaagcaatacagctcacacaccgactaccaaacaacagacctaattccagtggacaacaaatactgtgtttcgcatgattctggcatcccgctttaggagctttgcattccaaattaatagtattctaaaccagtttgcatggatacaaataaaaatgtctgaacattgcatgaaataaatagtactctagtctagcaggataaggcaaatgcattcacaaaatatgtgtatttctaagtaatatgcaacagagccaaacagcatgcaaaaaaatgctcttaatatggggaatgaaagaaggaggtttattaaatacatagttctcagtatggtgttctactcacctttcaaaaagcccaagcttgagaataacatctgccaggttagagttagcctttcctacc

SEQ ID NO: 68105 - DNA, 1723 bp, Oryza sativa
agtttggttccttggtccttagttggaaaatcaaaatgtatttcagcagtgaataactccttatccagatatttagtcatttttagctcattcaaattgaccacatgctaccttgtaataagcaagccaatgaagtcaagccaggatgtgaataagaaagcaaatattgtaagttacagctatgtatacattgcaaatattgtaagtcaagccaaacactgctctaaagttgtaacttacaactatgcaagtttgtttgccagctgttgatcaatggaaacagttaaaatttgaagtgtagcctactatggagcagtgctgcggaagacggatgtcggacagagagggtacggccaaacgtttaatcgttatgtggataattaatcggaatttgatggaaatttaacgttttataaatatgagtacatagttgataatagtttgccattttttgagatgtaaatgcatattgaacatattcttactatgtttaaaatagaaccaccatgaagtggcattaattcaacatatattaaagttcataatgcatagctgtgcatcaaacagtgagctgtgggtgggtagttgtcatgggctggggcgtgtgatcttgcccgattatacggacgattagtcaaaaaatgatggattaatcagtaatgatggtgattacatgttcaggaacgactaatgaagaccgtttcgcggacgggagctcgctgactccattttaacagttgtatcaatcgttttccacgacactgctatggaggcttctttcagcatggatatgctctactcaacatcatatcaccatctcacatggactaggaaaacagcaaatatccagtgttccagtactaacttctgattaatcctcaacacaacattgacatgataaggaaggaccacagtggccaaataggacaaatattgaagcactctaccaattcaggaaaaaatgagcatgtcttgagaagaacaagggcttaccatcttttctcatctctggaagtaagcctgatgcatgcttctcaacaattttcaggtatccatccgcttcatgatcagaaacattaaacagcacaatggacccatattggaacaccaccatatagtggcaatgactttcatctatgatgccagccttaaaaccctgaagaaaacacgcaggcgagaagcattagtgcaatcatacttgcatcgttactacaagcaagcaagtactttctctagcatggtttaataaaacaaaaaaagaagcagtcaactcattaggcaaaagaaaaaccaagttgcaaggacacttgaacataaattccggccgcattcagcccaaaaaatccataaaagcaaaaggaacgcttgtgaagctatgttgtataccactaaagcatgagtatgttatcaggaagagcagagtggagactgtctccattgaactaagcacaaactaataatggcattacaactgaacattgcattaactgaaaatatgtcattacaactgaacattgcattaactgaacaattttctcaattatagcaattccagggatagcattccaccaagttgagcaccggacatggaattgtgcgaaaagaaagagtagatggtgcgattggctaacctctgggtctcccttgacatcgtagtacctgaggacgacgtagttggtagcacgcgaagtgggggggatgcattgaaggaattctgggactg

SEQ ID NO: 68106 - DNA, 20771 bp, Oryza sativa
ggcgggggggccggaacaccgagggcgaaggggaccgccctagggtttggagggttctacaaggggcatgctggaggaggaggaggggcctcagtaggctcttctggaaggttcgaatcctacacagctccatcatctctcacaaatcacacattacactagtatttttttggagaagaagaagaagatatgatatgagtatgacggcggcggcggcccccctcccttcctgttcctgtgcgctttgtggtggtggatcgagggttagttcaaaattttatacatgagcaaggaggtttttgcaaaattaccagatctcacgtggcatgcatacaaggtgaaaccaggcaccagcggtggaaggagcaggcacgcgacatagtcaaacgcgagattaacagtgagattaccggcaaactgtgttttcctgatcgcacacgcgctcacgtggagccgtaatcgcaagacgacaatgtgcaaattaaacaaggagaccaaaaaatttttaaaaaaaaggagaaaaagggtacggttaggctggttattgattgatgatatgtcacacgcacccctttcctattacagcattgtgaaaactcttttaatgtttttagcttccattactgcccacgcaattgtaacaaagtggctcatgctttagcagcctatagctataatagttctcagacgactcagttcagctgggatggttttcctccagatgtggaggaggtggttgccggcgatttagccgaaccagtggtataatggaatttaatgttcctctaaaaaaaccctgcttgctccaaggatgaggtggatcagactccacttccaaactactctaatccacttattaaaaatttccaacttgtgtttcaaacttttatctctactagaaaaaaatgtccgtgcgttgcaacgggtgaagactattttaatttttattatttttatacgaaattcactatgagaatttgcttggatatgtatttttctgaaaaaatcatgagctgcaattaggagtccgagtccgatcatctcaagttagcatgcgagtttttttaaaagagatttcttatgactcctgtattttataaaagcgaacgaacttaaaacctgactcaaatacggatatgtatctccaaatgcgaacgaacttaaaaaccgactcatacacggatgacgtactaaagtaccggcaaaaacatcttcaacttttataatagtagagatactaaaaaaaatatccgtgcgttgcaacgagtgaagcctatcttaatctgtgggaattcacttggatattgtttttacaagttagcatgcagttttttttataatagattacttatacaactccttctatgtgccagggttacggataagtcataccttctatcctacgacttatggaatatacagataaggtgtaccttcatgtacacggatcgtttccttgtataccatttggaatccattccaaattatggaaaatatatctacgagtctaagtgatttccaaaatcctactcggaagggatagaatttcggttacaccgtaccagatccaatatcctcaggtctttcttgggggtcaagatgattcatggtataaaagggaccctcggggaggggtgaaagggcatccaatttaatcgccaacacacccactatagtttacaaagccagagtacgcggggccaaatcgctgggagatctcatcgaaaccctcgaccacgatctcgttggtatgatctatttcgactactctctttgtaatatgttcttgtcattataaatcccatataaactggactagggctatgacctgataaggggcctgaaccagtataatccttatcttttgtttgcttgatgtcgtactacgtagaccctcattccaatgtaccccaacactctattcatccggtctgcgagtatcactcgtcgacactatgtttccaaaagagaatggaattaaaagctgactcaaatacgaatatgtaattccaaaagtcaataaaaacttaaagaacgactcaaatacggatgacgtatcaatttaccggtaaaaacatctttaatttttataatagtagagatctctaatttttgtaatatgtgtggtattcccatacataatacatataaactagagtatagttattactcatctagaggacccgagctagtataaatacatgtcctttgtctgcttgatccgatctcgcatacacactggttctaacgatctccatactctacaaatactacttgcggtgagacgacaaaccttgttgttatagctaaatatttcgtgaaccgcattaagttcaaacggattggtcttgccttagatcgcaagttgttcaaatgctcatggataacgaaattatttgagtaaatttcaaagaactactactattttgtcaaaagtatcagttatgacatttcaggtaactggaatagtggtatacaattgtatcgaaaagcttctactttatgtgtctgacaagttttggcccatgtgtcatacatatatatggggaaatgctgcgttttttaaataaaacagttctctattattcccattttttttgaaatattcaactaaagttatagcaaagtgatagttttgaccaaataattgcaatttatgaaatttactcacatcgttttgttggatgatttttttattatgtttacaaatcccgtctctcttctatctatatatgtggttacttaaccacaattcgtgggaatagaacacatttcctccaagatagtagataaggatgcagttttgtgctcaagcatgctaggaaaaagctaatgtcatgacaacgagttcccacttggagtgttgcctagcctttcatgagattccattcattttatgcctacttatgttattcctattgatgacttcatggtttactattggttttgtgtattagggaccaattaaatacatactaatttgtcaatctgggagaggggggcattattaatatcgatcgtatcatataccaaaactaacacttctgtctaatgttttggtaagcgccatcattggacattcttcttggtgtaatacttaagataattttcaatgaattgctccctcatgttaaggatatttgacgttgggagtattggttttagtactcatagtatatttagctgtagggagtattggttttgttttatatatttttagggtgttcctctaaaatcatacattagtgggataaggaacaccattttttgaaaacgtactaaaagtggatttcactggcctagatgattcttggaatttcctcttcttgttctatcaacaagtggctcatggttacttgtacgtagcccacttaatatagttcaaacttgtactcatgttttgactagcttgagctcatcatgttaccaagttcatgctctatgtttatttgaatgtttttaggtctcggggaataaattggttaaaacacaatgtttatgtgtttgtatttctaactaaaacgtattgtaaacttaaatatcaagttgtggtgtttcaaatgaattgtggaatctcccatgaatgtcaccttagttgtgctcaggtttacttatgtatgttaatgtcacttccagaaattcttgggcactatatattaggctacagcaaatgaaacttctcttaaaaagtgagataccaaatgaattcctatagcttcattttttaaaagagggggctcaattttattttaagaaacaacaaaatataaacatttacataaccgcatgtttgttcatcaatgaccaacatgaatgagcataaagagtagaggcaacagaaaacactagtgcgccaccaagatatttgatcaagagaagagttagcaacacataaaatgtctatctaaagaggagttaccaaatcaacatccatttcaccagaattatctaagaaacacattccattaagcctccttgtcattggtgccaaacccatagactttctaaacacgtcctcaatcacttgttagattttttttttgcacaatctagcatctcatagcgttttccttcaaactggattaatgtttatgtttgtcggagatatggacccggaggtatgcgaaatgagggaaatctaccttcccatcctgccacgtgtccctacagcctggtcctgcccccgcattccgcgaaccgcaggagcagccgagggggtcggggcctcggggtgccacgtcatgcccctcgggcccttgcaccgctttgccccgaggccctcgcccagccgccatttggcagggggagcgagcgaggagggggcccaggctgaaccccctttaatgcgcgcagcgccccaactgccccctgtcgcatttaatgcagtggggtagacgtgcggcgtgctaaactgacgcgcaatagtcaagaatgaccggtctgtgaccggcctgacgccggtcacgtctgactggacggacaaccgtgctcccatgtcgcatctgcttccggcggagtagaggtaggtatgacccgtcccatcggagggtcattcggacggcggccaccacaagtcttcacccattaatgagggaatgacagggttgtcccccgtgtcaggcgagggacagcgctgggccccgctcaagggcaagctgtggtttagcttccaggcgaaggcacgggtcgagttccggtcaagatagggtgggtccccacccgaaagaagagtaggtagaggcggtgcatgtggtatccccttaagatataaaaggaggacattgcccaccgagaaaggggacgactctcagtgaacttgagctctaggagaagagtgttctcctgagtttaggaacccttgtaactctcagtctaaatcccatacacaggagtagggtgttacgcttcatagcggcccgaacctgtataatttggttgtgtgcgagctagctaggagccttagggacagatacgtgatttctagaggcgagcttcttcccccggctgaactcacgaaaggggggtctcacgacctcccgctagagaggatcatccctcgacagctggcgtgccaggtagggggaagtcgcgcgctttaaagagaagtcgtttccttccgtcccaagtttcccttggccctcgacgatcatggtcgaggtcctggaggaggaggcggtgatgttcacccccactccgtctgggagtgaggatgctagcgagagctgcggccctcgtcaccgccgccgcaactctccaactcctccccgccgcgatccctcgcggagggaggaccccacccattcgggtggttcggccctctccccgcccccgggcggagggaggccacaacgcgtcagggcacggcgccgcctcacttatggtgacggcggctcgccccgaggcgcgcttcaagcagtgggtgtccttctgcggcatccccccgtgaactcggagccagagacccctgtccagcgctggttgggcgacgtggccaacttggtcactactgcccagtggcagttggccgcgggcggccgacccgccgtcaccggtacgtcgcgtacccccattaccctctcctcgtcagcaaggaggagggcccgtcggtcctggaggaggaggcggtggtgttcacccccactccgtctaggagtgaggatgctagcgagagccgcggccctcgtcaccgccgccgcaactctccaactactccccgccgcgatccctcgcggagggaggaccccacccattcgggtggttcagccctctccccgcccccgggcggagggaggccacaacgcgtcggggcacggcgccgcctcacttacggtgacggcggctcgccccgaggcgtgcttcaggcagtaggtgcccttctgcggcatccccccgtgaacttggagccggagacccctgtccagcgctggttgggtgacgtggccaacttggtcactattgcccagtggcagttggccgcgggcggccgacccgccgtcaccggtacgtcgcgtaccctcattatcctctcctcgtcagcaaggagagggcccgtcggtcggccacggcctcgaggcggtccacggatccaacatcgttgggggcctcaggaagccggaggcgtcacgacggtctctacggggagcaggacgctcgaatcaatatcgagcgacgccgggacgagcgccgagctgcccgcatgggggaaggcgcctcctcatctggagtgccacattcctcctcacgaggcggccctccccccacgctcacccctggagggacaggttgtagggccttcgtggcgagtctccggaatgtccggtggcccccgaagtttcaccctaacctcacggagaagtatgatggcagcatcaatccctccgagttcttccatatctacaccacgatcatcgtggcggcagggggcgacgaccgggtcatggcgaattatttccccatggccctcaagggtcaggcgcgcggctggttgatgacccagccccccgactccatctactcctgggaggacctgtgccagcagttcgtcacgaacttccagggcacatatccccgcccaggagaagaggcggacctgcacgctgtgcggcggaaggacgatgagtccctctgctcgtacatacagcgcttctgccaggtccgcaacactattccatgcattccggcccacgcggtcgtttatgcatttcggaatggcttgcagcataaccgcatgctggagaaaatcgctttcaaggagtccaagaccaccgctgagctcttcgagctggcggacaaggtggctcggaaggaggaggcgtgggcctggaactcccctggcatcggcgcggcggctgcggctacccccgagtctattccccgctctaagcggtgagataggaggggcaaaaggaaaccggcccgctccgatgacgagggccatgtccttgcggctaatgggcccgcacgggccccgtgcaagggaaaggccaccggcgacaagccgagctccactgctccatccggcgagggccagtcggcagacaagtggtgctcagtgcacaacacttatcggcacagtctcgccgactgccgctcggtcaagaatttggccgagcggttccggaaagccgatgaggagaagcggcagggtcgacgagagggcaaagcccccgcgaccccagccgatgaccggcgaggggaggccaagaagaaggcccccgccgatgatggcgatgacagcgaggatctggagttccagatacctcagggaaccatcgccacgcgcgatgggggggggggcttgcgctcacacctcccgccgaggcttcaaggccatgcggcgagaacttctggccaccgttccaacccacgaagcggcttggaaggcgcgctggtcagaggtgaagctcacctttgaccagagcgaccatccgacaatgctcgctcggggtgggaagttgaccctcgtggtctccccgaccattcacaacgtcgggatgaagcgcgtcctggttgacatgggggggggggcagcctgagcatcatctccccagctgccttcgacgcgctcaaggccccggggatgaagctccagccgtcgctgctgatcatcggcgtgactccgggacacacgtggcccctcggccacgttgagctcctggtaaccttcggcgactccaccaacttccgtaccgagcggatcgacttcgatgtggcggacctcaatctgccctacaatgcggtcctgggcagacctgcgttggtgaagttcatggccgccacccactacgcctacctccagatgaagatgccgggccctagtggtcccatcaccgtctttggtgatgtcaaagtcgccctcgcctgcgcggagcagcgcgccgacaacctggcggtggccacggagccacaggccctggaggcctccgcgtcccgcgcctccaagaagcacctcacctcggctgacgaggtgcccgtcaaggagatcccccttggagatgatccatccaagaccgccaaaattggcgggaccctggatgccaaataggaaagcgcgctcgtctccttcctgcgggcaaattccgatgtcttcgcatggaagccgtcgaacatgcccggggtccccaaggaggtgatcgagcaccacctcgccgtgcggccggatgcgcaacccgtccagcaaaaagtacggtgtcaagccccggagcgacaggccttcatctgagaggaagtggcatggctcctggaggttgacttcatccgcgaggttatccatccggagtggctggcgaacccggtggtcgtcccgaaggccaacgacaagctccggatgtgcatcgactacacggacctcaacaaggcatgccctaaagatcccttccctttaccacgcatagatcagatagtcgactccactgcggggtgcgaccttttgtgttttctagatgcctactcttggtatcaccaaatccgcatggctagggaagatgaggaaaaaactgtcttcgttactcctatgggcaccttttgttatacaactatgccttttgggttagagaatgcaggccttacttttcagcgtatgactcgtattactttgagtaatcagatagggcccaatatagaggcgtatgtcgatgacctagtggtaaagatgcgccaccaggacacgttgttgcaggatttggccgagactttcgacagtcttaggtccacacgcgtgaaactgaaccccgacaagtgtgtattcggtgtgccggcgggcaaactcctcggttttctagtcttctcctgaggcatagaagctaatcccgagaaaatacgcgcgatagagaggatgcgccccccagcaagcttagggatgtgcagtgcatcactggatgcatggccaccctaagtcgattcatatcgaggctgggagagagggcgctgcccctattcaagctcctcaagcgctccgggccgttcgtgtggacggaggaagctgagcaagctctcaatcagctgaaagcttacctcacctcccccccatcttggtagccccggggctagaggaaccattgctgctctacttggccgtgaccccccatgtggtgagtgccgccctagtattcgagcgtgaagagaacggaccggaggcccccttgactcgcgatggcccttcgtcccccgaagacccgatgcccgaagcccccagcccctgggaggaccccgaggcccccgtgggaggaggggaggctttggcaagtggtcctgaggcatatgatcctgacatgattcgagaccccccggggcccctgagcaagggcgccccagatcatctgcccctgacaacacggaccggccccaccgaaaggtgcagcggcccatctactttgtcagcgaggcactccgagatgcgaagacccgatacccacaggcccagaagatgctttatgcagtcttaatggcctcaaggaaattgcgccactattttcaagcgcatcgggtttccgtagtgacatcctaccctctcggccaaatcttgcacaaccgagagggtaatggtcgggttgtaaattgggccatcgagcttgctgagttcaacctgcactacgaaccacggcacgcgatcaaaagccaggtcttggctgacttcatcgcagagtggaccccagtagacgaccctgttccgtccaacgttccctccctccccggagatggagaggacccaaacgccaacattcgtggcgggcactgggttatgcatttcgatggctccctcaaccttcaaggtgcaagtgccggagtcacgctgacttcgccaagcggggacgtcctcaaatacgtcgttcggctcgacttccgagccacgaacaacatggcggaatacgaatgactcctcgcggggttgagggcggcggccggaatgggcatccgccatcttctggtcctaggcgactcccagctggttgtgaatcaagtatccaaagaataccagtgcaccgacccacaaatggacgcatatgtccacgaagtgtggcgcatggcatcgatctcatagccgacacccatcagggtgagtgcggggcccattcggcctcacgcactttggtcggtaaagccttccgacaaggtttttactggccgactgcgttgcaagatgcccaagaatgggtccggcggtgcaaggcatgctagttccacgccaagcaaacccaccagccggcccaagccttgcaggtcatcctactctcttggcctttcgcggtctgggggctagacatcctcggaccattcaaagcggctcgaggcgggtatcaacacctgtacatcgccatcgacaagttcaccaagtggcccgaagcttatccagtcgtcaagatcgacaagcattccgccctcaagttcatcaggggcatcacgtcccaattcggagtgctcaaccgtatcattacagacaacggcacccagttcaccagtgagctgttcggcgactattgcaatgacatgggcatcaaattgtgctttgcctcgcccgcccaccccaagagcaacggccaagtcgagcgagccaacgccgaaatcctcaaaggcctcaagaccaagacgtacaacgtcctgaagaaacatggggattcgtggctcgaggagttgcccaccgtgttgtgggcaaatcggaccactccaagtcgcgccacgggggaaacgccttttttcctggtgtatggcgccgaggcggtcctaccttcggagctttccctgggatcgcctcgcgtcgcgctatatgatgaggccaaccaggatgatcttcgccgcgacgacctcgactatcttgaagagtggagaaggcgcgcggccctacatgcggcgcactaaaaacaaagcctgcggcgctaccatcagcgccacgtccgggccccgtcactgcaagttggcgacctcgtcctacgccgcgtacagtcgcgtctggggctaagcaagctctcgccaatgtgggaagggacatacaaagtgatcgacgttccccggccaggctctgttcgactaaccacggaggacggcacggagttgcctaacccctggaatatcgaacaactccgtcgcttctatccatagcgtcgcagttttttgctttccaggagctcgggccaacccccgcacaacccctcggcttgtgcgggcttggccgggggctaccactgtgaattactttgtatctttttccctttccaagcaataaatttttccacctaaagtggaggccgttacgcgccctttcttctcactctttcctctggcttgtcctggttcaaaggacaattcgcgcttactctgaaccctaagtgccgttgggcgacctaaaaaccgctgaaagggagcccaaacgcgggccgcgccccgggttgcgccgaaccccgggagctcagaagggcctacacacggccgtccccgacccccggtcgtcgtagcctcggtctggccagtcccgctgggcggctccctcgggaccacggaccgagcgcggatttaccttttcgcaagaacgagcccgagagggggatggggtaaaaacggcatttcgatcacagggaggttaattatatacttttgctcttgttttttcttctttccgtgccgcaggcattcaagggagaaagcaaaggggtagaaaatgcgaaggggaagctttatttatagacaagacggcacgatagcctaaagacaagaagtgtctgctgcagacacacaacaaaaggaaattaaaagtggggataatcatggagtgcccgggcccccgaggtcggcgccgctgaccacgtcgtcccagtcctcgccatcggcgtcgtcaccaccggcgtcgtcaccaccgtcttcgctcccgttctcctcatccgaggcaagcccgaaggtgaactgaggggccgacccctcgaagttagagacgatcgcgtcggccgcctccgggacttgctccagagcccttgcctcggttcccgggggaaattctcaagtgcgcgccatgggacgaagtcgggatcacgggcttggtggctcgtgaggaccagttccaccgtggcccgcgccatggaagccgatgacgttttcacgatgtcgccggcctcctcctccagcctctccagatccgccgccagcccgtccagccggagcgcgagtgccggctgtgtgggccgtccagccggagcgcgagtgccggttgtgtgggcgggagcttcctatcccggcgcacggagatgccgactcggcgccccgcgcgctccagccgatcgacagcatcggagagctgcccggggccgatctcgttggtaaggcggagggtcgcgacctccctagcctggtcttgcaccaggagctctaggtcggtaagagtgctctaagccgcggtaagctggctcaccaactccgcgccgccgggctgcccgcccaccgctaggtccttctcccgggcctccagctcagaagccctcgccgccatcgccgcgcactcggcacgagcactctccagatgccgagcctcgcgcccggcaacggcctcctcgtgtttcgcgagttgctcgcccagctggcgcgaggccacttcacggcggttcacctcggctttgcactcggcgagtgcggcatcccgttcccggcacgcctcttcccggagccatagctccttcgcgcgacgggccgccgaagctttcacggcgagggtggtccggtcacgctcggctgcagcctcctcacaaaggcgaagggaggcctccgcctctgccgctgttctctcatgggaggccaaggtggactcccgctgatctagcaggcgcgctcgctcctccagcgccttagcccgcctctccagctcctgggctcgctgcgcctgctcctggctgcgcgcgtcttgctcgcgctggctctggtcgaggacctcgattcgccgacgaatcgtggcctcaaactcctgcgcggagcgggcacgctcatctaaggccttgcgttcagcctcgagcgccgccgtccgagcccgcagcgaggcgttggcttccgatacccaccgctctcgggcggcagccgcatcgaggacaccgcgggcgtccttaaccctcttcgccaggtcctcggcatgggcctcgtaccgtaggcgaatgtcacctagctcttcattcaggacgcttgaagcgatcagtgctgcctgccgctcttcctccgtctcacgcatgacggagtccagcgtctcctcgcgcacctggatttcagctagttgggcttggcgcattttgcgtcccatattcaccatgtcgtccacggcgcggcgcccctcgtcaacctgcgtgcggtccgcagcgagctgtgcctactctgcctccagggccgctcgttcttccgccagggcttgaacttgggcattgagcccctctcggacggtggaatcggcggcggcgagcacctgcaggagcggcttcatacttgctagagtcggagaagaaaaagttgcggtcagtccatgggacgatagagtgctgctggatcccccgcgagactgggggcttctctcagccccatttctgcgaggccatccccgaggactccccaagtgcaagggagagcggctgttcctctcgccccccacttcgggccctcgggtagattcggccttgttctcaggctcgggcccgcccccagtttcggcctcggcctcgggctcagggccgcctctagcctcggcttccgggccgcgacctccctcgccccctgctcccgggtggcgctccgcatggatccgggcctcggagtcgcccccgggagagacgccgccgccgctatcgctcgcggcgggtcgagtcccggctgaggtgaacccagggtcggacccagtgtgtggcccatgggccccgccgggaggctatgaaggccccgcggccctggatcggccaagcccgggccgctccgatcgttcggactttgtcccctgcaaagggtcggaccccgagatcccctgggaaggaatctcgctgcaaaagaactctgatcgcgttaacgaagaaaaagaagaggaaggaacaagagaccgagatgagtaaaaagcaccgaagcgagtgccggcagtcgtacctgcgaggagggcgattgaaagtccacttcgggggctcaatgaagctctcccgacacggctccgtttgacctatcttccggagccgcttcttcttccgtccggcctcaggcgcggcggggcgcttgtggcccgccggcggttggtccgccacgcgcttggcgccccctccgcgcgggggagagggcggtcgagatttggacatcttccgcttcccttttgggtcgctggctgagtcgaccccgggtccacggcttgggctgggtgccctagagctgccacccccgccggggccgctggtccgactcccgcctgcggtcgcgccacagccacccacgccgacagcgccaccaccggtaccgccccggcgggaccgactcctgccggtgctgacggtcgacatcacccaggatactctcccggtcgcggtcgctgcagaggggaaggatcccgtctagaatcagtgtttgctcggcggtgtccagacccaacacccgccgaatcaccgtcttcgcgtcctcctcgccccaatcccaacgcttgcccacatgcgtgcgcatggggtcgttgggtccagtgtactcccacgcgccacgtgatttatcttggagaggcgcgatgcggcggcagaagtagtcgccaaagaccattgcccccgtaaggcccaggcttcgcaggcccctgaggcgatcccgcaccgcgtcgtactcctcgcccaactccgaaaccgctagccacgtggcggatcgttcgagagggccagcgggaagccgaagttgcgggtggtccggcagcgcggtgtagaaccagtccttcttccagtcctcccatttcttgcggagatgactctcgatgtattgccccgccgtgcctggccagggctggaagtaacatccccccaccaccgcaccttgcagcagttgcgggacgaagaaagactggaacagccgcatcgtcggccgcaccccgatgaacatctcgcatagatgcgcgaagatggccagcgtcatcacggcgttgggtgcgagatgcaaggcatggatttcatagaaatccaaaacctcgtggaataatccggagaatggcgggatcaaccccgccatagcaaaggacaggaggtgcacagatcgctccgggtatcgcggccgcggccacgactcccccgccctcacggcggcgtcttccggcataatcttgcgggggagactaagatgcctatccgccgtaatgcgcgatgccgaaagcactgcgtcgccagcatcttgagccatgatgaccggtggagaaacgacgaggggcttggcgtgcggaatagcgtggagtggcgagaatgttagggcttagggagcgagtatgcgggtgagcagttggcaaaaggaaggaggcaaagtccccgcctccgtatccttttatccttgcctcgcccgcgctcgccttctcgtttcacgccctcacggttgcccccatgattctcgcgcctgcagttgcctcatcgtttatcgcgaccactcatcacgtcgcccactgaatcctcgccccgcatttagtgcgcctgtcaacagcacactcggtgtagggcgtgcggcggtcacgggcgcaatctgggcgaactgtcaccagtaccgccgcatacgtggcgggcgagggagttgaggtgtggtctaaccgaccccctgattttcgcgccttaagcatcctcatcatcagcgcggtcagtggcggtcaaaccgctgttgtggttgatacgccaacccggccactcggcggcatccgcttagattccctgccgggcccacaaccccagcttgggaagtcgcgaggcaccacatcagaccgacctcaggaggccaatgtccgatgtggtgccgggggctactgtcggagatatgggcccgggggtatgcgaaatgaggggaatctactttcccatcctgccacgtgtccttacagcctggttctgcccccgcattccgtgaaccgcaggagcggccgggggggtcggggcctcggggtgccacgtcatgccccttgttaacagtgaaatttggtaatcggcaaagacgtcatcggcttagaatcattatcggctgcagcatctcggaatcagccgatgggagttataaagtcgccaatagtcggattcctgctatattcgattaaggaaatcaatctattaaaggaagcttatccctaagtgaccgagtttaaagaggatgcggcatggtagtttatctattaattaggaatagtttgttagtttccttttatctttaggaaagtgtgtttagtgtccgataaggactttatattttccttttatctttaggttagtttctttcttgtccgacaaggacttgtatcaacccatgggtataaatatgtacacccggggtctatgtaatcgattctcacgatcaatacaattcggcgcatcgccacccttttatttctacttttgtttttacgttccggcggaacttggcacccgacgcggggctgcatcgtctttgatctccggcgaagggataagtccaatgttctgctggcccaggccattgtatcgtctacgtcggcgttgttcaaggctgcatcagtacattcgacctcttggattgctctggtttggatgatatacttgcctacctatttatcatatgtctctgttaatctagtcttagcatatcgatttagctctatcggttgcttctcgttttagggtttctgccggtatcggctaaatcgtgttgctagattatattagcttagacatctaccaccctgaaaactcagcaacggcttgattatctagatattatgtttcttttcatacttagtgctgcatcagttaagtttgatctactaagtcatgcttagaaccataatctctagcctgcttcttgattgccaataagggtatcatcggggtttcagccggtgagttatctggacgttgcatcggctcataaggattgcatatacatataagtaggatttagccgatgacaacaaaggtttcactgtttaatctaatcttatggatttcatgacatcggacctccagccgatgtgtgctttgaccttcggatcgatgcttatttatcatatcattatttgtcgattggtttatactggattatattgttattttattacatcgttgttagccgattgcctttatattattatctacattggacatatagccgattgcttaaaccctatcgctatcggctggtatcggcattggctattatcggcatcggctggaactactccatcggcttgtcagcccatcggctgtttagatctactatttgcatatcttgtcagttgcaggatcaaactgactggcacgctcgcatctcatcaatatttggacctgcacaggagctaagcagatctcctaggccggtgtgttcaattttttcgtcaacacccctcgggcccttgcaccgctttgccccgaggccctcgcccagccaccatttggcaggggaagcgagcgaggagggggcccaggctgaaccccctttaatgcgcgcagcgccccaactgccccctgtcgcatttaatgcagtggggtagacgtgcggcgtgctaaactgacgcgcaatagtcaagaatgaccggtatgtgaccggcctgacgccggtcacgtctgactggacggacaaccgtgctcccacgtcgcatctgcttccggcggagtggaggtaggtatgacccgtcccattggagggtcattcggacggcggccaccacaagtcttcacctattaatgagggaatgacagggctgtcccctgtgtcaggcgagggacggcgctgggtcctactcaagggcaagctgtggtttagcttcaaggcgaaggcacgggttgagttccggtcaagatagggtgggtccccacccgaaagaagagtaggtagaggcggtgcatgtggtatccccttgagatataaaaggaggatcttgcccaccgagaaaggggacgactctcagtgaactagagctctaggagaagagtgttctcccgagtttaggaacccttgtaactctcagtctaaatcccatacacaggagtagggtgttacgcttcatagcggcccgaacctgtataatttggttgtgtgcgagctaactaggagccttagggacggatacgtgatttctagaggcgagcttcttccctcggccgaactcacgaaagggggggtctcatgacctcccgctagagaggatcatccctcgacaatgttgtacatcaacaagttggatccaataaacggcatacttaggaagttttccacatcacccaataaatatatgaagtaatcacaacattatcatttctcatttttttggaatatgttctagcaatgaattcaaaccaaaaggtatattgccaatctgaaatcacacctaacaaatggataaaagcttacattcacccactttccctagttcccctttttttctttggcaatttctcattgtgaattagtcaaaaagcagcacccaaatgatataatcacttctatgaaattttattttcaaataagacaaatgtgcaaataaacacaaaattgttttcatgttcaaagaacttttctttatcatcttccattataaagacgatgtcatcaacatactgtagaattgagaccctatagcattcagcaaaatgtgacacccttcctttgatcaaaccttttcaattgtttggttaataagcaaagtcaatgcaacatcccccgctatgttaaaagggagtggagcaatatatattcttgccttaaaaccttgtaagacacatgcttataagttcattaagcatagttgcaacacaacctccccttaccaccttaaaaatcgaaccacaccatttatctatctccaaaacatttttggccataaatttgttatacaaaagaaccatctcgcatttcgtcacatactttctcaaagtttaccttaaaaagcacccatacattttttcccatatgaacttcttgaattatttcatgtaaacttaatatccctttccattatgaaccaatatttcaagaatgcaacttgactattgaactcaaccttttggatcactctaaccaacctacttatcacccctttggtgagaattttataactcatcacgtcgagtacacaaataggcctaaatttctatatggtcaaagtatcaatgtatcaaggttatacatagtttaatctctctatatctaaaaccgcattgtaaaaaccctcaaaaactttcagaagatcctatgtgatcacttcctagaagaattggtaaaatatttgtaggaagctattaggaccatgggcggccttattctttctcttctaaataaaacatgtggtttaatttcttccaatgaaaaaggtccattcagagatttcggattcagttcatccatttatatattcctaatatattagtgtcactgtggggccaaacaattttttatataaaagaagatgtcacatgttccatcaattccttctcatcttctatcatcttgaagattttattatatccaaagtgattgcacggtttagaataacgtcactaagtttgtatttaataattgtagctcccggagctaccatgctcctcttcatctggtattctgttcataattgtggcctttaacaagccttagtttgtactcctttctatatctcttataaataaaagaggaagatctcctgctcccttttttatataaaaaggaatatatatatatatatatatatatatatatatatatataggccaaccaaatgaagttctttcgaaccatgtgtttcaactttcaacaatggaattgaaaccaaagctccaagagttcctgagattttctgaaaaaaaaacaggtgttatattgagcaaatgaaaagaaagaagtttcagattgtttagtgagcaacgaagtccaaaatcacaaggttagcacatgatgtcggttaccatttaatttgcttctctataaattgtgttgtccaaactaaaatcgttgttgtgttctggttagttgtgaatttcttttgaggtgataaataggaagaaatgtgtacgacgttctcttgtgttaagcaaactcagcagagcttcagtgtgtactagtagtagtatagtatagcaaaagaagtgacgaattaattgtctttagaataaaatgttcttgctacattgcacaagtaattctcaaaaaaatacattgcacaagtgaattatttaacggtgacagcacgtgttgacataaaataaaactgaagagagaaataattaaaatacgtactcgatccacttttataagaaaagagaaaacgttgtcctcaagacctgtgtgtgccatgtgaagcaaggcgataaaaggcatgaagagaatcaggggtggtgaagaaggatgggagaatatggagcaagccagccaggtgaagctgaagctgcaagggccaagggctaggctacgaggaaggatggaagatgagaagaaaaaaaaagaggcactactgtacatgtgggggtaggaaatcaaaaggattcagctcaagccacacaagaggaaagcaaaaaaggaagatgcaaagcagtgcacatatataaaaagcactgctcctcagccacaccaagcaaaggataggagaaagctaacct

SEQ ID NO: 68107 - DNA, 1414 bp, Oryza sativa
tcctgcagcccgattgatttgcacaactgcacaagcacagatgcggatgcagcccagctagctaagctaggttagctgctgctgttggtcttggaggcaaactagtgtaatatgtgccgtaccgcctgcctttcttcatcaaccaaacccctgccaccactcaacccggccaacctcttcgagtcaggctgatgatgggaaccgctcatcacaaccaaaccgccggctctgccctcggagtcggagtcggagatgccaacgacgccgtgcctggggctgggggtgggggctacagcgacccggatggcggaccaatctccggtgtgcagcggccaccgcaggtctgctgggagcgcttcatccagaagaagactatcaaagtcttgctagttgatagcgatgactccaccaggcaggtggtcagtgccctgcttcgtcactgcatgtatgaaggtctgtctcttctttcctccttctaccttctcacttctgtctatttatttatatgtttgcctttttcacaacatattttcctattattacttactatctgactctcaaactgttaatttttctgctcctcatctctgtttaatcacacgtaccgcctctgctttacaatttgctgtagtgattttatccggaaactatcttcttaaggattgtaccaaacacatttttcaccacaaattagacgattgtcaagttcagaacaagattttgaacacctacatcacaaggacgataagcaagcaacaagatcatttggtacataaatctgttgaatactttgttttgaaacataaagtatgctgttccaaagtcttgtttgagagactgacttgaaccctgcaaaatccatgcacactttgtcatgctagccgctaaagccaaatttaaactaggcctgattaggtcaactggaaactccttctgatttttttttgttgaaaaaaggggtgcagattgtggtactgataatcatctcaaggtcctcctttttttttctactgaaatcatgtcaaggtccttgaacggacacgttaccaaatcaatttgttgaagaagggagagataactttttaatccaagattaatctccacgttgtatgagaggccaccttgaattgatggtttctaatgattttgggttttcttttttatttcaatacttgtatgaatttctagtgccaatattttggaccaatgctcttgtattccttatctttaatttggatgcaacttttccattggatacatcaaacgagaatgaagtcatagggatagtttgttgttgttgtgttgtgttggatacctccttttggcacccagttcaccttcttcttgtaagccaatgggtaccacctagaatctccagccatctgtggacagcactatatattgcaggcttgtt

SEQ ID NO: 68108 - DNA, 1261 bp, Oryza sativa
tctgcccatgtttctggaaagagaatcatcgctccgattcttctctcttctaggctagtttgagcaattcccaggtcagctcataacaatgtgatatcagagctcgtcaatcctagagaagtcgtgattccgaacacgtatgcagcaacaggtcgaggatatggattttaggaaagtattccaaacacataagtgtgggcctttccttgctcggcccaacccatcggttgcttgacccatttcatcagttgacccaagaattgtatttctaggtgtatgtgggtccgctatacgtgagagtgaaatctagattttggaggcaccgaggcagggtgtgatatcaagattgtaatcctactcatgagtaatacaatgaacatatcttgattgttttaaaaaaaccgacaaggctgtgatgttcttttcacaaaaagaaagaaagaaaagaagacgccaatgttgtgctggtcttttggcctgtaatggctctttatggacgagaacattgttattaagctattgttgctggtgacttgtctagaacacactacacatacactctcctcggaaatttcattagccacaagtgttagcacctccaacctaatcccatcctgaaggacctagaacttgattttatccattatctaaaaagaaaggacctagaacttgccttcccacagaaaggaattacgagggtcttgtcatgttgctagccgatgataatatctgccaaatattcttgaagtgcaggaagttacccttgtaagcatcgaagaaacaggatcctaagtgcctcgcaagcttgtgcacaacatgacccaatggttggaatagtggcaaacaccggactaaaatttagtatagactagtccactggtttgacatatgcttgttctcagtctgactatattggggagtaaaggttttttttttcatatttcaacattagaaactttaaattgttggtctagtactcatacttggctgtgttcgcatatgtgggttgggaactcattccctccgcatggaaaacggagtggtccattagcacgtgattaattaagtattagctatttttttcaaaaatggattaatttgatttttttaagcaactttcgtatagaaactttttacaaaaacataccgtttagcaatttgaaaagcgtgcatgtggaaaacgagggagaagggttgggacaaggggatgccgaacacagccttaagtttgttggtcgcactgtacccaagcatgtggagc

SEQ ID NO: 68109 - DNA, 6127 bp, Oryza sativa
  unsure (1)..(6127): unsure at all n locations
caagagacttatgcatcattttattgagaaggaaagggtctggtataaatccaaaaaatgaaaaacaaaacaacaaagaaactagaaatgtcaaatgtggtgggtggtggtgaataatgctgcttgctagcgggagatgcctgcccattggctatctctcgcaaaatgatagtgtgaccaagaaaagataaagcactctatgccttgagctgtgggatcatcactccagtccagcagcacttgatcctttttttctcattgcaggcattatattcaatttgctaacgactttaactgagatcactgatttatggtccccattctttgactaaaactcatttctgcattgtgcacttgcttgctgtttcaagtattattcatatttcttgtggatcttccattcgattatactcttgtttattcggcttctttgttaaggacagggagccaagcacactagagtaatattctgaatgcagactggcttttgtgacctttgtcggccccggttttgggtgcttcttcttagttgcaatacctcggggaagttctttccccttggggccaaggtttttttttaatgcacaagatattttatctttgttggtctttgactgagtgttattaatttatttctgtgaagtcatccctgctgaaaatggccagcaagcatggacatatctagaagatatgcaaaacagcattgatcttgttttgacagaggttgttatgcctggtgtatctggaatttctctattgagtaggatcatgaaccacaatatttgcaagaatattccagtgattagtaagtagctttcctcaactctacagtacaattcttgtacaaaatgttgcccttgtcatttatttactttctatgcttttagctgctacactgttgtggtttatgtgcagtgatgtcttcaaatgatgctatgggtacagtttttaagtgtttgtcaaagggcgctgttgacttcttagtcaagcccatacgtaagaatgaacttaagaacctatggcagcatgtgtggagacggtgccacagcgtaagttgttgttggtccagtttttcttatatattagatgttcaggcaaatccatcaagtactgactgctgcttcaccattttatggttacaatatgtgatgactctaaactaaagttgttattttcaaattcagtccagtggcagtggaagtgaaagtggcattcagacacaaaagtgtgccaaatcaaaaagtggggatgaatccaataataacaatggcagcaatgacgatgatgacgacgatggtgtaatcatgggacttaatgcaagagatggcagtgataacggcagtggcactcaagtatgaaacttgatctttttattccaacatagctttactactacctgttaacaaagctgtaattagaatgagaagaaaaaactgaagttaaaaactgaataaacctgtcagtaacaatgatttctgaaggcataaatgacatttttttgcatagctgataaatttattttagaatagtgggaaataggaagagttcaccatgtcactgtaaagtttttgaattaaccaaaccagtaaaataccatggatcatctgcatataacaatcttaatattgtacaaacacaacagatgaaacacatactgaagaaaatatagttatcgcctctcggatagtttacatgtgtgttcatgtggcactatcgttttgcttaactaataccaaggtgccaaataaaccagcggttggttcattgcattttggagcacatatagtatttataaatcttgatagcgtgtgtgtagaatgttccaccagaagttgatagcactgtgctttttgcatgttcaaggaatcaaatggattgtacaatacatgcaaccaaactttgatgtagggaatttctttgttttggcttggatgtccaacttatagtttctcaccagttggattaacttcttttccttgttctcccattgtaaacgtgaattgaacaatccttgccttttaagataaatgtggggtctatgctttatgctgccctttaaatttttgaaatgctaataagtagtttgcatgcatcgtgcttctctaaatgtcatcaagttgactaatatacagttcactatcaatcagctaataccactttattttatgtgtttcctattataaattgaacattttgtttccttaccaactagaaatcatagtacagatacatattgtatagttattttcggtttattcatgaatttgtgttagaattagactatatagacattgctggttaaaaagtactcatcccctaacactgtgggaagagtacaaaactactagtgtgttaacaccattggcctcttgacattcaaaactgctacccaatgaacacattccccatcaatggtccaataatcccgaagtctaaagtccttaatcaactcgtgcataattattcacttggtaaggaaataggaaaaggatggatgcacacaaatgttttgtccatttttgctaagcctccagtatttttacttctgtgttttgagcttcataatggtttccatgtcttttcttcaattaacgcttttgtcctgtattttgatttctatttgcaccatttaatgaatcttccaaatttgggtttttcctcttgatgatttttaacttcacatctcaattgatctttaaaatatgcctaattatttaatactacctccgtcccaaaatatagcaacctaagactggataggacatatcctagtccaatgaatctggacaacccttgtccagattccttggactaggatatgttccatccaatcctaaattgctatattttgggatggagagagtatcatctaattaattacctgcaaatctgcaatgctctgcttaaacatattgtatattttctatactaatttactatacttattatcaaaatgaaacgtatattaaaaattaaatatctgctgcaatatgtgccctcaaaactagtataaacatattgtatattttcttttcaaagttacctttaatttggcgacatgtttggattgataaaatcaagtctaagcttgcaaatttggttctcctgatgctgtatgtttgattccactaaatagattctcttcaatgacctaggcaagctgtcgtagtttatcccaaatgtgttgaaaaggttgttctgggtatcaccgtacagatagattgatcctgaaattcgtatgcagagtaaacaaaatagtcttatcaacatagataatgctaaacatcatatcatcagcgcactagtgcaggactgccttgacatataatggttgcctgaaatggcaatgaaataaaaaatcttttatttaaaaagcaagattcaattgtgaattagcaatagttggagaaatttagagttacaggatatggcacacgaggtgtacttgagaactgtcggtttgtagctagagatggctacgaatgccgccggggggtacctagcttatcggcggtggatgaaaactagtgtaaacttgaaattagtccacgtttcatgtggatgaaatctagtgtaaacttgaaattagtccacgtttattatgaaacgttgactacagaccctaccgagataaactgtatcttatgtgttgctgtcaagttctcttttattacagtgttgtggagtggggtaaaatttttttcctgtcagttagttatgaatcacataagattttgccactgaaatgttcagtgacatggccgatatgtcaatgtaagaaacaacttagaataaattccacattacaatattcagaaataattactgtagatcggatcactttgtgaagtgcatttaaactggttgctcatcatttttttaaggcgcagagctcatggacaaagcgcgctgttgagattgacagtccacaggctatgtctccagatcaattagctgatccacctgatagcacttgtgcacaagtgatccacctgaagtcagatatatgcagcaatagatggttaccatgtacaagcaacaaaaattccaagaaacaaaaagaaactaatggtattgtatgctcaactgattcattgtgcaactcgataaaacaaaagctccataacactgtatattaataaatttcaacatgtttttttttcagatgacttcaaggggaaggacttggaaataggttctcctagaaatttaaacacagcttatcaatcctctccgaatgagagatccatcaaaccaacagatagacggaatgaatatccactgcaaaacaattcaaaggaggcagcgatggaaaatctggaggagtcaagtgttcgagctgctgacttaattggttcgatggccaaaaacatggatgcacaacaggcagcaagagccgcaaatgcccctaattgctcctccaaagtgccagaagggaaagataagaaccgtgataatattatgccatcacttgaattaagtttgaaaaggtcaagatcgactggggatggtgcaaacgcaatccaagaggaacaacggaatgttttgagacgatcagatctctcggcatttacgaggtgcaaaacataatatcagtgtcgctagtgagttaggaaaccattgttaagttgcatactaactgttacttttgttgcaaggtaccatacacctgtggcttccaatcaaggtgggacaggattcatgggaagctgttcgctgcatgataatagctcagaggctatgaaaacggattctgcttacaacatgaagtcaaactcagatgctgcaccaataaaacaaggttctaatggtagtagcaataacaatgacatgggttccactacaaagaacgttgtgacaaagcctagtacaaataaggagagagtaatgtcaccctcagctgttaaggctaatggacacacatcagcatttcatcctgcacagcactggacgtctccagctaatacaacaggaaaagaaaagactgatgaagtggctaacaatgcagcaaagagggctcagcctggtgaagtacagagcaacctcgtacaacaccctcgcccaatacttcattatgttcatttcgatgtgtcacgtgagaatggtggatccggggcccctcaatgtggttcatccaatgtatttgatcctcctgtcgaaggtcatgctgccaactatggtgtcaatggaagcaactcaggcagtaacaatggaagcaatgggcagaatgggagtacgactgctgtaaatgctgaacggccaaatatggagatcgctaatggcaccatcaacaaaagtggacctggaggtggcaatggaagtggaagcggcagtggcaatgacatgtatctgaaacgcttcactcaacgagagcatagagtggctgcagtgatcaagtttagacagaaaaggaaagagcgcaacttcggaaaaaaggtagcctgttttcaattgcatgttttctgttcctttggttttagcattcctgtttaactcgtctaaattagctaaagaacatgttactggaagtagttgtcaaaagcatattactggaagtttctcccaaacgactagctaaatgggatcgggcatgaatataatttgtttatatactagtattatctgatttctaaaaggaatctcacaagataatcttccaaaaagttgcacgtttttggtcccatagccgtgttgctgaaatttcttgccaatgacatttcttggatttttctcataatttaatggtagctacttagagcggcaattcaattttactcttgaaacactgtcctttacttttcggcgcgggtgagtacaatttggataggaggctctttttatatatagagaaacatacatacatacatacatatatatatatatatatatatatatatatatgatgtgcttgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68110 - DNA, 1023 bp, Oryza sativa
tcatattaatctattttttaagtttataataattaaaactcaattaatcacacgttattatcacctcatttgcgtgaaatgttgaaaatttagttataattcggtatattttaatccaaaataacaagataataaacatgatatttacaataggatttgatccagtgatagtggtgaatgtaatcaacattagcatgcttaacgtagaataagcatcaacaaccacataataacgcaatgttgatattacgatgaacattaacagtaaaacttctaattaaaataatataagaaggttataccccaagaatagtcctccgttggagtttgaggcggtattgcctccgttggtgttgacgggaacctccttctccttgtctctagtgttgccgttgtcatgttgccgctgtctccaatgttcgacatgttagtgaagacgaagtagacattgacgaacgcagtgagtagtcacgccttgcgctctccaaaaacctgatcgcccgtccgtccgtgcaaacgtcgcaacagtgcgtggtttcagaggcatactctcccaaacgtcgcagcagtgcgtggtttcggaggcatactctcccaacgcgtgtgcacacactcgtcaggatgggattaccgtagcagcaacagccttggaaatggatgaaagtgtgtctcccttcttcttagggagatcaaatccattctcattttataggaggaatggaagatgaagagtaagagtcatggaataggaagaggaatagagtaactaattctcatcaattagccatcaaccatcctccactacacaaccatcaaccaaccatcaattagaagtaattgatgtaggttaccaatggaatagaaagagaaatagagcaactaattgttatcaactagccatgtgaaagtgcatctaggcccctaatgattttggtgattaattacaatgcgattagagaggactaacatttttattcaagtaaatgtgaaggttgttatgtccttaatgagttaaagtaatgc

SEQ ID NO: 68111 - DNA, 4260 bp, Oryza sativa
  unsure (1)..(4260): unsure at all n locations
cattttgttcaagtgtgagacttctcatgcaagctgcataagaattacggtgacccaacattacacagcctttggtggcatgccgcgttcatcgttcccatgaagctaacatttgctaagtaatgagtcatgctacctaggatagaggaatgcctccctagaataatttagagtggaatctgaagaagaatgttgcttgtaatttattgatctttctgttaattttgtgtaataaacccaatttcatcgaagaactaatgaaaaaatatgcacacacggtccaacacaaactaagtagcagcttgagtattacactctgcaagtcctattcaaataatgttaatatgcatttttttattttattttgcaaatcaatgatgctaccattctaatgcttaagttgttttgccatccagggaccagcgttatcatgaatgagcttacgattggttctatcgccaacttggaagcaccgatagcagaagtggtactaacttggagggtaacgatatgacatattgatagagagaatggcacaaaggtgcacgatgttttgttcttgtttttaagttctcattgttgtgttagtgacgatttccttttgaaaggggcctttatgcaatatcccacttacccaaaagaacagtgatgagatatcaaagctaaggccaaagaattggttgtttgtcattacagttcggcatttccttttttatactgagatttgtctgttgattcacagatttttttacgagtaccacatcatcgcgtatgttgtgttatctcgttgtcatttttttttaaaaaaaaatattctagagcatgagcattaggcattagcagtggctttgaacaagagccagaaacttattaccatcttaatgatgctatcaatagtttcagtgccaaatagctaaggcagttagaactttcaggcttgcagatgttacgtatgacgttagtaatcgcaaaggttgatcatgtccattggtggaataggcatgtcagcatggcaacatatacaaggcgtttcggtaggtattgatcaaatcattgaaaacttggaggactccatcactgttctctgttcttatcctggttcctggtgctcttaccatcttcaacgttaaattcacatgtccagataacccgaacacacctaccaatccaatgcaacaggtccttttgaagtcggatctagaacaacttactgcaatgaacacagatgctttcatgctcagatatacagtaagcgaacaaggttaaccagaagagataaaattggaaacaatagcgtatcaacatcacaacgcattcacctttgaagctggatgacgctgatacagctgttcaaatagccttgctgacactggctaaacagctgaaggagaaaacatggtttgagaacttctcacttacacaagcatagctttaatttaatggtcatgagagactccgcagctagctttcagcattgcatgataaatttctgactgctgaaattataactactgaaaacaaatgttgatactgcatcctgcaagctaggataatgtgagacaggatctaaagacggaaatattagctcagagaacatagcataaagatccacagctgtgcaatgatttctaggcaatacaaaaaaggataaatcgctaagataacaaggagagggatcgcgccgagatcatctaccatctaaataatttaataatataaactacctctgaactcaagtacacaaccagtcctcggaatgcatttaaccagataaaacctaaaaaattgctcactcgaccagcgaacaagtcgtccggcctggccagtgggcattcctagctctaagtcagtaacgcgaacatcttatgatcccttagctccagtcttcattacgcatttccctgaatttagaacatgcaaagttgatgcaaggcaaaatatgttagcatgtgcaaatgaacaatgaacatggttgggataaatgatcagggttctatttacctccaaatggcgacatatccagtttagcctgcaccatctaaggaacttgaggaaccattggcaggtatttgagatcatacctgagaagggctggaccaaatgcattatactttcccgaactgctatatgcctgttcagcatcagcactcttagaaaacactactcttgcgatctttgatttcttgttgatttcagtcgcaccctccatgattggcccgtgcatacggaatatactattgatgtcatccacagaagggatggcttctgcattactaaaatgtaagatcagagctgccggtccatctgcctgtttcacagcaggtgaatcagcagaggcctcatcttgaggtgcaacctcctgcttcatcttcttattaaaactcctgttctgagacagccgcttcattttgcggccctcatagtcacttgatgtgtctccatcatcaaaatcactgattataatatcacaccaatatgagtcttctgcctttcttgctgagtagatactccctgctgacttcctccgacccctatggccatccgccacctctaagtcaccttcttcttttgcagctgggtacaagcttctggccgtattttttctacctttcttgccacccaatgtctgcagcagctccttgtcgtcgtatgtggccggcacttctgagtccttgtattttgagaagaagctaagaatgacaggcacagagtcatagcccttgaagttgaatggatcagcagcaacggatgtaagctgtagaaacatgtcagcggctggtggatattgatactccactgtttcttggatcacctcgtcctcgtccttgaggtgtgcaggcctcccagcattgtttttcctaggcctcccgcgtggcctcccgcgtggtgcaccgctgcccctgccgcccttggagaccctcttgcggtcgaaatcgacttcggaatcggagtcagtggcacccttcttgcgtgggtcccaatcctcatcggagtcatcgaggatttcctcctccacctccttcctcttcctccccctcctcctggatggggggtaggagttgcagttgttgggagtggctgcggcggcggagacattgggtaggccgaggtggagggtgtactcgggagggtcgggtaggcccctgaacttgtcgaaggctctgagatgcgccttagcgacggcggcgtggacacggttggagaagcccatgcggtgggcggccaaatcgtgcagcagggcgatgaaatcgcgggggaggaaggggcgggcgatgcggccgggagcggtgagggcaagctcaacgcggcgctcgaactcgaggagggaggcatcgagggcggcgtcgaagtcgtcggcctcgccatcgtagagctcggcgacggggaagtagggctcgtagggcctgagctgggcggcgtcgcaccaggcgagggccttgtcgccgaagaaggagacgaggagctgggcgccggtgggggcggcggagatgacctcgccgggccaggccgggtgggagagcttcttgccccagaccaggtcgccgggggcgaaggggcatgcacctgctcctgctcctgcccctgctcctgctcctgatggaggatgaggattcggatccgtagccggtggcggtggcggtgggggattcttcctggggcggccgcggccacgcttgggcggcgctagggtttgggggtcagcggcggagttgaggtcgaagggtgtggacatggtgagcgcaagctagggtttggattggtggatgggaaaagtggggatcgatcgatcgatcggagcggaatggattctttggtaagggcttgagacttgagaggctttgggcggaggaatggaatggatgatccaatccaccctcctcttctcttctctagtagcctcctctcctctcctctctcctgtgagtgactactctctactggtgtactgaggaggaggatgagggtttgtcagtgatgctgtgcctcactgctactgttattatttactactactgtagcacggcaaagttaaatcaggggtaaacatcaatgctcactatctcatctcatctacgaaaaacaacctctcttccaatcttccaatactcccgtttcgnaaaccatgacaaagagtggataaactttttggatttttatggcacgttttttgaaactactaaacggtgtgtttcgtgtgaaaaccttttacggtgtgtttcgtgtgaaaaccttttatatgaaagttattctaaaatatca

SEQ ID NO: 68112 - DNA, 37401 bp, Oryza sativa
  unsure (1)..(37401): unsure at all n locations
atgtgttttggaatttttcggagtttttcgaaattcattttcggactttccgaaaatacacagaaccacttttcgcttctggaaattttcggatatgtctgaaaggcattttcagactttccgaaaatgactaagaaggcaaacatggttctgtatattttcggacttgtccgaaactgattttcggattttccgaaaaacatcagtagagtctctttcgcttctgtaaattttcagagttttccgaaaggaattttcggactttccgaaaatgtccagaagggtgtttttggttctggaaattttcggacttgtccgaaaagttttcagaatgtccgaaaaatcttcagttgactttactgtcggtgccgagctggaattttcggacttgtccgaaaatctttcggaatatccgaaaatcccatttattgtgcacaacgggcagaatttgggttgtggctataaatagccccatcccctcacttgtgagggctgctggtcacattggatattcttgtgcccttggcttgctcttgttgagattcacttttgagccttgctttcttgtttcccctctcacccgtgttcgattcggatttggtgtgtgtgtgagagttgtggattcgagtttgtgtgagtacttgttgttgacttcgtaaagatttgtgagcacttgcatcatctccgggagttcattgcatcatttgttactcttggaggttgaggactcctaggcggctaggtgttgctcccgagccaccgatctacttgtggttggccgggagaagtttgtgaaggtcgggtctcacctccgaaagggaagagatactcttagtggaaggaggagtgcttagtgcaacctcttgaggaaagggtcagctaagacccggctcttagtgagctcctcaacggagagtagaattccctcaaggattcgaacttcgggaacaacttcgtgagcttcatctttggtgacttcacatcctccctctcctttagctttgcttgtttgagccgctataggtctagttgctgtttgtgctagtatattcttgttgtaggcaactagatctaggttttaccttgtgtttgtgctgactccgataaattttcggatatatctaaaaattttggaaatatccgaaaattactgcttccgcttttaattgaattcttgaattagcctattcacccccctctaggcctaattgacactttcaccatcaaccatcctccactacataaccatcaaccatccatcaattaggagtaattgatataagttaccaattccctaatcaaatggattaattctcaaaactcttcatcccattgatatcccataagagaatgaatacacatgaattcctagcataatgagccttggaatttatttgatttaaatggatcaattacccaattaaatctaacatgaaacacttaatcttcatcttcaagagattcaaacaccaccttagggcctgcttagttctcaaacaaaatttttcgcgttgtcgcatctaatgtttggacacatgcatggagtattaaatgtaaaaaaaacaaaccaattatacacttcgctaggattaattaggctaattgcgccatgatttgacaatatggtgctacagtaaacatttgctaataacggattaattaggcttgataagttcgtctcgcaatttcctggtggaatctgtaatttattttgttattagactacgtttaatacttcaaatgtgtgtccgtatattcaatgtgacatgcagaggcaattttttttttgccaactaaataggctcttaggccttgtttaattcgcgagacgaaaagtttcgacatatcacatcggatatacggacacatatttgaagtattaaacatacactaacaaaataaaatacagatttcgcttgtaaactgcgagacgaatttattaagtctaattaattcgtcattagcaaatgtttattgtagcaccacattatcaaataatggagcaattaggcttaaaagatttgtctcgcaatttcaacacaatctgtgtaattagttttttttcttatatttaatactccatgcatatgtccaaacatttgatgtgatagggtgaaaagttttttgtttggtaactaagcagggccttaaattcatacttcccataaaaatattaaccaaaactgatttggattatatattcacctttacatctgctcttaagtttttcttgtttttagtccttgtgttttccaggtgttgcctttcagaggcatttctattaaatgttactttaatcaaaacatacgtagctctcaacaaagttatgtatacctcaccgttatatctagaaaacatattctgcctacataagctttcggtgcaaaatatctcaattttttttgttaaaaaaatatacacgtacttccaatgttacaacacatatgtgcaaagtactatctttaaattaattatgttttagccgtacaaagaaatacaaaatacaaacaattttaagagttattttttttggttatgcaggtgcattactaagagcaggtacaatagcagcctataagccagctataaacatattttaaagagataaagaaagagagagaagagcagcgggctacatatttgtagctaactacaacacggactccaagacgtaatgtatgtatgacagataggaccagatattaatagtatagcaagcaactattgtatgaattgactattacagctatagatgatttagagctaacaatgggctatactattaaatttgctctaacaatagatttgttgacacaaactccctttataagcacgacacggtacgacatacgtatgggttaacattttgattggtggcagctgctgcagggcccaattcgaacacaagtcccacggcctgtggtaacccagcccactccaccacaagaccaataatcgattatttattactcccttcatattttaatgtatgacgccgttgactttttattcaacgtttgaccattcgtcttattcaaaaaatttatataactatcatttattttattgtgacttgatttattatcaaatattctttaagcatgacataaatattctcatatttgcacaaaaatttgaataaaataaatggtcaaacgtttgtcaaaaaaatcaacggcgccatacaaactaggcttccatccaatggcaatgggggttcgatcaagcacgacaaagcaaaaggaatcgaacgattaatagctactcctactaaacagtactactcaccaccctcttcccttcattgctgttgatgttgtttggtcttttttttttgttaatttgtttattaaaggaaaacccgcaccctcactctcagtctagctccctgctgcttccacagctacttaattgtaggatgtaggatggtgcgtgctagctgcagctcactactacaactgtactagctagcagatcgcagctagtagcagagaggagaggagaggagttgatctgaggtaggataggagagcagcagatcagatcagatcgatccgggcaggcgggcagcatggcgtcggcaggtggctgcaagaagaagacgggaaatagtcgtagtaggagccctcgtagcccggtggtgctgcggagggcgatgctgcattcgtccctctgcttcctggtcggcctccttgccggcctcgccgccccctccgactggcccgctgccgccggcgccgccgtcttcctccgcacgctccgtgccagcaatgtcatcttcagtcgcagtagcaataggccgcagcagccgcagctggtggtagtggtcaccaccaccgagcagtccgacgactccgagcggcgcgccgccgggctgacgcgcacggcgcacgcgctgcggctggtgtcgccgccgcttctctggctggtggtggaggaggcccccgcggagaagcacgcggcgccgcccacggcgcggctgctgcggcgcacgggggtggtgcaccgccacctcctcatgaaacaaggagatgatgattttagcatgcagatatcgatgaggagggagcagcagaggaacgtggctctgcgccacatcgaggaccaccgcatcgccggcgtcgtgctcttcgggggcctcgccgacatctacgacctccgcctcctccaccacctcagggacatcaggtacagcatcacaatacatacctacgtatatgcgtacactacatccttattagagtcttagaaaaaaatactcgtacgttgtaacatgttatggtttagttaagatgaaattcactatgtgaattcacttgaatctatatatttctagaaaatcatgagctacagttaaaagtccgacgagtccgctcatcacaatttagtatgcgagttttttttaaagagattcttttatacgattcttcctgtattactaaaaagcgaacaaacttaaaaaaaaaaccagatatgtatttccaaaaacgaacgaacttggaaactgactctacacgaatgacgtgccaaagtaccggtaaaaatattttcaatttttataatataggctgtgttcccttcaaaacttccaaaaattccgtcaaatcaactatttgtacacatgcatggagcattaaatgtggataaaaaaaaccaattgcacattttgcatgtaaattacgagacgaatcttttgagcctaattacgccatgatttgacaatgtgatgctatagtaaacatttgctaatgacggattaattaggtttaataaattcgtctcgcggtttataggcggaatctgtaatttattttgttattagtctatatttaatacttcaaatgtgtatctgtctacttaaaaaaaaattggtacaccaactaaacacctctatagtagaggtaaagatattttagtcaacactcaactacattccgctatatataggcctgggttagttactaattttctttttaaacttttaattttaatgtagaactaaacaaagccatactactccagtatgtttttaattactagtagtgagctagctagctagagacaaacaatgtacacataacatggaggcctcccggagtgatagtttttgtacgtaagcaggtactccctccgtcccaaaataagcatagccatgaattttcgtgtctaattttaattgtccattttatttaatttttttaaaaaactaaaaaaaatataagtcacacataaagtactattcgtgctttataatctaataacaaacaaaatactaatcataaaaaaataaataaaatagatgatcaaaattgaacacagaaactcgtaactatgtttgtttttgaacggagggagtactacgaagctagggtgtcggtggatggaagggccctccctactactacaatagctactccttaggattcaaaattatatatgtgtcatcctattcacatttttctctccaatcactctttgaaatttctccccattttactctatagtgcaccctccatccctaaaaaaataaaattagagataaacctggataaattcattctcaaaaggtactacctccgtcccatattacttgtcgctttgactttttccttataacgtttgaccattcgttttatttgaaaaatttatacaaatataaaaagggataagtcatacttaaaatacttttgataataaagcaaatcacaaataaaataaacaataatttcaaatttttttaataaaacgaatgatcaaacattacaaataaaaaaaggtagtatctttttaagacggggagagtactctataatttattattatgtaggagtacttactactaatttaaagttgagcgtgaaaaatgattgctgaaattaaaatgagagggatgtcgtagcagtagcgcgttaattattgtatatggccgtacagtgcagtatagtacaggatgtgtcggcaagaatgaatgatttgatggggctggcatatgtaaatgcaggacatttggtgcgtggcccgtggcgacagtgtcggcgtacgagcgaaaggtgatggtgcaaggcccactctgcatcaacacatcctcctcgtcggtgatcacccgcggctggttcgatatggacatggacatggcggccggcggcgagcggcgagcggccgctgaccggccgcctccggagacgttaatggaagtgggcgggttcgcgttcagcagctggatgctgtgggacccgcacaggtgggaccgcttccccctctccgaccccgacgcctcgcaggtcagccactgcccagtgcccggaaagagatccctgactttgtgcagtttgcagttatgccactggtgacaccagtggcataacaccagtggcataactgcaaaccagtggcataactgcaaactgcacaaagtcaggggatcctcattcccagtgcccacccatcatcgctacctctcactcgatctactcctgccacgtagtagtaattaattagcctaaccacgtcgtccaccccaccttcaggcggaccggagtattatatcacgattctcaatttcttacttattagtcattccatattttaacgtataacgtcgttgacttttaagtaaagtttgatcattcgtcttatttaaaaggaaaaagtacgttttaccctctgaactattgtgacagtacgaattaccctcccgaaccatataatcatgatatattacacctcaaactattgataccggatgaattacccccccgactcaatactgagcggttttgctcctacgtggcatagacatggcgtcgatgtggaaatccaatcagcaaaaaaaacacacacacacacacacacacaagggcccacatgtcattatctctcttcagtcttccccctcccccttctctctctcaggcgtgcgtcaacgggcaatgcgcgacggcagcggcacgcggacgggcggcgagcgcggcaaggagtggtggggccgagacaggcggcgggcgggtcgggggcgcagcggacgtggtggagaggtggccggcaggcgtgacggcgcctgtgccctcctgtcgcggcggcagcggcgcgcggacaggcggcgagcgggggccgcgggcgcggcgggtggcgcggcagggagtggtggggccggggcaggcagcgggcgtggtggagaggcggccggcgggcctgacggcgcccgtgccccctatcgcagcggagggcggcgaagtggcgagggcggcgaagtgccctcctctcatacctctctctcgggccgtcgggaggtcggtgcgcacgcctgagcttgccgtcgtcatcttcaatgtcctcgggaccttggcgcccgtgcccgtctcgccctccccaccgcgcccaccggagctcgaggcggcaggaggaggggacagcgaaggggagcctgggctcatcgtactccagcaggagcggctcgaacgacgacggcggcggctgggggatgactccgacgactcttccggcctccacgctccctcgccggtctcctcacctccttcctctctgcccgccccgctaatgccggcatgcttcggccgccgccgctccgcccgcgttgccaccgctgcttcgccccgccgctctgccgccggcgcgcgagtcgcagccgctagcatctaacgggagagagagagggggtgagagggaaagagagagagaatattatgtcatgacaggtgggccctatcctttatttaatgaaaaacttgctgactggactgccacgtagaccaaaaccgcttacaaaactgttgggggggtttcatccggtatcgatagttgagggtgaaaaatgactggttttcaggtttagggggtaattcatactcacccaatacttcagggggtaattcgtacttttcctatttaaaattattgtgtaaatataaaaatatttatgtcattctgataaaacatttgatgataactcaagtcataataaaaaaaataataattatccaaattttttaaataaaacgaatgatcaaatgttggttaaaaagtcaacaacattatatattaaaatacggggaagggagtactttcttgtcatgtcctggggctggtcctagctatagatagatcagtagtactacctcgtttcagattataagactttctagcatttgtccatatgtatatagatgttgattaatctagtcacacacacacacacacacatatatatatatatatatatatatatatatatatatatatatatatatatatatatatatatatatatatatatatatatatatatatatatagtgtgtgtgtgagtaaagtcgaaacgaaggaagtagctagctaactgaaaagagattaaaagtcggaagaatataatgcgcaattcacgtacgcacacgacactagacacgcacaagctccgcgtctgtctgctttctttttggtttgtttgtttgcttgcttgcttaatttcatcaatcatttccatatattattccagcctcactagctagaagcctttcagcgtgtagtagtagtacatgtactataattaccgtacagtttggatcccaatctgcagattcatcatacataagtacacagtaactattgacaattacgaagtaggagtacgtactagtaattgagattatatatatatatatatatatatatatatatatatatatatatatatatatatatatatatatatatatatatatgcgcttaataatatgtgtatacatatatatgcaggaatcagtgaagttcgtgcagcgggtggcggtggaggaatacaaccagtcgacgacgagggggatgccggactccgattgctcccaaatcatgctctggcgcatccaaactacgctctaggctctagctagcttaatttcattcttcttccttaatcatcgatcgtcaatctccaaaacccacactcctactcctatctaagacaaatacctgcatataaatatatacacacgtatacgtggtgtgttcacgtacggttaattaagctgcaaggaagtactccgcaatactacatgcatatatgttttcaccttacttacgtcgagtctttgtgattctcggtctctttttaagtaagagtgacaatatattcacgaggaaaatacatcagtgatataccacaacctgtgtggagggtgaaatttttagtcactcgctttgtaagttgatcaacccagcttaagattctgataagcagctgctgagaaactagctggtgacttctaagttcattttctagattctacaactacagactctcagaatctggataaaaaactagactgtttggaggagcttctggcaactggagattctaagagaaactgaaggtgttagaagctccccaaacagattcataggctaaatcttgtccaacagatgtcatttctgctggttttctcttatagcatggacacacacgatgtataaataaatcaacagcggaggcaggtaccaaatcatgacagttgattgtgctagattcaatggttcaataatgtaggtaccagacaacgccatctaatctgggagatggtaccggctcgaggaacggaattgctagaaaactttcgcaagtttttcttttttgcccctaaaacttttgagatttgtgcattaacgtaaaaaaaaagataatctccaagaaattctattgacaagtgtccaaatctcagaaatggcatcgataagtgtgagttttaagaaatgccatcgtacaaacgactttgtcctaaaaatgccatcgtcgttagggttatgtccattccacgccattaaattctataggatgaacagtgtatttaatggtgtaaagtggacggcgatggcatttttgggacaaaatcgtttgtacgatggaatttcttagaactcacacttgtcgatggtatttcttggatttggacgcttgtcaatggcatttcttgaattatctctaaaaaaatcgctagaaagaaattttcacgcatgccacgcgtaagatccctatgctaaccaaccaaatcatagttgaatacaagttttatataaattacatcgtagttataatacaattacacttcaattatgtgatgtcgcatgcgtgacggagaggagatatttcagcgtctcgcgtgaaacattgaggtcgcgcacctctgcttcacttcattacctatcatgcctatgttaaatgaatggttgtatttaatttggtacctggtggtaccgtaccagtatattgtattatcgtaggcgcatgatgttatggtccgcctgtaatttagtatgtgtttggttgcagagatttgctgggtcgggttaggtcgaatccgcttttatagatgtataattgtggggttagatgggacgggttgactccaaaagagaatatcctcctgatatttgggttcgactcccccatcattagtatataaaaaaccatcataggtgtcagttcccaaccggctatatgtgccggttttcctaccggcacctattgatcgacaccaatacaagcaaccggcacctataccaaaaatagaaccggcacctataggtttgtacgagcaaaaaaaaagagccggctcgaatcgagccggaactcgcaatcgcaatcactgcgccatgccccacatctagttttttgaaatccccacatcacagatcatccaccaatcacagatcaaaacatattcaacaagaaaagcatccacaaatcaaaaaacatcttaaaagaatctacaaaatcatcccaaaaaaattcctcaggcgccgccgcccgccgcctcccctcccaccggatttgacggaggggagtgtgcggcggccgccgttgctgtctccgaggtccgccgtctcctcttcggtcggatcgagcggaggggacagcgccgcggcagccgccgccggccgttcccaaaggtccaccacctcccctccggctggatccggtggaggggagggcgcggccgccgccagccgctgctgccgcctccgcctggccaccgccgaagcccgccgactcccaactgcctccctccacaggctcccctccacgccgccgcctctgtctgtggggtgcccgccgcctccccacctgtcggatctggcggagaggagggcacggccgccgccgcctctgccgcgtccactaggccggttgccagccgcgggggcttgccgtcttcgccatgcagccactgccgagagagagagagagagagtggtgggagagagacgcgagagctgagagacgagagaaaggtagtagatggataaggcggagagacgagagaaaggtagtagatggataaggcggagaaacgatttgataaggacgcgtggtggtgtggtgcttatgggctcggctcgccggcttggctcaaagctataggtgccggttttttaaaaaaacggtacctacaatatatgataggtgctggtttttttaaaaaaactgacacctatagtataagtgccgggtttttttctagaaccagcatctatatatattgtttaaaggtgccggttctattttttccatcgtagggaggtgggaaaagctctataggtgtaggttttaaatgaaccgacacctatgagccgttctctatgacggttttttagtagtgcatgaaaatttggcggaccgattcgacccaacactctcgcgtgaatcacgtgaggcagcggcgaggttgaccacgcgtcgcagcctcctccctttgtgcttcccctccctcactggcttctcgtccaggaagcggctgcggcggcggcaacagcgacggcggtgttggtaggaagcagtggggaggttgatgcgcgagggagtagtcgtcacgacctctttccttctccctccacacttcccctcttgtgccatcttcttgtccaagaacggaggaggcggctcccagcgacatcactctcgtgcccttctctttgtgatagctggttggttgcatgagactattgaaattcctagcgatgatgtttttttttcaataaatttcatcagaatagaacaattttttatatgaacaagtgttaagacaattctgaagcagctatatatagtgggtggtctaattaattaagctaattctaagacaattctttgtgaatccccctaagcctagcctaggagaccctctcccctttccacccttccctgttccatttgtaccctaactcaggaccctaactaatcacgattgccgctgcggatcgtcagagttggaggagaagcccactagagtacgaatcgcgaaaccgaattgaagtttataaatttgtcagaatttatctttattttactatatggaatgtggtttacagattcccgataataataactaatagagtttgggaccatgtgcgtatgtacctagatagggagctcagctcattgatgcacatgtacatgcgtccatgtctggtacttacttgcgggtaactagcacgcacttgcactaattggatagatccatccatcacgatcgagctcacctatggatgcctacgctatataccacacttaaaatccactcttgcgtgcgtgcttggtgtcagtggaacaagcaccgaagaacgactatcgatagaagttgatgatgaggcgcagcttggtgattgtgatggtggcctgcagctgcgccacagccatagccagaggaggaggaggaggaggtctgaagctcaacttctactcggagtcggagaggtgcccgagggcggaggaggtggtgagggaggaggtgcggaggctgtacgaggagcacggcaacacggcggtgtcgtggttgagggcactcttccacgactgcatggtctactcctgcgacgcctccctgctgctccacaccaccaccaccacaggcgtctccgagcagtcctcccaccgcagcttcggcatgcgcaacttcaagtacatcaccgccatcaaggccgccgtcgagcgtgagtgccctgccaccgtctcctgcgccgacatcctcgccctggccgcccgcgacggcgtggccatgctgggtgggccctcggtggccatgcggacggggcggcgcgacagcagggagagctactacggcgtggtggagcagtacatccccaaccacaacgacagcgtgtccaccgtgctgtcgaggttcgcggccatcggggtggacacggagggagcggtggcgctgctgggcgcgcactcggtggggcgcgtccactgcttcaacctggtggggaggctgtacccgcaggtggacggcagcatggaggcggcgtacggggagtacctgcgggggaggtgcccgacggctgcggcgacggaggacacgagagaggtggtgtacgcgcgcaacgaccgcgtcacgcccatgctcatcgacaacatgtactaccgcaacctgctcgccgggcgggggctcctcctggtggaccagcagctggcctccgacgcccgcacggcgccctacgtccgccggatggccgccgacaacgactacttccaccagcgcttcgccgcagcgcttctcaccatgtccgagaacgcgccgctcaccggcgcacagggggaggtcagaaaagactgcaggttcgtcaactctagctaagctcgactagctagtagtacacatatacatacatatatgatcgatgtaaaaataattgaggtacgttctatgagatcgatcggtctgtgaactaatcgatcggcggcctctatctgttggcatcgactcctccattggatctttgtatttttctcaacttgtatgtacgtacgtatgtatgtggggttccgtcgagtcgtgtgtgtccgtgaccgtaactggactcaattattatggagtaacataatatatattgtatgcgtggcgttccatcgttacaaatatgcaacagtgtctatcatcatagcagtagtgcagtggcggcagcgacatgtttcgatggatcagattcaaaatactttgggggaataagttcaccggaggtcccttaaccacaaaaccagaaatgtctacccctaaactcactcgaaccgttcaccggaggtccctcggcagtattttcgcccggttttgctgacgtggcatcctagtcagcaaaaaaaaattaaaaaaatacatggggctcacatgtcagctgcacatttttttcttctcttttcttctccttctctcctcttctccttcaggctgcaggcggaggcggagcagccgcgcgccatggccgccgtcgtcgtcggctctccaccgtcgtcgtcgccatgagcgaggctacgcggagcggccgtccggtggcggagcggaggcagcggagcgcggcggcgggcggagcagccgcgcgccgtggccgccctcgtcgtcggctctccaccgtcgtcgtcgccgtgggcgaggcctagagttacatgcacatatgcattcattcatgaatgtagtacatatatattcgatcgatcgatcttgtcactttcaaccagtgcagcctgcaaatcaatcacaagctgcttttgctttggtctttttctctctattgcatgcatgtatccctcacttgagaacccatagctagcatgcatgcgttcacgggcttttggcctttcttctctcgcgcgtggagggacgccattgccgccgacaagctcgcgagtgaagctcggccggctctctctcctctccggcaagaagggcgccaaggccgccctgtccgacgacgacgattacgagccccccgcgccgccgctcccacccggggacggcgacaatgacgaggagcccatcaacctcgtcttcaagggcggagatgaggccggcgggagagggggtggcgcgccgcatcggcgaagaggtcgttgccgacctcctaccgccgctccgcagccacacttgccccccgccgctcgccgaccaggccccccgctctgtcgtaatcgcccgccgtcctctgcccaccgctgctccgcctaccacgctcgtggaggtcaaccaacacgacgacgacaccggcggtgaagagctagagcatgacgagcgccgccgctccgctgccactctcgcccgctgccctgcccgccgctcccgccgtcccagctgcctctctccccctctcccgccaccgctggcgcgctcgctccacgccgcccaccgccgtgcccgcctcctctcccctctctcgcttcttccccgcgcgccgctgtgcccgcaccgctgcctgtcgccacgccctcatctgcccggccgcctcactgaagaagacgagaaaagaaaatgtgcagctgatatgtgggctccatgtactttttaattttttttactgactaggatgccacgtcagtaaaactgggcaaaaatactgccgagggacctccggtgaacggtttgagggagtttaggggtacacatttctgattttgtggttaaaggaccacagaaaatctcgctgttaagttgagagacccctggtgaacttattcctagtttgggatagagcgttgactgacgttggttgcgattgggcctctttctcatctttcgacaagtttaattgggcccccatcacaacgtacggcatattttatccccaacgtctccactctcacacctccctctctcctgagtcccctctttcaagatatttaactatttatcaattttacatatagcaatttcactaaacttacatatcatagatacatacatgatggtccacatatcgtaggttgtgagtaacaaatcattaattacaacatcttaaaagtaacgaatagttaaatgcccctacgagtcccacataagcaacctcaccgacgacgtcatgcacccaagccggtcggcatcggcagcctcgcctccactcagagtaggtgtacaatagcagactataagctaactataaatatatttcgaggagataccaaaacatggcagggaaagatttgtagtggcagatctatctcttcttcaaaaaagattatcaatcttggagtatatgtatagttagcttttgtatgagagctaacactcatttttttctttatctttctcttccacataagattatagttggcttataacccactgccatccttgctacatactctctccgtgctcgtaaaggaagtcgttttggacagcgacacggtctccaaaacacaactttgacttcttgtttctataaaaatatttattaaaaagtgatatatgtatacttttatgaaagtatttttcaagacaaatctattcatataacttttacattttcaaactcaacaactaactttagagttattcatgatttatattcccaaagtttgatttaaacattattctaaacgacttctttacgagtacagaggaagtatatcaacatccaacatcacaggaagccttctggtaagactcgcattaatgcattatacttgttggctgctgctttgtgtgtggtgtgttgttttgaggtgcaatcattcgaacaatcaaacatgaaggctctagcaaatgaaacctgaagatgtagatattctgggtaaagggtttgtctttcccttttttagtagtctgacagatcaattacaacctccgcattcatcttaggtattaggacctatttcgggaaacttttagtagctgtatctttcaacagaatctctaactctcccaaacagcttagattattacctagattctacaaatatgtatatgtagaatccataaaataaattagaagctagaagctgaaaaacccaacttcttcaaattcttagaaactggatactaactagcaaattatgagaatcttaagctcctcatttcatctatgattggcttgctttaaccatgcgaaaagaggtaacaattacgtagtactccctccgtcccatattatatgggattaggggttaaaaacgtgtctcaaaatataagggatcgggtaggtagagtactaatgcaaacaaacatcgggcagggagagtactaatgcggacagagagctgtcggtggaatttgtccctaccttatcctctcaccgagtcgcccatcgaccaccgctcgttcccctcccgattttcttcgctttttctctgtcccctccatcagcgcctccctcccacccgcatcttcttccacctcctcccatccatccgagctccttcccttccacctcccatccgtcgacgccaacgccggtggtgcggcggccaacctggcccatgcgccgccgccaccggtgcccaacctggcccgtgcggtgggggcaccgccggggaagcgaatcgaggtggtgtgggagcgggagaacacgctgctctcgttcggccaggccgccgcgcacgccgccgtcgccttcgtcgagttcaacgtccaggtatatatatacagcgcaaccgagtttgatgtgcgtgcttccatttccacgttgttggtagtacctgtgtttgttttggatcttacattggatgtcagtttacgctttgaattgtttgattttgacaccgctgcatcgcaatgcaagatttggaagctagcgtgggtatgacttggatgtagccattgattggtgtggtactggacatgaaatttgcagcaacgttctagccagtgaactatatgggacaagactcacaagtaggagtatcaatttaatcgcatttaaccaggatctagatgccaccatgctaaattggtcaagaatgaagaatggagcgattttaggtggatgttttgcagggatgtagttatccattaggcaaagtgctaggatttgaagttgcaattcttgtttagagctgaagaggttcttaaaacattgccaactactcttagatcatacggagtactaggaaattaacggtgtttaaaaaaactgaagtgtcaattttattaatcttaaacgctgttaggcacatcctatcttagattcatggtagatttaaaggttctatgtttcattttgatagtttaaaatttaaaattttataggaatataatgatttaacatgtcgccggcagcagtttacgggctggcggcagaatgcggcctagcggcagggttcgcgggacgtggtggttgctaggcaaagagccgcgtccagtggcggaaggcgtttgttttgacgacttggtgtttgtccctgactcggatgatgaaggggctggcaatgagttcaactcacaaggttttgacgacgaatttgtgcctgaaacacaacaagatgttccaatcgaggagattggcatagggttcctctcttatttatttaattattagtcctttccattcaattttgttaaattatgtgctttttgatgttccatttatttctccttacggtgcagccatcctgtgacaagcaaatcaggagggccgcgccagctcggagtgcatcctcgcttggggtatgtgattcacactagattgttgatttgggatggttatgcatttgtagcatgcaaattgagtcacatcttgatttatattgatttgtcttatcttctttacagtacaatgttgcacgattggcttcgggctatttcagagtatgagaagccaagcatcgacatggcaaccatcgagaaggcatgggccgatgagaaaaaggcaatcgctgatgcggactatgagggaaatccaagcaaggtgaacacaagctccgagaagaaggcatgtgtcgacgaggggaagtcaatctccgatgcagaaactgatgatgagggcgtcggtgtgcctgagaagaaggcatgcatcgccgagggaaagtcaatctccgacgcagagactgatgatgagggcgtcggtgtgcctcggaatttacagatgaaagatttgcacgatatcatgtttcctacctgctgaatgtgattgtgttgtggtattttattgtggaaatgcacaatggacataggagtacttagtgcaatatggatgtaagactaccatgtttataagtgtacaaattaccgtagtgttccatatggttgccagactagtacgaagtattttgttatggaaatgccctagttatagtcatatactcctataatatattgttctaatgattgtagtattgttccaaagttagtgctgaaattaactatgcaatgacatgttctgaaatgggttcaattaagtattcattgttatgaaattagtgctgaattaaatatagaatcacatattgctgattgctaaaactagttatgctgaattacctatatataacaaaagtctgaaatcatatttacaaactccatcggagtacgaaaaacaaaagtatggctaggctggactagttgttcaacatggtctgcatcaccacatacttacaaactccatcggagtacaaaagataaaagtatggctaggctaggctagtttaacaaggtgtgcattaccacatacttacaaactccatcggagtaaaaaaacaaaagtatggccaggctggactagttcaacaaggtctgcataaccttgttgtaaagtgcaatatcacaagtcagactagtagggagcatgttaagcctctccaatcgatccttgttcatatggggtatcttgtagccattgcctccatcggctttcatcacttctatgaagcaagcttgtagggttaggaaaccctactcaccaagttagaattatactcattgtactcttcgtccacattgctgattaattcatccatgttactacaatttttgaggtatgtcttcgattgaagagaagcaaagaaacccagatcaagcacattcatgtttggtgaattagggcgttggttcatgatgcgtatgtctaggcctacttgggccaccgcgagggcaaatgcttcgtcgtttggcagaatatgtgtccgtgcattgtcttgctgaatccaaatggtcttccctacatcttctctcggccaacaagaggcaatagttggaataacctttgtaatcaagaaagccctacttgtttctctcgacaccgtaatagattttgtgaccaatgtacccttcggcctgttgcgactactcctttgtgctggttcctaacatatagagcaaagaacaagttagctacaaagtgacttgaaagcaataaaaatagattgaatcaagttgagacttcaccttcctaacaaagggccatattcctattttgacatcgaagtagcaatttccttcctcatcatacctaggctttgcaagagctgataaaaacataactttatctatggcatttttattttgcacacatctcacaggttcatcttcattgaatacaaggtagaaggtcttgtttttcatagtggcgttgaaccatttttcatcaatatgcacaatgttttgcatgtctataaatcttggttcagcattcaaagtagcaacatctagcatggatacacagaacttgagcctttgttttttattagcttccttcaagtaaggtttaatgctattttagtgacggcgaagggctccttctttgactaacctatgcaccttgcttttgctagcattcaatgcgctagcaagagatctgatgctacaccttaagttcaaaggaagtgctaaaacctgatccaaatcaatgtcacttctttttcggccacaattaccaggcttctttgatttaaagtcaacttcaacacctgctgctaaacatttcttcgcctttgtccaaatgtcttgtacaactctccttgtcacatcaaccatagttgcaataattgttgtagtatctctatcaacaagtttcccattgatagtacttgcaagtaaagcaccataaatagctttgttctcagcttctggtaaatatttccttctctttatattgtcttgttgagtatctgcacaaagaaaatatttatatatatacatatcagttggcaatatattttatacttgcagtacactaatgaatgtcatttgcatgtcataccttcctcatcacttgatgtatggagatcttcatcaaagacaacatccatataaggagaataaacatcaaaatcctcctcgtctgcatggacagaaaaggtgagacatgagctactcatatgatatccccatctgcatcactgctgattacatatgagcaaaaaataatgtatgtacctgcataatttgattgatcttggagaacatagagtctgtcatcgtcaaatacaatatcatcttctccataatttgctgcatgacatgtgacgaagataaatttaaagttgaaggttgtacaaagaaactagctaatgaagtagtgcattcgcgcggctttaaccaccctgtcatgtgctttgtatgatgaaatatatagaaaagtgcattataaattaagtaaccattcttgaccacaaaagtttttttttgcattaggtcatctaccacaaaaaaaacacatgttcccatacctatatgggtcatccttcagtggtgttatatataaagttcataatattaattttttggattgttttagtagtttctgatattaaaaccagctttatgaaataaaacttgaactatgctgattccaactatttagaacacatgatgtacgcttataaactttggagattgttgggctaatggctggttatcataatgagcaaataaaatttatagagccatttatgatcatcatttttgcacagtaccacataagagtatatatatgactgatggctgaagtttacaactcttgactaaaagcaacaactgattgacactaatagcaaagttgcaaagctctgtgttatgcaaagaagtaatattgggcttgttagtttatgaatttgttcataaattttgatcatacaaactttgctactttcaacatttatgtttctgttatttcagcagaagggaggatgggaaatgtgagtaagaccataacttgctttgcattaagattttgattccatacctggctccatgtttagatgacaaatttcttgtgcactccggccattggagagttcaactgcttgcatggcagggtctggatgttcatcttcatgagcaccaaaacattggttgtcaggaagctcttcatcttcatattggaaggcatcttctccttgcacagcaggatccaggttaaggtcagggatcccatcaccttcatcttgtagcacttcttgcacaccaagatcaaggttgagatcaggaatctcatattcctcttcttccatggattagttgagggtctctcttggtgtaatgctggagtaggttgctaatatgagtgtaatatgagagctttggtttttagacctgtgagtgagagcaagggagtgaaaatggcgggttggttctgagcatcaagtttaaattttgaacagctaatgcctgtgtatttgtggcgctaatgtgtagtgcgtgtgaattttgggcagcaaagaggtgagtgggatttaattgactcttgtcaacatatgcattaatgtcattgtatactgaggaatgcttactctttctttgtgccaatcatttgctggcaagcttgtaaacccaaatagtctctcactgctagtgccagtactaagtaaatgaggggtacatgcatctttcgccaacctccttattttggatgaacagtgtccagtcccatataatgtgtgtcggtgatatgggcccgggggtatcagatttagagcgaggaggctgccccacgatgccacgtggtcctccccggaggggagtcaggcccgaggtagggtggcggccactccttcccagagactggatggaggaggctgccccccgatgccacgtggccctcccccgaggggagtcaggcccaaggtggggcggcggccactccctggccgagactagagggagaaggctaccccaggcgccacatggccctcccccgagggggtatcgggcccgaggtcgggctgcagcggccccctcctgtgactaggggtcgggctcccccgaccccctctctaggtcaccatgtacggtgggttaaatgtccgcctccaggtgcccacctacccgcatttatggcggctcgagtagtcgcgcaacgccgcatttaatgcggtgtgcaatgcactccaccggtctgtgaccggtcgaatgaccgatgggactagggtagtgcgcctgtgcgctgctcgtgtgtcaggcgacgtgcagcctgacatgtcccatcaaataatgatggtgagaggttctcatcctcttatcctagccagagtcggtcctcccgctctggtcaaagtaaggctcccgtttcccggtgtaataagagcccagaagtcctcacccattaaatggtgactaacaggggcaccccccgtgtcaggcagcaagatttgacaggcctcatcagcaagatgacgtgcgcttgcttcccaagtcaagagacaagacatgcatttaatgcaaagattgtaatccttctccactaagttatgtttttgggcccatgtggtaaccccttggagatataaaaggaggtccaggcctagtaggagggggggctggagcccctgatgatcaacaccttctaccccacaaggagatcttgtaatttctcataagatcagctaagcacaggagcagggtattacgcttcttagcggcccgaacttgtataaacctcttttgtctcatcgtctttggggggggctaaccccctcaagatcacacagctccgctcaccaagccctcgaatctcacccgctgcccccagccgaactcacaaatgggggcctcatggttccctggtggaggagttcattctccgacaatgtgggacggagggagtaccagatacgcacaagcacatagacttgcttgcggtttcctagagtagggtaaagtggcataagatttaacataggattatgcttaatgggggagtagaaactaaacgacgtttgagtcttcaatctcctctaaccccccaaacccccgaggacagtctcaactctctatctcaagttctcaactactacctccatattttaatgcatggcgccgttgacttttttttcaacgtttgaccattgtcttattcaaaaaatttatgtaattattatttattttactgtgacttgattcgtcatcaaatattctttaatcatgacataaatattttcatatttgcacaaaaattttgaataaaataaatggtcaaatatttatcgaaaagtcaacggcgtcatacattaaaatacggagggagtagtttatagcattaaatatattgtcattgaagaaaaaaactaatatagcaaaagagttattaataagaaaagaggaaaaaaataaagtaaccatttaagaggaaaaaaaaccttttcgtctctcactgggccgtcaataaggcgtttgtacttgatgggtaaatggaccttttggtcagaattactctaatcgaagaataaaaatcataaagatctaaaaaaaaacataatgtgcaagatctattccatattcaatatgaatgaatataaacataatgtgtaagatctactccatattcaatatgaatgaatatactaaaccagacttttgcatcataaagaaattagctttacacggtacagacgtgtagtcacctttctccatatatacgctgcccaggagatgcttgggcacaaaaggggcggggaaaaaaacagaaagcgaatcgagcattactgaaacataagcaagataagaaagggagagaatgtgtaaaggaaaacaaagaaggagaatagccgatgggtcaaggaaaggcacacatgcttgaatgttagctggatagatacctcgctttgcttccgttgcattttttcttctcttgtttttcatgatgatcaagactcgagggagagcaacgtccattatccatcattttgtctttcgtctcgtggactagtctgttgccttcttttctttttgcttaattattgtattgtcttataccgctttcaattactgtacatggctgtacttttgtgccccattaactctcccaatttttttcctctttattagcttgtactatactaccccaagtccccaacctaaaataaataagtgcatcttgtccaatatttgatcgttcgttttatttaaaaaaattataaaaaaataaaaaatatcacacataaagaactatttatgttttatcatctaataacaataaaaaatactaatcataatttttttaaataagacgaatcgttaaacgttggatatagacagtatataattatacttattttgagacatttagagtagttgcttgctgtttctttttcttctctttctttcttataccttccggttccacaggcagactcatcgtatggagcggatgtcgtatcataattatatcatatattagaactaaacacaatggacacatgttatgcttatagaccacgtattatgtgcattcttatccgtcctccacatgcactcacacctcacctgtcggtggggccaactaataattaatactccaacagctaaccaagcaatactctatggcaaaatatctttattgtactctagtagattagatcactaataaaaagtagaaactctgctgcatattactccctccgtcccataatgttgcaacctaggatgggatgagacccacctagaactacgaatttgaacatgaggacccatcttaggactacgaatctgaacatacatgtccagattcgtagtcctaggatgggtctcatcctgacccatccgagattacaacattatgggacggagggagtagtcttctatcttaagctgactcgataaaagtactactccctcggtccctcctcctaggtttagctcttaaaatttagcctaaaatataacatcttattcatcaatattttttttccaactaatcctaaatcttcaccatttaatttttctatttatctttacttcttatctaattagattttctttaatttacttgtacctattttcttattaataatcatgtccaactctaaaatttttatattctggaacggcctgcatagtggtgtgagaactttgacctttgatccataataattatttagtgaattgagctagtggtgttgaaaattccatccattaaataattactcttgcatactcaaataatgaattaataaaatgtagtgaccgtgccgacggaggaagacgaagacaggagacggttactggagttgagtactccacccaccacaccacacaagagagagaagggttggggttggggtcactctttccttttctctgttgttgttggcttgatgatgagctgattcgcataattccaattccaattccaattataattccaagaggcttatcatcaactcaactgaagaagaagaagaagaagaagaagaagaagaggaggagggttgtgaactgatttgggaagggagggggaggaggaaggcgatcgatcggcgatgggcacgtacaagtgctgcctatcttcaagcgccgcttccgctggaacgacgcgccgccgcccgacgatgtccgcgccctcttcgccaaccactccgccggcggtggcccccacatggccgccgacggcctccgcgcctacctccaggccaccggccaggacggcgacgtggacatggagcggctggtggagcagatccggcagctgcaggggcgcggcgggcgcatcccgcgggtggggcgggcactcccactcctgacggtggacgacttccaccgattcctcttctcccacgagctgaacccacccatccggcacgggcaggggcaggtgcaccacgacatggccgccccgctctcccactacttcatctacaccggccacaactcctacctcaccggcaaccagctcagcagcgactgcagcgacctccccatcatcagggctctccagaggggcgtccgcgtcatcgagctcgacatgtggcccaactcctccaaggatgacatcagcatcctccatggcaggacgctcaccaccccggtctccctcctcaaatgcctcctctccatcaagcaacacgcctttgaggcctccccttacccggttatcatcacgctcgaagaccacctcacccccgatctccaggacaaagcagccaaggtatatataatcttcttcttctctctgtctctgccttgctcgctcacttgccaatgggccagatggttcttgaagttttcggcgacatcctctactaccctgacaaagatcacctcaaagagttcccttcgcctcaagacctcaagggccgtgtcctcctctccaccaagccccccagggagtaccttcaagccaaggatggtaatgctgccaccatcaaagaggacgccaaggccgccgccactgacgatgccgcatggggaaaagaagtcccagatattcactctcaaatccactctgccactaaagtactcctcatattactagcttcttcttcttcttcttatgctcatagtagagccagtttcttacctgcagggcacacttttgtttcattctgcagcatgaccaaagagaagatgacgacgacaccgatgaagacgaagatgacgaggaggaggagcagaaaatgcaacagcatctagctccacagtacaaacaccttattaccatcaaagcaggaaagccaaaaggtactctacttgatgccttacagagtgacccagaaaaggttagaaggctcagtttgagcgagcaacaacttgccaaattggcagatcatcatggtaccgaaattgtaaggtacgaatctgctaagtgaatgaagttgctcttcctttccatcttcagcatcagtgaaaatgtttttttttttttgcactttataggccatctctcgctaactctgctgaaatgcccaatctttttggccaaaacaggttcacacagagaaacctactgaggatatacccaaagggcactcgggtcacatcatccaactataatccatttcttggttgggtgcatggtgctcagatggtagcgttcaatatgcaggtgaggtgcacttctgttcctgagcagttagttccagagtgatggtttagctctttgtaccttatttccaattcagtaaattcggtgaggaatcaatttgctgaatgcagttaagtttacattttatcttataattatacctgaacgattattatggtataatataacttcagaattggtggatcaaatttgagcaacctggaatttctggctccatgttttctgaatgcctgtcaagttgtgacatttgccgcttcttttaccgttgtcatattaaaaatacatgaaatttcttgcagggatatggaagagctctttggttgatgcatggattttataaagctaatggtggctgtggttatgtgaagaaaccagatttcttaatgcaaactgatccagaggtttttgacccaaaaaaatccctatctcccaagaaaaccttgaaggtatgcatgcctgtcattctttttgtttgtgctcgtctgtgaaacctggagacttcactgaagtgctgcctttcaggtgaaagtatacatgggggatggttggcggatggacttcacgcagacccactttgatcaatattctcctccagacttttatgcacgggtacgtacgtggattgaatttcataccgaaaacggttcgctactccaagttgatgtgatattatggaggtgacgatggaaaatggacttgtgatgggatgatggataggtggggatagcgggagtaccagcggactcggtgatgaagagaacgagggcgatagaggataactgggtgccggtgtgggaggaggatttcaccttcaaactgaccgtgccggagatcgcgttgctgcgggtggaggtgcacgagtacgacatgtcggagaaggacgacttcggcggccagacggtgctgccggtgtcggatctcatcccggggatccgagcggtggcactccacgaccgcaaagggatcaagttgaacaacgtcaagcttctcatgcgcttcgagtttgaatgacccaacacaccgacactttctttctttctcgccgcatcgcattgcactgtgcctgtgcttgtgcagcatccatcatttggtttggtttttcatgttcctgtgcatacgcatttgtgtctgtacataggctcggtcctgtatattgtttgtgagtaacatgtaataataaggcttcacgccatgttcattcctcctgtttgaacccctccaaatatattaataccgaaggtacaaaatatctcaacggcagacggttctgtttgcagggcaggagtaatttggcaagtgcgctatgtaataactaaactcgaccacaaaaagaccatatacagttgaaccccccccccctccccgccaaaaaaaaaaacgtatgtaacaaatatcagacattcttcaggcacaaaagttcaatgaaaaattttagaaaatatagaccgccaaagatgaaaagacggctaagaatcttcccatttccctagtcaaggtaaaactgtatactacatatccaactgcccagctacaatgaattatccaagtcctaagtcctaacaagggtctattccagacccatcttgaacttcaatgcccacctccttccggcatataactaatacagaaagggaagtaaccaatagttgattgggacgtcacattctgcagagacaaaatccgcagacaattgcgtgtttgttcagttaaaaacagagcattataatggcatttattatgataaaacaaagagccaaaaattttgagatatttaccacggctgccgaagaagattagctaacagcggaagattcctgggtcacttctgtcgtagtatctgcagctgaactgctggtttctgcagcctgattttggctactttgtgcttgaggtgcaggttgctgttgatcttcagcaagacccaaaactaccaaggtagacctgccataaaatggaagctctgaatcagatcctgccctcgtgtacttgaaatggataagtagcttttatgctggtaagatatagggttaagtacaaaccttggaagagttgatcgtacgttaggttggttcgcgtgctcaaccaaaggtgccttcagtacaggattcttattcaaggcattttcaagttgaggagctggtaactgataaaccaagtttgatgttatgaaaattattggcagtttggcactatgataaaaatgaactcaagagccactagcagatagcatgtaaaacagctagcggatggtgcacatgctacagagatttttgcatacaagaacaagtagattctacgtagaagcaaaagtgagccaacctgcagcagcacaccatatgactgaggtttcgtcaagatagcacacttcaggaatcctacccataacttgggatacttccatatctgcaataataaaagatgacatgatatttccatatccaaaattatgtaaaaccactgaaactaaacttaaaaaaaaaatgaaaacctgcttgctaacaagacgtgacatgatatccatcacaaagtccacctgaaaagaaggcttaccgtcagattataagaacaagaaacaggtctataagattgagaaataataccgaaaactcccaagagatttttcataataaagaattgcaatgctcgtcaacttcaatatgttatcatgccaacactgtgtaataaaggaagttccacatgaatatctttgatagtttgatggtcccaatcctccatcaccttcgagagagtggaaaggacatatattaccatgtaactgctttctcatagaatcaagtggataagtgcacgcaccagatatgaagcaagcagttgtaaacagtaaacacaagtgatcaactctttgcttcttaagtggcagtaaaatacaactaaagaaaaatcatgaatggacactttctaattgaatcaggcgcaagcaccaaaaccaggaaagggaatgtggcctactcaacatgaaccacaggtagatcatgtaacagcatgaccgtggcatttcaacttgatttgttgtactatcagcagatgttaactatatattataacaccaataaactatcagccacagttagaatattgggttcatgcagttaactcaccaatgcaggaaatgcaccgattgcttgcataacagttcgcataaacagcaacggaagtggaatttgttcaacctgaggaaaagtagagcttgagcaatgacccaacaactacatcatatcacaaggcaggtacatctgaaaaggcgaaaaatatgatcatatataccagttggttcagtgctttcgccaaaacttgttgagtgaatattgtcctttgctcaaaacaagcagcacaggcatcaataacctatcataagataaaatgaattaccaaatttatcagtatattaaactaaatcgccaaatgatctatttaaaaatattggaaacagacctttttgagtggtattccttctttctcaggatctattacatgaatcgcaatcaaaatttctgatggatcaagagaaggcccattctgcggtgatccctgcaatagtcagcaagttataatgtatcataagcccgcacaagctgggaaacccttaaaactaaactgaatcaatttaccaaaaccaaacaagtacactgaacttgcactttgcaacaggcataaaaataaaattttcaacaagtaaaactgtaatatttacattttacaggcagtaaaaaaaataaacaattaccattgtcctactttgagaaaaataattaaatgaaaaggaaatcatatcatgaaaagaaaaaacatgaaggaaaaatcaaacatgatagatgagctgtggaatcatatcttattgtcttattgaatgctgcaaatttgcagctaataagatcaatcagtgtttgcatgtaatatggatcagttacggtctgatggattcttgcggtgtgtgagtgcctttgagtaaactttccagtatttttctagataaaaataaaagctcccaaatctttataactgcaacaagaaaactgtgccctactaacagaagaccaaagttaatccactttgttaccagttaaagtcatgcattatcttctccccccagtcaactttacatactttgacgacatagttggcctaagaaggatagctaagctactggatggtcattgaatacaggtgaatttttggggtggtgtggcactgcataagcttctttctgtattcaactgcagaagtctaatatataatactcacgtgaaacatataaccccaaaaggagagggtagaaacaaggttttactaaaaaaacattaaagttgttatttttttacgtcaaaggtgcaacgaaaggatcagcttggacatgaacttaagttaatactcaaatacaaatcacagttaaggatcagatagaaaattaacacagcatgcacatatttcatgccagacaaaaactaacctgcaggattcgagaaagtgcaacttgaaacttatccaagggaagattaacaatactgggaaaaacagggaggacctgagaaaaagcacaatgaacaataaatgtgaaactataataataatacaggtgacatattgatgcctagagaccataaaagttccactaatgcaacatgccatgcattgtcaaagattcttaacacggaaaagttggatacccagattagtcaattattaaatgttaatcagcatatgtacaccttctaattgaaacactccattgcaaaaattattaccacaggttttgcaaatacaattcaaatagtataaattgtgagcaattcagcagcatatgctgattaacatttaataaatgacagtacacaacagtcattaggtgactgcaggaaatgaagacttaaagtaaatataaactactgcataaattctatagttcaataaaactagaaataaggtatgcatgctgctggttcattgtaatatcttcaatgttgcaagggggagaaaaaaacctcatcttttggcagatgagccaagactgcaaaaaggacctcgatatcctgcaaaatgaagccagaatgttaatagtatctcaggtgggaatcagtccagaaacaaaagttgaactctgataaagataagtaaagaacctttgttttagaatataagttctttacagaggaaatcagatcttgagatggcattgctccatcggtgagtgtctgtaaaacctgtgtggcgatgcaatttcatgggttatgatgtattcagataaaacaaaccttttaagaaaatttgatgaaacatctttttctgtacacatttaagcagaattttggatttttatcataaaagaacaacttgcacctgcatcagtaggtcccgactatcagctggtgggtctgagatgatcccaagaagactgggagatgagcctattgtgcggatcagaatgggtacttgtcgatgaactgcctgaaaggtatacaatatatcaaatggatatagtttattactgattgagccattggcatggcagagagaagcagtcagcacagacctgcttggcagcttgtggtagacttccatatattgcaaatacatgccgaagaagggaatgcttctggcaagtaagatgtaaattgcatgctgttagtaaaatccatagaatcagatcaagatgttaaactttagtaaatactaaccttggtgcacaaagcaaaatagagtgacatcaaagtttgagaatctgctactgaagacgataaattttctgaaccaccatccttcataagacacagttcatcccaataagaaaaggcagcactataattcacttgaaaaggaacagaaatgtactcaaggttatcttccaagacaatatcaattaagtcatctacaattctgcatatcttactcatcactttttctttttacatcacttcgtaggttcatctatatgactttattcgtctgtttttcatctgtttcttggttttagtgtattacttggttgattttatgacaaagttcaaccgcaattctatttaagaatcaactaaactgtaataagtccagaacagtacatgtgaaagaaattagagcataaatcaaaccttgggtgcttctggagtagacatttcagaagctgctgattcatcagctggaactacttccagaactgaattaagtttttcatttgcaaaatcttcaatcctttttgaaatgcttgccataggaaatagcttatttgctacctgttattaccaaatgagaaacaaaatggttaaaatcacataaatgcatgtttcatgcaagcacaaacaattaggtcaattaccaagcgtattgccttcatgcggacctcatctagatgatggattgaactctgcaagaaaaacttctacttagaatcataaaaaaggaacaagctatacttgaaccagaaaagtagcactagagtaccagtcaacaaaaccaacatcaagtcctaaccagtatataagtttcattcattggtaattgcacgtttggagttcaatctgacgcttatgtccataaaagggaaatagagatgcaaaacattactcatattttgagtgttcaactgtcctgaactcttccaagacacatgaaacaactaaaactgacatcatgtcaaatgactcttgcatgctctaccactgaatcaaaaatcaaaatagaaaactntctcatgctaccacaggtggagttcctgacaatctcatgacagtttgtgactcacaaaaatcatgtgagaagagctgcacatctaagcaagcgtatcgcacatttacacaaggtgagtaaatatgtcatgaagtcagtctagcacctgcaaagcgatctccagacatctgtctcgatttgaaggtcttaacatgataaggttccagacagcactaagtccttgagttaccctatcaccactctgcagatccttgtcctgcttctcattgcttccaggagaacataagccctctagcaacttcaatacaccctctggtaagtatggtatctcacaaagtaattttccaagtgatttatctgaagccggaaacatatcgcgaagattttcagcctacgccaaataagaagtggttggacatgatgcaagaaaaacaatacagtgacaaagttagagatatcataagaagacatacaacagtcagaagaaacgattcataaactgatgttgcagttctcgatgaaaggaagtcttgatcctgttctgcttcacgatacaacctgttcagaatgcacagtgtcagctcgtgtccctgctcaaggaaagatagtcagaccattgtaaggggtaaactgattaaagcatgtaattagataaagcaacagagttacatgaaacataatctgggtaaacattttgatataataaatagataatgatcatcgtcataggcttgctatataaataagaatggagggagtagtttggtaaactagaatgaagataaaaaatgttgtgtctagttaactggtcaagatattggcttgctagttgaaccacataccacagatacagcgccagccctacaactagaagttaaaaaaagtgaagctgaacaaacatattttatttccataaatactttggcaatggaggttggggatatgttcttgtaattgtcatggtagttgtcaagtatgatctttcgctgccagtctaccagataggtagcattctgtgcaaaatccgtaacgtttagcaaggtaatttggtttgaatcaaagccatgtggttgaactggatttttctcccagttcagtcacctaggcaggactaaaaagctttcagttctctcttttttttggtatggactaaatcagttcccatccaacacttgtgtttataatagagaattgataccagttgcacccagtggacccaaaaaaaaaactgtacagaaaagaaattctatgattttgtacacctgtacctcattatttacataatcagacagtacatgcttctggagaagctcccaagggtccaactccaaagggaactgcactatcaagtagcataatgtaaaaggagtgtaactatgacaaaatacaagaaactgaagcatcattggtttaaacattgcaggcactatcaattaattgcttctgcaaagaaactgtcaatggataaattaaccaaacaatggtgcacacaaaaaacactaaccgaattgaagcaaaagaatattactctaaaggaggcaatgtaacatgtacctcaacacccaagtgagcaagcaagggaagacgagctattgaaccaccagatgcatcttgtttatcacaatcaagaatccgcaaaaatgcttctttttgaagtagatctttagcctcatcgctgagatcaatattagtcacaaccaactttggaagcacatgctgtgaagtaagtgtgcttgaatatgagaactgagtctgacttgcttccaccatagaagagcttggactacgagtttctgaagattgagccaaactaagaccagctgaggaattatcagcaggcaatgaactaataaaactgccaccatgctcttgggttccttgaagttctgttgaagcatgggaagcttctgatgattcttgaatctcaattgataacctagcggcatctgcagtgggttctttagcctctatagtttccatatcagatggaattgatgaactattactattctcctccataggtacatttcttgaggtaggtccaggaatggcaggaattgctgcagtttcaccagcagcagatggcacaacagcagaatctatagtttgaggtgcttcatcgacctctcgatcattttgatttattctctgaagacaaagttcaataaacaaaagtcaaagaagaaactctaatgaatcaataaaatctagataaaaaaccaaccttcaataaagattctaacagaggaaagcatgctgaaagaagacttgaactcggagcaccagatggctggccagctgaaggagattgttgttggtctacttcaggatgagaaactggcaggtgttgcatgttaaccattaccacctctgctaataagtcagcagcaatactggatgacaggatttgcagtgatccagccgctctgtcaccttgagcggctaatgcagcaaacatactaactaattgatatacagcttcagaatttccagtacttgcagagttggacgggctagatggggtatcagcagaggttagctccacattattctttacattttcagtatgttcttgatcatgatgtgattgcctaattcttttgttggaacgatcaccatcttctggcgcattatcgatgtcatcgatcagattacgcttgttactgttatctgtgcttg

SEQ ID NO: 68113 - DNA, 6634 bp, Oryza sativa
taaagcatgtacccagcctaggctcacatgaacaggatgcaaggcgtacaggaaatgagcatggttcagcagaataaggaaataaagcatatatatctcccacattgccatgacactaccaaatatgctgcctcccaggctgctaaagctgacactaaaaccccacatatgttgaagctcatgcctgatttagtgctgcctgacaaattgccaccgcctaacaactgcgtgatgttattgtctccccaagaaaccccagcttgtttactgccaaagtccaaactctccaatatatgatgctggcactggtaatgaacttatctattggaatgtggttccatcaatcaagaaaggcaatatgcaaaataaagaaaagaactctgatattccccgggagctgggagtaattgctaatttcgattatatacggttaaaatgtcacaatgaaggaacttattttatgcttagtttatggttagaatggtacaatagacataattggtttagtttagttctttttcaccactcccataatacatgcatccaaccaaagtactaaaccatactcactcattcatcctgcatccacaatctaaccgaactagtaaccaatcaaaaacattggcgccttccaggacaaatgagaccaaagatgtgattaactgagccccatctaggaaacccataggcacctaagcgacctaacatgtgtatacagtatgcaaaactcttgagtacactgaccaaataaaaacagcatagcctcttacataataaattaattaactacagtttttaagcacataatgaaataggcacggagtgatacatgtgaaacctgccagtagaaagaaaggttcaccgagaaaaagttaacagacaatatcagatattatgaatgcaacatttataagttataagttactagttgtacaagctaaaagaaataccggctctgcacttgaatgtgtacatttcaggcatgcagcaaaggcactcttcaaagcatggaaagcacctgggacttgcactttaataatggaacttgctggatccaaagaaagtaaaactggaagtatgcgtccgtaaaatgaaggtcttctttgcgcgatagctgagaggctgagggaaattcatgttagaggatgaggaaaaaatggtagaagataaaaatataacatggaagaaacctgcactttcttctacaaacagaatgaataaatgttacaacatcctcatacaggaaatatatttgttccaagaatggtaagaaaggtaatatatagaaaagacagtggaacacaaatggatgagacaaacctagtaacaaagacaatgatcatggaagtactgagtgattttactttaggaggcttaagctgttctagcagcaatccaaggttctggctggcttccattgccagatctccaacattaagcaaagggtgacctcctctcagccacgctacattgaatcccatatctacaaaaggatttacagatgacagaccatcatggcacaactccaaaatattggcaaatgtttttttttttgggggggggggggggggtatgaaatgccgtgtatgttataccttctgtaacttcaattggtggatccggtggggtatcaagatcaggggtgtacaatagaactgttttttcaacaaatttaatagccagtaacctggctccttcattgctcatcggctatacagcaggttacgcagatgtaagaaatggcaggaggagaggatgaaattgaccagccacgaggaaaaagatagtgccttacctgaaaggccatgtgtgacacagcagatttaagcttgagcagtgcctcccaggataattttaatgaatcatcaatgccaccacttgagaacaagccctgatatcaaatccggcaaaccagcgatgttaggcaaagttcacccacacaggctgctcgaagagcttctgataaaattacctgaataactgctgtcgtagtactttggcaaacaaggttgttcctgttttaatagcttgccttgcgaccgcaggtgtgtcatcgttgagaagatgaagcagacaaggcatgacattgggaaggtatgccatgtgttttgacccaacctcaccaatcatcctatgtcggggtagaattgacatgcacatgtagcaaaaaaaccatgagcatatacgagcacagtgaaaagcgtgggcagagtattataatttctaatagacgctcttatgaacaacaacaccttgagcgagcaggctcgtgtacagtattgttaataactagcaagcgctaaattatcatttgttactgttggtgagtggtaaatagaagagtggaaacttagcatcgaatgtgtgtggaaataaaattacagagtgactcaacgttgacacctaaaccacacacaatccaaatataaaaacctaggacgggaggatgaaattgggaggtccaagaccaagaggagaaagggacactgactcggcgacgagcttgcggacggggctggcctgatcggcatggaggtcggcgatgcgggcgacgaagtcgaggagcggaaccctgcggagctggcggaggcgcggctccatggaggaaggcaaaggcgaggggttgggatggaaggtcggcgggaggtcttgggcagcggccacagccatcggaaccctagctcctccgctccggccgccggcgctcactccgccgtgccgcctgcggatgggttgggctttcccttttctttttttttttagaataatatgaatatgggatgggttggaaaatgtaaatgggcttacggtgggagggatgtcatctggacttaaatcatcagatatatgggctcaaatttgagatgcacatgaaataggaaataagtccacctgtcatccctcaactttacgtcgagtttgccagaaattttcaccctccatcttgacaaaacgggcccatctcgctgagtcaccactgaccgggcctatatgtcagtggataacctttcttcttcctccaatcctcctctctctctcctctactcctatcaccctccatatgtaattgctacagtatttgaaacaatatataaatgtaatgaggcattgaggtgtgtatataatggatatatcaatatggccttgtccaaattgtcactagctttatgctgcgtcttacaaagtacagcacgcacgcacatcaaatctagctacatatccttcaatacatgtatgtatactcctatatatccatggaaagaattgtgacctccatatctccacacggacacgcacatatatatcgattgatcggcgatatatataggtctctttctatctgtctgtggatcgaatgttgaatacatgtccaggtcagtcgcagctatctaattaagctaatttaagcctccgggcttaaaagaattgaaggaaatgtaaaattaatttagttagcagggtcggtctggtagtagaccacatctccggtgtcgctgacatagtggtcgcgtttcaagctccgggacagcgctccaaacaggtgtaagggaaaaggcccagacttgtccggctccctgtagtatttccccatcacaccctttgctgcttccgtctgcacattttcatcacccatgcttcttagtaattactcagcactacgtactgataaacatcacatagcataatttaattactagtactccgcatgcactgcagagactagagcttaccgcctcaattagatggtaatgcgggatttgggggaaaagatggtgaatgacatgtgtcccgatgtcgtggtggatgttgttgatccacccatagtccctgtccactgtcgtcagtcctccccgcaaatagctccattcctgtacatatcatcaatctattcagtacaaaagtgcaaaagtgagattattattatttggatttccttgagtaattctctgcctacgaacattttctaaagaaaaaaaaaagaaaaaaattcactgcctcacagtatgaattctgaaaacgatgcagctctctaggaaaaagatgcatgtatacaaaagttgtgatccaacttgcatttgcatcatggaccacaacgtattgtgattttttgtggacagaagatcgcatctttgcattatcatctagtttctatgactcgtttaatcacaggctcaggtcaaagtcccttcctaaattgactatttttgacaaggtagttatgcctaatctttttttttctacgtactgcaatcaatcgattactagatccaacggcataaataaaagttgcaacctagcttattcattcagtgtgtgagccatgcatacatatatattgcttgatttctgaatatattaagcatgcatatagtgtgagcgagtttaattagagagaagaaatgatgtatatatgcatgtcgtctaatagtaattgatagtaaaaaatgttagtaattagttaaacggaccttgccacggtaccagggcagcttgtcgttgtggccgtgatggtgcaagtaggtgacgaagtccagccacataacaaaaatctgcagagaagtagaattgaaatacaaactgatgagaaaagaaagcaaggtaggttttgttccccacatccacaaaagaggagatcgagggcaggcagaggatagaggaacccaatccacagatcacatcaatgaaccaacgtatgtatgtagggggtaactacgtacccagtaagggacaaagtagaggttgagcatgaggaggggtcccatgaggaaggtgaggcctgcgaggagggcagccatggccacccagcacgctgtggatgtcagcacatcgttcctttcgttgggctggaacaggtcgctgctgggatggaaatgcgaaccagactttcctgggctccgagaccactgcatgcatgcaatatatccatccattcatcatcgtcttaatcatcacatcacatataaatatatataatggaataatgaacgtagagtacattgttatgctagtaatattagtagagtactagagtagcaattaattaaccaggtagaatgggtaggcgagcatggggaagggtatggagaagcggagcatccgggtggctctgttaaggctcctgtacagccgctcggggagctgcattttggattggattgatcagattcatttgcaatggggaaacccaactggagtagttgcaattaagtagtgaaatcgagaaggaaggaaggaatgcgtacgggatgccaggactcatccttgtcgacatggccatggttctgatgatgcgtcctgtggctaatcctccagccatggtagggtacgaggatggaggagtggagtatgtggcccatcacgctgttgagcctcgagttgttggagaagctcccgtgcccgctgcaattccaattccatgaacgaattaattactactagtgtagtagagtggagtaggaatcaaaatggaaatgaataccgtcgtaccagtcgtggccgaggacgaagagcgcccagaacatggttccctgcgccgcccagtagagcggccaggcgaggcagctgtggaggcgcgcggcggcggcagcgagggcgaacaccaccaccacgtcgcgcagcacgtaccccatggatcgccaggggtccttcacccaacagtgcttggggatagcggcgcggatgtcggccagaccaaacgggggcgccgcgcccgggtcgaagtcctcacaaggaggaggaggagcattattttcattgtcgtcctcctccacggtggccacgcggctggtgggtgcggccacacgagcggaggcggacattcccaagtgggagcgcaaatgcaatggcgcgacggcggcaggggaggagggggagcggcgcgacgccggagagtagcagccgggccattctttccttggttggttctactccaattggtattggtaagctgcgcggcgccgcccccgcctgggtttatcaacgcaaaaaggaaaggaaaacccaactgggttgccggccctatctatctatctatctatccatctgtccgtatcccacttttgggaactcgtcggcaaacctcagccttccctccactccatccaatacctcatcaccttccaaaccaccccacccgttacactcccaaccacaaactactcacatccccatttctcttcccaaaactaccttccactcttcctacatactagtatatcattacattctgctgtaatacaacatattactatcttttttctttcaaaaaaaaaagagagagagaaacattacattctcgtgtagtacaacatgaccctaaagctaacgtgtgtataaacgaccaccgcgacaagctcggagaaatatgtaccacaaacgaattatatatatatatatatatatatgtagtgcatacctaaaaatgataaaacaaattgacgtataagatttatccacatcaccacaaataaaacttttactcgtgatgacatggacaaatctctcacattcacttcataatcagacagtttgtcttacatataaagtttgcgctacatatttccccaaggctcccctcctactaatattatacacaacaccaccagatggcacacaatgaatatgaatcaatggc

SEQ ID NO: 68114 - DNA, 2113 bp, Oryza sativa
  unsure (1)..(2113): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatttatattagtttatcaaacgggcgcaatagaactgaggtaactctgacttttgccgatttccctgttcttttttcacaccatatacaggatcttagtttgtttttatgacaatttttggcatgctgaattttatgaagatttttgatattttgactttttagtataattttaatagtatatggataaacttatagtgtgtatgatcaatgtattgttggagagaatgtgcctttctctttatactagagcgcattcctcaagtcaggaaacatgactaactacagctttgattgtccacctcaaatactacaagtaaaatctgagaattgtagtgtaggtaagaaaggagaaatgttagtatagatctcatgggaatatggtttagttatatgaaaggaaagagagtcataaattattgttttaaatctagaccatattcttaagttttaatctggaaagttctgtaagtccttaattgggaggtccaatcctggctgtcccagcccaatcctcaccaagaccagttcattttcgttgttggtattgggccctcccatactatgcctgagtgatgtgatcttcactgcgagcatgtatgcatacatcaatgcaagagcctggtaatttttgttgaaaaataattatcttacttttatcatgagcagatctctgccagagctggctattcttgctgaaagctccttaatgtcgttatcaaggtggagttacaaggcaggcatggagaaatctatgagctccgcaaatggacagattgctctggtaaatcgttttgctttgagctgtaaattggtcctaagggttcggttggtttatgccaaataatacattgaactttggtgtcacatatcgccagatgtttgttgattccttttttctgttgtttctggaacgtttatatttgagcgcatgctcaccgtgccaactggcaagaacagttgaagttgactttcgctagtaaaagtcacctctaatcaattccatctttaataggaaactcaagatttaatttagaatctccaggtccatctacctattacaatgttacatagtgtggccacagtacatgcgaatgtaactaatgcattagcgcacaatacacctttttttcacaatccactaatcatccttgatccagtgggaaatgttcggggaagaaatccatcattttttattctgatcttccctctgccacaggtaaacgggttgaacttgcaatcatctctcttatagcctcagagaatgccttcaggtacttggcttttctggcatgtcttctgtgtagtttttttttcctgtttcagttcgatctgctatttaggttaagaagcatagtcccgacatatgaccatgcactgatattttggcattcacaattatcattttaggcttccagagtcaatgccatgccttcatgacaaagtacttgcagcagctgctgaagcagctattaatgcctcaatggaccagaaaagaaaccaggtttggccttgttagatcttctatgtatcatcatcacctgtgtacaatttggcatgacaatgaaaattcatctgtagactccagcaggaggaattcttggtggcatcattaaaggattgaaaggcaaagaagaaaatgcaaaacagaaaggaagtttaagtgcacaaaccatgagcgaacagttggaatcgattttcttgaaagaatcacttgttgaaccatcaatacccgatcctgacgacccatagaagaactgtcaataggtcatcttcctccctgtctatctgaaagctttgcccttaagtactgcctatttatttgaaagcatttgaatgcagacgacatagatatcgatgatgaaattccactagcacccccaccagcatcatctacatctcatgtgaataaaaaaacaacagggctgcag

SEQ ID NO: 68115 - DNA, 12094 bp, Oryza sativa
aaagaaagcagttgagagatactagcatgaaactgataagaatttgatcatctgtcatatgttcccctttaatgaacttgtccccaaaaaatttcacagagggcattgctgatttgccaaatgtttcaagaatcttgttttttccaagttcaaaattagaagaaatttcaattcctccaacaggcaatccaagaataatatgtacacaatcttctgtcaatggaattactttgtcatcaacaactatatcagaagaagacacatctacatgattagcaatccaagaggcaaactgatttggaacaaatgaagactggaaattcagcaggcttttaaagcaagtccttccaataacttccttatcatgtactgataaattgttgattacttcagagaaatacttcacattgaatctagtgaaaacttcttcacacttgttatctttctcaaaggtttttctctgccaaaaaaatttaaagaaaagaaattaaaaaaactaaagaaaaaattattcaccaatgtaataaggtaataaaattaccttattttcagactgttcaccaagcatgcttaatttcattttcaaagaatggagaactagatcattgtgaatctctaacaatgcatcatcgataattgagtctgattcaactttttgtctctgaaaataaaaaatatcatattaaaaaaataatgtaaattacaaaaatctaaatatgcattaatcataccttctttttatggtcatgtgtaaatggccttttaccaagcttaattttcaatttcttcataagctcttctttagttaaatgaagcaaaggatcattttcctcaaaatgttggtccttaataaaaaaacaagaagattcaaaaaaaatattgaaataaaaaataaacttccatgataaatgaacatgacaaatgaacttacatgattatcagaactttcatcatgattagataaatgaacatcaccatcatgattatctgaactcaaactacaatcattgtcactgttagattcactggaaatatccacttttgatctttttctatgacccatactgcaaggagagaaaaaagatctcaaaacataagtattatggactaaaatatataacaaaacagaataaaacatacaagttaaatgcaccatgtcatatgaaaataatattactttcatatagtagaaataattatttccatagagtagtgtcaaatgtgtagcacaaactcatgtcatatatcagagtatagtgatgactaggaatactatagtcttctccttctgaacaaatgtattaacaatactcttctccttctgaatactaaacctgagcatgcaaaatgcagagacaaaaattgactactataaaaaacattctagtacagaaatcttcaataacttgtgttatttactcatgtaaggttgtcattgaaagattaaaaataccaaactaaaatgcaaatggcatatagcatttgtggatttctagaaaaaaaaatcctgaatcagtgcataaacatccacctaaataccatatagcattctcttgcatagatttagaaactgacatcaaagcattactacaaaatcaatcagtgcacagaacatgcaaatcaagggtatacagaagggtcaacaaatgtacattgcacacatctagttcacaaaagcaaaagcacatatctagttcacaaatgcaaaaaagcaatcacaaaaagatatatctaaaatgaaatgaatcacagatctagtccacataaacaatatctagggctaagaacacaaatcgcaaccataaacataacagtactcttctcattttgaatactgaacatgaacatggaacatgcatcagagacaaaaaaaaattaacaaccataataccattctaataaagatataaaacctgaaacttagtacaaaccagcatatcttagtcatgcaaaaaacaactgataatatcaataacaaatttaactgctcatataaggttgtcattgaattaacatatagcatttgcagatttctagaataaaaacatcctgaatgcattactacaaaaacaatcagtgcatacagataggtgaacatatgtacattactcccttatttgcacacatctagttcagaaaaaagcataaaacacagttctagaacaaaataaaaaagcacataactagttcacaaaagcaaaagcacagatctagtccacaactacaaccacatcatgttctgtaattttcatatagaagacaaaagcaaaagcgcagatctagtgcacaagacaatatatagggctaagaacacagagatcaccgagtcataaacgaatatgaatcaaggggattcaccatatcaaacacatacatagattccgagtcgaaacaaactcagatctacaagccccatgaatcgacgacctaaaacacaagggaaaatcagaaaaacgaaggggaaactcaccgaaatcagctccaacttcacagccgcgtcgtagccaccagcaaaccaaagaccacgagaagagaaaaatgaagagatgaatcaacacaagagcaacaaatagaagaagaaatcgataaaaaatggaaaataaatctgccaccttcacctcccgcaaactgcgcaacaggactgcacaatcaccggacggaatcgccgccgctcctcccgacggaaacgccgccgcttcgcccgacggaatcgccgccgcgtcgcctgagacgacgagaacgagagaaatatctctctctctccctctatctgactcactctctctctctctccatcggcacaaaaaagacaagcgcggatttcaaaatttgaacagtgcccatgggtcccacacaggctgtcgaaaaaaaattctgatgtgggtcccacataattaccacacacaaaaaaaagcccaaaagcccagacacaaataaaaagctcataagcccacacaccgataccacaaaacgaactacgagccagtacgaatcacaaagaaatccgacggcttaaaaaacgaatgatagagccaagaaaaaacatgcgattgccaaatagccatcccgtattgtttatgtgtaagaggtgggaccatatattaatggtgtggtatgtgtttatatgtagctattgtataaatgacatattagattggctatagatgaattggagatactagttggctatactattaaacttgttcttacgagtgacaattaaagatttgttattggacccacaaatcatagatatacgaggacctacatatcatagactatgagtggtaaatatttaattgcgacattttaaaagtggcaaagatgataaatgtcccctcaatttaagacttccacacgtgccgttgctttacatttcttccacggttctttctcgttttgttttcttgattcctattaacattttataatcgaagattatagccgttaaacgatgtaactcattttttaaatactccatccttttatattagagaaaagtacaaattaacccctgaactattgggtgagtacgaataacaccccctaaactcgaaaaccagacatcacttaccccgaacttttaataccggccaagaaaccccccccccccaagcactgttgtgagcggtttagagttcgaatagcacacgtggcagtccagtcagcaattttttttctaaaacaatagcgggcccacttgtcagaatccccacctctatttctctcctcctctcgttctgaagagtgcggcggtggcggcggccggcccgctctggaggagtagcacgagtgtgcatgcggagaaatacggtggcgcgggagaggggttgacgcggcggggcgcggccagtggcatggaggcggaggcgagggccgcgcggtcgacagcgaaggtggggcggcggagatagagagccaccaccaccatagcctctgccgccaccgccaccaccacaacctcttccgggggagaacgacgccggagctgtggtcgcagacaaagacggcgaacgagaggaccaaggcgcaggccaccaccacgcacaacgccatggaccacggtcgcccgagttcgataaaatcattactcagttttttgagatggagataataattgatctcgatctgatgtgtccatggaattcggaacgtttgttgcttcaaatcgattcacagttgagcacttgagctcctccgccatgcacggtggcccagagcttggacgccaccaagaaggaagaagtttttctttttatttttttttgtttatagctctccgccccatggacttccggcagccaatgcccgtcgccccaccgacggcacggtggttagctggcgatgcgtcgctgtcacggtgctgacacaagccatggccgcctccgccgccgcaccttcaccatcgaccgtgtctccggttgcaccgccctcgcctccgtctccatgacgctagcctctgcaggcgccccgcagcttcgccctctctcccgcatgcgggacagcggggcggccgcgcgtttctgaaggagacggagaagagagagagaaaagatgggtggggaatctgacaaatgagcccactattttttaaaaaaatattgctgattggactgccacgtgtaatattggaactctaaaccgctcgcaacagtgctcaggggggtttcttgttcggttttaaaagtttaaggtgagcgatgtctggttttcaagttttggggtgttattcgtactcacctaatagttcagggaggtaattcgtacttttctctttatattatactcactccatttcaaaatataatgcataatcacctttaactaaaaaccaataaacaatcattatcacctcattgttggctcatcctaataaattagatgatgtctcgcgcgttattgcggaatatttgtattaaaatggaatttaaaaattcaagtacactttgcgagataaaaaagtagtaagaaaagagggaaactgaggcaatacagcgtagcaacttttgcgaggaataaactgatagcaatgcttcactttcagtgcactgagacctcatgtaaaacaccacgatagcgcctcacagaaaataggatcatatttaagcacgatgaaccaataggataaggttaataacaaagagcacgcttgttacctgttgcagaggcaagagatgaatggttgtctatgaattttctctctcaacaggtgtagctagctattccgaaactcagtttattattgatcaaacgataactttcaaatctagggcaaggagaagaacaatactgaaaatactgaaaataattttcaaatcttgggttagggtttcatggtcaaaagacccatttaacaagcccaatgggcctaattggttggcctggttcgctctctcgctcgcagcttcaccaatcgccatcgcgctctcgctctctctcgtggtcacgccatggcgctggtgtggcgtcctgggaaggaggacgcgcggggggggggggggggtgctcgcgggaggagcaaggtaaggcgagcgccacacccgagccctccacccctgcaggttagcacacaaggtaatttatggtaacaatatcctccccaatgtaccaatgacatggcacgaagtgcggttttaacattgtctaatttccccctaccttcaattctctcaacgctatccattttcagccatctactttatatatattttttatttcttatgcagcacttttgttgtttgaaagcaacatgccatttcatacattcaccaacaatatgtttgccataaaggctgacatagttaccaactgacattttccacattatttcatttttaagataacatatatgaatcatagcttaagcttgagagcgaccaaagtttattcagcaattcagcttccaagctaagacggcacacattgtgatagatggaaagttaaacgtatagaacaccaacattgtttagatgaaacaaatattaatagcaaagactattgctaaatctatatccatagtcggcgaaaatgcatgacagcaatctcgagaaaatggcatccacaattcttcgaaggaagcaaaatgttataacaattatcaaaccaagccatcactgttatacatctgtctagcaagaagccatgatttgtaatacaacccaatagcccaaaattctttgcaaatatatgctaaacagagtataaaaattcatctttgccgattggtgagcaggacttcctcgatgagcctctatgctagtaatgctcgatctttgacatgctacctaggattagattttcggggttggagaaggcgggatagggtaggagggcggtaagggtgggtttagagggatgtctagggcggcttaagaacaatggtcggtggcgacaggctatgtagatgggagggcggcagggtgcttgaattacagggatggtggagggcagtgggaaggatcagtagctagggaaaaggacgtcaacagatttggttgaaaggtagggttggcagaagtggatctggcgctaggagccactggatatgggggatgagtagcagggtgtgggaatcttaccggagctattaaagagggtgatgacacccacacggaggaggagcacaagaagggagggaagcggaggtgtgtgtggatgcgagtcttgccccgctgctaatgcgatgttggtgaggtggaggaggcgttatagatggaggcatggcgtattggattgggcatgatttgcggcaacagactagagtttgaggagaagagatagggttccctgagtttcacgaatcttgatgagatctgaaccaaacaaaaatgaactgatggatagagaaatatcatgcagctattaataggtggcctccaatttagcataccatcataacttctgttaccttttcctatgcggtggcgtgattcagttcgatgcccggaaggagcatatcgttcgacgacaagctctgtgatcgtcatcgccaccgctgacactgacagcaatgcgtccaccactagggcgaggtccttgctatggcggttcttgaggtgcagctttttcagatgcgggaagcccaaggaaaagaggcgagcattgacgaacccctacgtcaaccacggcaggtcctccaggacaagaatggtgagcatgcccaggtacgacagtgacaccgtgggccatttccgcagtgcgagcttcgtcagacgcaactaatccgacggcatgaaccagtagagcttacggatgacatgcggggatggggaagcttgccagagttgttgaagtgggcgacgacagaagcttggaggaggagcaggagaaggtagggaagcggatgtgtatgagattttgagtcttgccacgccgctggcgcgatgatggggaggcggaggaggcagcgtggtgtgttgaattgggcacgatttgcggtggcgaactggagtatgagatcaagagatagggttacctgatttgcatgaatcttgatgatatctgaagcaatcaaagatgaactaattaataggtggcctctaatttagcataccgtccaaacatcagtttccttttcctacgttaatatgtgcttatttacctccttctttgttccaatttgtgtgcacactccattggcatgtgacacactagcgggtgagttagtggttggccatggtagtgagtgagctggtgggcagctgtattgagacatatttaataatttacactaatgtcttctaactccacgcttttgttgaatcctacatgtacaaaagaagttctaatacaaataaggtgaacccactttgagatatacaaaatcacatattttttactcattgggtgattgaaaatgtaaaacacattagttgattctccaactacaggagatgtggcagcaccgtcaaattagtgttcggggtagtaggaaggacgggagagatcgaggagatgaggtcggtccccggtcctcatgccggagggggagggggatcggctaaagctaagggagggataggtctatcatataagcgtcgtaaaaatcttggggaaatactagccataaaaatgttattgacatttaaaaaaaaaatagttgcctactgaagacacaaccaaaaaatgcaaattaggaaaaactgtaactgcaatactatgaagttgaaggtttttatagatgcacgtttaagcaatgcaacttttactctgcatatatcaataaaacaacaagcttaccaataccaatagaacatagggttattgtctcgtgaagagcccaagcttgtataaaatgtgtctcccatttgaccgaaatgtcccaaaggaacacacacaaactggacataggtacacaagtttctgttgtcaagatttttattgatgacatattaatagcaaagtctattgagaaatctccatccatagtcaacgaaaatcatcgaaaatcagcatgactgctgtctcgagaaaatggcatccgcactaattcttagaaagaaatagaatgctacaacaattccgcaaccatcactctgcctcgaacagtgacaccaatgccgatctcgctcatctctccggggccaaccttgtgcgccacctctagacaacaacctgcatggctgattacgaggtggccgcacacatgcttggcgagtgtgagcgtagggttgtcgaggccgagatctgtctccaagccaagatcgatgcacttcagatggagtatgatcttctagccaaagaagtgccaaagaaggagaaagaggaggtgcgccttgagaaaatcatcgttgaggctggtgcccgctttaaggccatccttgttggtattaacatgctacaaagaaggaacgaggaattccttgtcgattcacaacgctacatggatgaagttgaacccaaccttaagtctgcaatcacagtggttgaagtgctctagaatatgtagggtgctacgtgccccacctccagccaacaatgaacatagttgaggctaacgaggtcatcaccactgtgcctgccctagatctccctccaggcctagatttgtaccatcagaaagtggatctcgctatgaaagaagggaaacaacaccaagaaggtcaatatggtgagaatactaatatcaactgttgggaagaggagaaatagatggtctgtaccaaagcgcacggcatagctgtgttccaccatgaaccacggtcagatgttggctattgtggatgagatcatgatccctaccctttatgtggatcttcccttggtcctagatctgctacagcaggaagtcgatctcgctgtggaagaagagcaagagtgcctagaatttctcgattgcaagaatactgacatcaatagcctggaagaaaaggaagagatgatctgcactaatgtgcatggtgtgcctgcattttgccacaaacaactgctaggtgtggccatggccctaaccacagcttgcccccgtcgtggatttgcctccggtcctgcattttcaccaacaagaagtggggctctttgtgcaagaaaggcatgagtgcgggtgtagtcaatgtggcaagaatactaacatcaacaccaacaaaaatgaggtaagctgcaccaatcattcaagttcttctagcaagagaaagatggctgacatggacaacatgaccatcccaccagttttgcgcaagagacctcgttgcatcgacaacttcaagagcaccaaaaaatgagggaggccatgcaagagttcaatcaagccagaaccaaccatgtcaaatgatttcaaatgcattctacaattgcgattgccactatcatccacagttcctgcatccacgaatgtatcattgttggatttaccaattatagccactgtacccccctccagttgtgatctcgttaggtccacacttacttttggaaaccgataatcaagagagaaattggaacaagagatcactatttactgggttgggaagtgttgatcaagaatatggaattgaataggaaagtgctcccttgctaccatcatctatgcaacaaccttcttcttccttggggctatccatgggtggttctcaaatagctacagcacaagtagcaactagttttgcctctgtccccaatatgagcccacccttggttaaagaatcaaaccagggagatatagaaatgcataacgaattatcccatttgcacttgaataatttgatgaaccaactttcttgatgcttggatggaagaaagtggggcccctttatcaattagcaagtacccttctctttggtgctcccatccaacagtaaaagtgcctctctcgtgtcaaaaatggaaaccagcttgtgggagtctcaggaaaatatggttatgagattcatggaaaatgtggagctttgcatgggagctatttgcgctctttatcgccaaaagaagctaatggttgaattgacatgtgaagaacgaactaagtttactacactcaataaaagtcaggcttacaagtatgttaaatattaggtttgaatgctaggaaggaaaattattcatatttttacatattatctgcatacaatcttgagaaaatggtatccacataaattcttagaaggaaacaaaatgttatgtcaactatcaaaccaaaaccattacagttattcatctgtctaacatgcagccatcatctgtaatacaaccccatggtccaaaaaaaaaaacatcgcaacaatatgctaaactgagtttaaacaaattcatcaatctttgcctaaaaaagaacacaaaatgtttctgacaaaagggagtctcataatctatcccagaacaacctcaacgtcctctctgaaccaactccttccacacaggatctgccccttgatgccgatctcctccattctgctccaatggcggcgctctcctcctccaccttcctgctgcctcaccacctcccactcccacagcccatcgtacctaacctccccgtgccggagcagctccacctgccgtagcgccttgcacaccttcaccacttaccttcagggttttcaatttcgaaattagattttatgccggggtgaccaaaatttatcggtaatttcagaaatttctggctgaaattatttgaaaatttgactgaatttgaatgaatttaaataaaatttgaccaaattcacaaaaaattgcaaaaaaccaaaaattttgggtgagatttgagcatgctagtcagctagtgggggcgaaattaccgaaatttcagaaatttcgaaccggaatttcaaaccctgcatacctcacgaatgccacctgccccggcgtcggcccgaagcaggccaccactagctcccctagcttccggtgccggaacatcgccggcggccacatgatctctcgccccggcgccgccgccgcggccggctgatcatcagcggtggcggcgacgtggacgtgcagggactccagggacggcgcggcctgcaggaggaggcgcggccacgagacgtcccaggtgggcggcacatcggcgacgaggagccgcctgaggctgcgcagccgcgtgctgacgcgccacgggaggatccacctctccggcccggtgaaccggacgacgaggctggccatgcgctcgctgcggacgtgccagtcgagcttgtacttgtccggcccggggagagggtgctgggcgtcgtcgacggtgctggagtcgagggagaagctgaggtggactcgccggaggcgcgggacgtccctgaacaggaccaccaccgggttggcgtcgtggatgcacacgccaggtcttccagcgcggcggcgtggttcagctggatgccgaggaacaagcagcgctcgacgacgagctccgtgatcggcgccgccgccgccgccgacgatggcggtggcgcgtccaccaccagggcgaggtccctgcagtggcatttcttgaggtggagcttcttcaggtgcgggaagcccgaggaggagaagaggcgggggtagacgaaaccctgcgtcgacctcggcaggtcctccaggacaagaatggtgagcgcgaccggcatcgtcgacgccagggggacaattcctcagcgtaagcttcgtcagggggtgcagg

SEQ ID NO: 68116 - DNA, 11784 bp, Oryza sativa
tgacacggaagtcgagcgccggaagctcgcgcgggaggcgcgcccagcggcgggacagcgcgtcggtgccgagcgcggagcaggtgccgaggccgcgcatgacgatgagcaggagctcgtcgggcagcgcactgaggcggtcgtcgccctcgctgtgggacgccgcgcgcggcggggcgctccgacgccgacgtcgcggacgaacagccattgtcacggcaacactgacacaagttgccgaacgatttgtatttgaaaaaatatataaaaaagaaaattgccgaaggatttgtatttgaaaaaataataataaaaaagaaagttgccgaaggattccgattcggtctcggactcacgccggagtaagaacaatgtcactaaccaacacagtcacctcaccccggaaatcatcggttttcctgcaattccaaggtcacgacatttgttaggaccaaattgaatttacttgcaaaatacccgtactatttttttacttaagacactaccaggcttttgttaaaattttgtacaatattaaggaaaactatataaatggagttaaaaaaagggtgaacaaattttacaaactttgcaaccattcaagaactgtttgttgcaatgaatctttcatcctacaactatggagaactactttcttgaacaaagcaaatcatgattccacgtctaaccttgtaccttagaaaatacaaccatttgtctccttccagatatgccaacaagaaaaataagaattctgttacccttaattagatatgccaacaagaaaaataagaattctgttacccttaatttgttagcggattaaacaagaacttaaatgtatggtatcactaaacaagcaaaatgtgttactaaccggtgctaaagatgatttttagtctcggtttgtataattgagactaaaaatacccatcataagtcccgcattgtgtgtcccagttacataactggaactacaaagggttgccaaccgggagtaaagtgattatccccagcgatggatcctacgatgatagttgaatatttttgcttgttcaataaccatgtgatttacattgtctaactatagcacacaactaaaagaaattaatgataacatctaaatatcactattttcactactttactactagagaacagagacttataatatcgaaaaatcaatattttcactattttaaatttaaccatatagcatcgaaagttactagtttactttaacaacaccataagttaatttcgttctataatttagccgcttttgctgagtaggcgattgaaataagaaggaatttcaatcacctaggcttggccgttggatcaatggccagggcatcatctacaccattggaccaagggaggcaggaagagaggaaaggaagggaggagggagtttgcttatcgaccggtgatcgggacttccttggcaagcctacgctaccgatgcctaaacaccgacatgctacctatgtattagcgttctagggtaggagggcggttagggtggatttagagggatatttagggtggcttattacctatggttggcggcggtggcctacggagatgggagggcgacgaggcaccggaactgcgggtatggaggagggtggtgggtagggtcggcggtggcagcaaaggatgtcatcagatctagttgaaaggtatggttagtagatctggatttggctgtgtgagccacccgagatgggggatgagagatagggcggggaagcttactgaagttattgaagagggcgacgacatcggcgtggaggagcagcatgggaaggaagggagacggaggggtgtgtgggtgagaatcttggcccgccgctggcacgattttggcgaggtaccacaaatggaggtgtggtgcgttggtgtggggacgatttgcggcggcggggtggagtttgaggagaagagatagggttagggttacctgatttgcacgaatcttgatgagatctgaaccaatgaaaaatgaactaatggtggatagagaaatattaggcaacacattaataggaggcctccaatttagcacacagcccaaacttccgttaccttttcctaggttaatcattccttctttaccacttttctgttccggttcacgagcatgcaccattggcaagtgacacattagtgggtgagttatagaaaatatcacatatttgctactcatcaggtgacgaaaaatgtaaaaaccattagtcgaatatgcccaccatcgatccatgtgtgtgaatcacactctagctgtccttcttgatcaaaatgtcttttccaactataggagatgtggcagaaccactggattagcattcggggggttgtcatgggagatcaaggaggagaggtcggtcggggggatttggctagagctgaagaagacgatgagatgtcgacggatttggcggggattcgggatgagagagggagccgctggtgggcctcgcaaatgcttgccgatgaggggaggtggtggggagggtgtcggcaacctgacagatcaaatgtacaggacaaggaagggatatgtctaggataagtgttgcagaagtctctgagcaaccctagccataaaaaatgtaatttccatttaagcaaaaaaataataatgaatacactacccaagaatgcaaattaggaataaccaaaagtaaaagttataccatgaagttgaaggtttttacatatacaggtttaagtaatgcaacttttgtaggtgattgattagcatagcctcttgttaggcaatggtgtagcctatgtgcttgagatcattgatgtgcatgagaagaggatagatgtggtctagattgcaaaaaaaaaatgtcaaagttttgtaccctggggtgaaagcacacaatgaaactttcacaaagatgctcaaactacaatttactcattaataacaaatataaaacttccatcgaatgagagaaagagtttatttttggattttggcaaaataaataaataaataaatacacacatatccaagtgaattggagtcctgtccacagagaatgtgtgtgttagatgcaaacagcacacatacaagggttgtggaaagatttgagtaattatggccatcaaagtgtaactgacatttataagaaaaaatatatatgcatgataaatacacaatccaaaaacacaaattaggaaacttcgaaagtaaaagttataccatgaagttgtgtggcatcctggcccaattaggaccgacgaggacatcgggtcctttgagggtgtgtgtgttggggggggggagctcctgactcaattaggatgtagcatgtgtggcccataagagctatgtgtacatgtttagtaccacagtgctactttagcaagggtgaccttttaagtaggcctgtccgtcgattgtgttgggctgcacagttatgaagggcgggcggttacaagttgaagctttcttatgtgcaagtttgagttatgtaacttttaagtgattaattagccatatctatcctctccaaagacaaaggtgcaacatgcatgcacacaggtgggaggctcattggcatgcacgaaccattgtactcgaggtcattgatgtgcttgcagttgaggcaatccaaattgccgaaaagggaatctccttcaggagttcgcatcacatagcgggctttggcttctatctatttacggtgtgtttagttcctgaaaaaagttgaaaatttgaagaaagttgagagtttggaaaaaaaaactagaagtttatgtgtgtatgaaagtttttgatgtgatatgatatgatggaaagttgagaatacgtgagaaactaaacacggccttagtggaaggagccatccctatttgtggcaaggagtggatagtccaccaattccaattataatttgccaatgacttgtttcatggctttaatttgagccacacatcgtacgttggaaacaaaaataaccacattatagcaggtcaagcagtggaaaagaagacctctgaccacatgtttgttcaagaataagctggtgactagtaattggattttgactttttcttgcattgttatttaaaaaatttgtacaaatataaaaaaagttgtacataaagtactttagataataaagtaagtcacaaataaaataaataataatttcaatttttttttaaagacgaatggtcaaaaagagcaggcaaaagggaagaaaattatgtaggactgaggtcctaccctcctccgaaagacttggctcctctatgtgacacctgtcccacacgaatctcagagcagcttactccctcgtctctccagttcccattctcttcctttgctcggtgaggcagcgagctcgcgtctgaccagcgagctttagccgtgcgccccctggcgttgagcagcatcaagtccaagctcgcgctgccggcttgccgctagtctgctagaagaactctcatgatttggacgagactgcgctgtcgactcgaatctgctacatgattattcactgattcgatttttcttgcctcatagcgaaattattcaatgatttgatttttcttgccgttgagtttgctctgtatggtgtactgcactgataatcattgctggtgattgacttgaaggatttctttctttttgccgggtgagcattttaggattatagcgttaatttattgatgtttcttctcgacgagcgcctcatgtgagcttggatgctttcacgttactgatatcgtttgattccggcgttagcgacaacctgccgagcttcatgccgctcacccgctggtcggacgcgagctcgccgccttcaccgaggagaggaagagaatggtgaactggagagacgagggagtaagctgctctgagattcgtgtgggacaggtgtcgcatagaggagccaagtccttcggaggagggtaggacctcagtcctacataattttcttccagcaaaaagtgagtagcaaatatcaatctaaaacttccatctaatcagattaacagatttttgttcggacactttgttctcaaaatcgaaatcatagaaatccacgcgagagaattctgttgggaggcatccacgcgaatcggagtcgtccgcacgaagacggagatttggtcctgcactctactctagatcgcaaaaccgcacgtacggaaccccgcggccatggccgcgcccgcgggcaacgtcgagacccctcctcgccgccgcgtgcgccgccgcatcgccgccgccgcggccgatgacggcggcgaggtcgacgacgatggcctcagcgtgctgcccgacgaactgctcctcgtcatcctgggccggctcgacacgcgcacggcgctcgccgccgccgcgctctcgcggcgcctggaccgcctcgcgcgcgagatccccgcgctcgtgttcagcgtccgcgacgtgctcccgccgcgctaccacgcctgcgtccgcgcccacggcgacgccgccggcgcggacgccaggaagctcgacgcggcgatcggccggtgcgagcgccgcgccatccgcgggttcgccgactgcgtcagcgccttcatggagccgcgcgtcgccgtcgccccgcgccgcgccaggagtctccggctcgagttcttcgcggcgcgcagcacgggcttcgtcgaggacctgatcgccatggcggtcggcgcgtggggcgttcaggacctcgacatcaccgtcgtcaagccggcgctggtcgagcagggcccctgctacgccttctgcttccccgaccaccgcctcagcgcggagtcgctccggtcgcgcatccgcagcctcgccgtgtccaactgcttcctcccgccgccgtccgagctccggcactacgccgcgctcaccaagctcgtcctgcaggacacgcacccgcggacgcccctcgccttctaccgccaggtgctcgacgcgtgcccgcggctcagggcgctccacctccgccgctgcggcgcgccgtggtacgccgcgctggtggtcgacgggatgccggagctccgcgagctcgtcgtggacggctgcggcttccacaccgtcgacctgcgcgcggcgccggcgctggagcgcgtggcgtgcgtggacggccccgtcgcgctggccttcggcggcgccccgcgcctcgcccgcctcagcctcacctacgcgctcgacgaccgcctggtgctcgtccggaactggaggctctccggcctcctcggcgacgccccggcgatggcggagctcctcgtccgcttcaccggcgagcccaagtggatgacctcgggaccgctccgctcgccgctgcccggcctccgcaggctcgtcgtcgccgacatgccgtccaactgggacgtgtcgtggccgcgcgtcatcctcgaggcggcgccatgcctcgaggtcctccacatccacgtccaagaagaagaagacgacgccgggacaacggcggcggcggcggcggagataccatggccgccggcggagagcgcgcggcacgagcgcctcgcggagctggcggtggtggggttcgccgagacgcgggggcaggtggggttcgtgaggcacgtggtggaggcgtgcgtggcgctgcggcgcgtcgtgctggtgaggcgcgggcgcgtcgtggtcggcagcgaggggcggtactgggactggaagctggtggcggcggaggcggcggcgccgcgtgagggggaggtgggaggtggcggcggcgacggcgagcgcccgacggcggcggcggagtggagcgaggtggagaagatggtgatacggagccaggtgaagagcgcgtcgaggcctgacgtggaggtgttcattggatgacgtatgctatcacgagtccacaaacactttttggacctagtgccgattgtatgcgtaattgcgtataaagggtgtatatgatattttcacatctaaaatcttaaatcttagggataattgcatatttgcgctcgtttgaagcttatctattaaatgaccctactttcttatagtttgcttatttggctcggcttttcaagaatgaataccctgtctgaccctatttccactacaacgttacggtttcatttttttaaaaaaaatataattattattcgtaatgaccaaactactctcaaaccctatccattccctccccctctctcgtattccggttgaggtggcggcgcacggaggggacgagccggcacggccactcatggagggaggtagcggctgcggcggagggaccggacccgcggcaacgcgtgtgcggaggaggctgcgggtgcagagaaaggagcggcgacgacggcggtggtggcctctctcccacgtgctggtgacctccggcgcggcacagggcaccattccctccctccatgggcgcgtcgtcaccgctcgtcctttgtgcgctggcctgcttcctccgcacacgtgatgccgctgcccaccctccacacatcgacgagctccttcgccacacagggcgctgcttcctcccttcccgcgccccggcctccgtcttcctctgtttgagccccgccgccgggtcggccgcgacgacgacgacgccgtggcaaagaggatgggtggttgacaaatccaaaattttgttatattttatttatatttttataaaatagagtcaaataagcaagggtagaaggggcaatttttgctccgattaaaactgttacatgctcttaatggaatagggtcagattgtatcttcaattttgagaaaaatggtcaaataagcaaagttgaaagaagatagtcaaattggtagttagtcctcaaaacatggtcaaatgcacaattgccccaaaatcttattattgtgtgtgaggcaaaggtccgattggttggtaactaagagcatcaccaacagattatctataattttctcctaaaaatttggttttgggtttcttaaactaaaaatagaagtgaaaaaactcctccctccaacagatagcctaaattaaatccccaaaacttaaaaagtgggcccttctgttaaactactaacataaaattccgtttttttcttttatgtgcagaaagatcgctatctcccacgctcgggaacggaggagagaggcgggattgcgagattgggagcgacttccgcgcccgcatataaacggagcaaggaatggggagaagggaactccaaaactcgggtaggagagtaggggatctgttggagttgtttttttttttttttgactaaaatccctcaaaattagttttagaaatcatataggtagattgttggtgatgctctaagggtgggttttgatgggaggttttggatggataggacatgacgacccttttttttattgtttattacctctctcctaaaataaatttatttttcacccatctcacacataccaaaagactaaaatactcatattttttttccaatctcaatacaattatttttcactttatctacttccaatataattattctttgttttcacaaatttcaatgcaataattacttaaaaattaaatttattttaagacaaatgagatgagtaaaaaaacttaatatgaataggaggaaataatttatattccaacctttgcttcaaccatactccagttgtaccaaatttcagatctcactgtccatcgctgcccgaagacaaatcgtgtccacggcggaatcacaaagcccccgatcggacggccgataaatcgccggcgatttgatccgacggctggtaaatgctcaagcgcgactcatctccccccaaccttctcaacccacgaggtgggatctcacggcctcatcggcgggcgagatgaacgccttcaggctcgccggggacatgacgcacatcatgagcgtcctcgtcctcctgctcaagatccacaccatcaagtcttgcgctggtgagtgactgatcagccgactggcgcctgcttaagatgcatttttttttactgtattgagtcctggattggttgccagcagctcaagaaaggtagagttctggatcttgggggggaataggggacgctagcacaatgctgtttagtgagggctaagattggtggtgcttgtggatggattctgaggctttagagactggaagtttagagggtttgaggaaattaatcttggctttttggatgcaattggaatggttaagatgtaggtttggtagttgtacatttgaggctggatcctggaggaaatgttggatcttggcttgctctggtaacggcggtggcgttgcataagggcctatgctttttggaagatttcagtgatattgccactccattgttttgctaaaattagagattggtaggttagattctcctattatttttgccttcccccatcttttttctaacaatactgattgattgttagattctctggaaaatttgaggacaatgttgtgttgtctatgttttgtaacgcacttttgtcgacttattgattgttattgtgttaaaaccagagtggtatcatatatggggacctgtcctggtcatttgcatttgtgtttcttaaggatcccatgtacagaaaattttcatgtcctggttcaatcatatctgtccccaaggggccacatgacataaaattttcatatcctggttttttgttgtgaaatgatagatcaggtatatgcggatttatcacatggaacggtaaaggtattgaacttgtcatgtatccattggcatttttttcatttttgctactcaaaactttttatatatgtttcataatttgaaggaactaaacttgtaatagtttgtccattaaagaagcctttttgctggtcactactcactattcagacccgatttaactgcttgcacatcatgggtgtcatgtttgtggttcgtatgtaagaggccctcagaattactgcagtgctgtaccacttttaaattatgctagcgtgtgtcagcatgcggccaagtaatttacgaattgtattcatagaaccagaacattgaatggctaagattatgtgttgctcagaatttaataataacgagttggtgaattccaataatgtggttgctctcataagtgcagcaaataccatcattcctgtaattttcaatttttcccttgtagacacattagattttggaggatgcttgttttgaacaatgtctgtatcactcactcaagaagtatcatgaacataaaatcaatttttaatttcttttttcttgtaggtgtttccttgaaaacacaggagctatatgctcttgttttcgccactcgctacttggacatatttacagactttatatccctatacaatacagtcatgaagatgattttcctgggtagctcattctcaattgtttggtatataaggcgccacaagatggtcgcagatcatatgataaggatcacgatacatttcgacatcaatttcttgttctaccatgttttcttttggccttgcttatacatgagaagttcacttttagggaggtacttcatcaaatcaacttcttgaagttgagaaaatataagcttccaatgataatttatctcagcttttaggtctgaattgatatattcccctttagttttattacttctataagttatgaccaaacttttttggggtttatccgaattaggtgatgtggacgttttccatttatctggaggctgttgcaattcttcctcaacttgtactactacagcgtacacggaacgttgataatttaacagggcaatatgtgttcttcctagggtaagttttgaatatggataccattttcttttgagaaaacacaactttcaatattttctgatccatctctgaagcggttaaaccccaattgttgcttgtgtcttgttgatgttagttgtgctcaaaatatagtccacatttaatcaatgagcacataatctttcatcttaattattctttcaggctcctaagttcaacatagtcgagcactgatcattttgcattatcatgttaagttttttgtttaccctttccaatgatttagctgtttttcttccatggataataagatgcatatgcaacgttatcagttagaaattttcaaatgatgtacaccataatgtattccattgtcatctatttaaataagggcatgtgttgttaaagatatttcagacttgaatgatgtgtctaatgtctactgtttttttagtcaatgagaaacatggtcattggaaatagattcataccaaatatggtttcagtaagacaaaatcctaaaattaatcagcattgtatcaacatggtgactatgttgcaaagtaaccatttttttccaggttcagagaacttctgtggagaacatgcgatgtaacatgaaactgtccccttttgtcattaccgtaatttgtttctccattcatctttttggtcagtttgattgatggaatcaattgtccctatttgtgcttctactccacatgctagtgcttgcaaggattttcttttttgacatttgacttgtatatcatcacattgtccttgttagaggtaaccaggccagaaattcagaaacatgtacacattataagtttacgcagtggactttatccatttcattttcagattctatgcaccattattctccattggaagtcagtatgttctttagttagaaatcttgacgttttcattttcgcattgattgacatgatgcagcgcataccgagcattatacatcctcaactgggcctaccgctacttcactgagccacactatgtgcattggataagtatgtcata

SEQ ID NO: 68117 - DNA, 13066 bp, Oryza sativa
  unsure (1)..(13066): unsure at all n locations
attgacaactcaactaatgattgtaacttttggtgttgtatcatctgaaatgtgggtggcttggcatgtccaaccagaaaaaacaaagatcaggaaaaaaattgttttcatacagttctgagaggtgtgacaatagaacagtgcagtagcatatgttgaaattgtggtgtgctccattatgaggaaaccgcagatgtctatgttgtacatttgaaaatcttgtagacgatacactgtaaattaaagagataattgcccattgcactatggagatgaatattactctgggtgatcagttgtttgtcaagagaaccttgaaacttttaagacagtatatgtgactctttctacagcattgccatgagctgctattgttaaactctttgtcatcattttgatcagcctaaaatttaaatcgtaaaatccaagactttctagagcaatgtgatgtgcatgtttagtttgaagagatcctatagtgacagttcacaaaaatcatatatgcaattgttggagctgtgacttgtaagtagcatccaattttgaaatgttgtttgaataaattcaggactttgttttttgtcacttctgccactttaactttagcttttggaccactaacaaaagaagtataaaagtattttacctttgaaattgctttcgttgtttatgtccagggttgacaaatatgatagtaaatcacttaattattgtggttataggacatagagttggcatgaatttcgaaaccgttcgaggccaaatttattcaaattaaaatccaaatatttggcaaaaattgtttgaattttaccatagccgaacggtaatagttgtaaccaataaaactgctcgggagcgttgttccgtgagtgaacgattttgtgatccttgctttggtcatgtatgatgtatctctggcttatgcgccattaagaaaaaaaacttccaagcaagtttaataatataaccaattactagcttcaaaaaattgaaacattatctatagccacctaatatcccactcatataatagtcagttatagatatatattgcatcattaaaaccaaatccactcatttctcacaaactttattagaggtcgtgctatagctggctacaaatctataatctattttttcttctctttgctctccgctcttctccacataagaacatatgtgatgtattaacttgtgcagcccacttacaccacaaaagaacaaatgtcaacttgtacaacatgcttatatcgccttattgtactcgctataatgagttgtctttagtagttcgtatgaatccaagtcagcatgaactccctaccacaaatatacaaaatagcagcttcataaaagacaaaactacaaaaaatccagcatgtacctttttttttacagccaccaagaaaagatgaacctacccgactctctcaattaacgcatgacccatcaaccaaaacaagggttaagccgaaggagaagggcgtcgctgccccctccccccttcctccaacatgcaacttactactacgtgctattaatatctaacctatctaatcatcaattatgtaaaagaaaatgggtctaacaatatactccctccgtttcatattatattataagtcgtttgacttttttctagtcaaaatttattaagtttgaccaagtttatagaaaaattaagtaacatataaaatatcaaattagtttaattaaatctaccattgaaatattttgataatatatttgttttgtattgaaatactattatattttttagaaacttggtcaaacttgaagaagtttgactagaaaaaaattgtcaaacgaattataatatgaaacggagggagacatcactatgtggctaatatttcaatttcaaatctctgaaatactagcacttgtaatttctttgttcattttgtctttttttgtctatttatttgtctatttatctagatttttagctcagatgattttatcatcgtttataatttatttgctcattgcttataaagctgaattgaaataaataaatatgttacaaattatagctacatgataagcctatatattatattatcattttttatgttgatatgatatattacctatgaaaaatcttaaaatttgtgtatatttttatactactttttttattgtaatcacttattaagttgaaccccctcatactgagatcctggcttcaccattgaacctaaacacatcatttaatttcatatcaacccatcgtccaatgaaacctaattcttggcctcattggattaactccatccatcctgtcccaagttagtactacttaccaccctttatcagttgtgagaaacctcaatggtcacggtttcccttctcaataaaatcatatatgcaattttgtttgagcaaagttttgttgttcgtgtctaggattaacaaatatgatagtaaatcacttaattattgtggttatatggcttaggctgtgttcgggaggaggtgttgggaacttctctccttggcacggaaaacgagatagccgattagctcctgattaattaagtattagctaaaaattgaaaaatagattaatatgatattttaaagcaactttcctatagatattcttttgttaaaaaacatattgtttaatagttcaagaagcgtgcatgtgtaaaacaagagagtaaaagatgagaacttgtagttctgaagacagccttggagttggtagaaacagttacataaaagtttattcaaatcaaaattaaaatctttagcataatatgattgaatcttatcatgatcaaacggtaataattattttccaaaataatgctcaagagtgttgtcacatgaccgattggttttatacacatgtcttttgcttatgtgacattaaaagaaatgagttgcctttagtagcatcgtaccaatccaagtcaggatgaactccgtaccacaaagtgacaaaaatagcagctccatataaaaaaaaaggcaacaaatcggtgggtactctttcggacagccacccataaaagatgatcttattcttattactccactatctcaattaacgtgtgacccatcaacccgaccgcatcgcataaactcatatcaatatccactccctagttctcggccttatcagattaactccaaacatatccatcgatcaatccatcctcctccaagtttagcatagtatttaccactgcccccacaccccctccatccatagcatcaaaatccaaccctagccagtcacaccccttccaaaacaagaaataaacacaccccaaacacgcagttgacaaaatcaacactccctccaacaagagattcaataatttaacactcatttaaaatgataatcgattattcaacatcctagcccgctttcattcacctaaatggtcccacgtatcatcgtcacaagcgccaattaaagcaaaattgaccacgaaaaaaatgtgtcaaatttctcatctgtgtcacccaaggccgtgtgaaaaatctcggattgggttatttaagggctaagttctctatttgataggctaagtttctaatttaaaaaggttacatatatccggttagatataaagaccggataaaaatacccttctctaaaaaaagcctaggtgaaaaatggtgtgggttaagctggaccttcgccagtttggcaccatggctgtggctgggctgggattggaatttggaaaggccatcaaggccttccttactttaaaaaaaaaaacgtgtagagagagaaaatcagacggatgagggggagagagggagagagagagtagcggtttgagcacgcggcggcacggagacccacgagagagagagagagagaaggtggcaacggccctctcgcccggaaaccagcccacccacaccaacacactcacactgccctgccctatcgcaatttccatttccatctctcctcctctcctcctccacctcgtcctacaaatgcggcgcaggacgagagtcagagcggagtagtagcagacgaacacgacgacatcggagcgctcttgtctcctcctcgtttcttctgctcccgagtcaagcagatcctccaagcccagcgagggggcgggcgcgccgccgctgccgttgttgttgtcggccgcagcgcagacatggacccgtccggcggcggcggcggagtcggagtcggaggcatcggcggcggtgaacaaatgtgggtgcggggtttacgtcttcgggggttgctttgcggggctggtttggtttggtcgtcgagacggcggccatggggaggggggggaactggaatccgcgagtgtttatcgcctccttttgggggatggagaagtcttgtggttgtggcgatttggtgtttagagttttggtagatttggggggggggggggtgatcgcctgatcgggtctgggtgattcgtgtatgttagtgtgtgtgtgtttcttttttttaattttaatatcacttgctgaatatgttattcgtatgacgatttagttgctcttgttggaaatggcttaaaaaccgtgggtatttaggttgatgcggctgggaaatgctaggatactaggaggaggaggacatgactgtccttagatttgtgtgttagattggaaatgtttcacttcaatttttgggctcaaggggtttgggaataaatggacacatactgtctttgcaatgccgtgtcggtgataatcaattccggtttaggagtctgccgtagcacgaagtgataacatttattatgatctatgtagaaactataaggaagaactcattatgattcaagctgtatcctgtttcgactgtccgcggaactgattactgtctaaaaatggcacgctatttcgccgtgttactttgattgcatgtctgatcttgtaatgcttactgcagtctttgggactggcaagcggcggagcagtgcgagagcaatgctgcaaatcatggtacatcactcaaaatccataaatcataatagcatctttacacagattcggagcatctgtttcgagtttccacttactatttgattgtttctttttacattagatgtttctagattcatgtgggactgcctcaatcaagatgatgatgacctactgggattgctgggcaatcaaactcctctaagagattgtcgcggcttctttgatattgatggtaggtagtttcttgttcttaccaccatcaattgttattcctctggaatgtttgcttaaatggagatgttactcgagtcagatttcacctgcaaggagacgttggacctagaggaatctcgggaatcaaagcgccgccgcatattggagtacccttctgagtctaatcaatcagaagatggaaatcgtgaaataagttctaccttgggcacatctgaggtaattcactagcacctagatatcttccaagttagtgcattgtgctcttgtttacacttcttacttcttttcctgatccatgtcttaggtatcagaaatttcattgctttgcaccgatgaaccgcagagcttcaattgggattcacagaacaattcaaataattttggtttgtcttttgtttttcatattatattgtttgacaacttaaattgctatgccttttttgttagctaactgaaaatagtggcatctgatacaatagattctttgtcaactggagcattctaccaaccatcaaatagtcattcgaaaaattgctctgatgaaaatcaaatgcatttcaggcatgaccaaatgttagctactctctgttcccacagaaaacagtatttactttatcattatatttcaatgatgacatgttaagcttggattcatttttaggcattctagccaggagagcgttacatataccaatgatcaaagtggtatttcaggtcagtgcaaagtgtacgtctacagcgttgtttaagtcaaattttcatttgtttttaaaacatggcttgtaatctatgcatgagcatcccatctcatcactgtttgtccttacgtccccatgcgagatatctgtagagaacatttttgtttgctgttttccttcgatgcaatgccatgttttcagtcactgcaaaattctatactgattgacggacatacagtttgagtgcctcgctgaaactaagattttgtagttttggcaggaaacttaccagttctttctatctataacaggaacaactgagaatgattcagtgacagaaagtcttctaatgcaggagactaggaagctttctacacttaaagtatctaaaggtattttcagtttgacagtatcttatcatgtcatcaacatttcttactttgagttttgtctatgctgatcatttgtctctgctgctatactaggaacctcactggttaaggcgaagcagaatttaactacaactatagcatacccttttaccctcatcaaaccatcctgggaggaaggagatgtcatcactctaaaggatataaatcagcgaatccgtgctcctccgaagaaggctccagaaaccctagggacttcagccttctctggcaagccagtcattggcaagacaaggatcagaactgacgggggcagaggcagcatcacgatactaagaacaaaaggttgagagtccaaacaacaagtttctcagccattacctggattgctttcagcaatttgatctccacagctctccagtttttttttttttggccatggatttggtatttaggatgactatcaatggctaactcttcaaagatttaccattcatcctgtgtacattagcggcatgcggctaatgttaaatatatgagagttttgtgttcagaaaccatgtccctctactcatctaacttatgttggatgttgttcagggttttctcccatttttctgaatagttgtccattctcaaatggacgcgtgtaatcgggaaacatttgattattttgttgcttacaatatatagcacagatacaggtgagtttatatacgattgcatccagtactgcattttgtatacatcctggtaacaagaagaatatgagatatccgaattcctactattgtatcagattcctctcattccttgacgcagcggtcaatcggatggaacatgaaacacatcttaaattttgatctcctgtagcggcactatgatccaagtgaaattcttggcacagaagctagtagttgatgattgtcatcatctcttactcggatagagaacccagtagttgatgattgtcatctcttactcggatagagaaccaggagttttcgtgaaggtgtcgacattctaggatagagagggcagaagaactcgaacatcggcctctcctctataaattattaagtaaataccgatcttgaattgagttctgatggataggttgcaatggcgaaataacaatagataatacttgctatctcttgcaagatcatgagtctatgatcatgtcatcgtttataaatgacgctagttttatcgaacacgcaagaaaaaaaggtttaaacataagatccccactactgtggtgccaaaaaaaaaagaaaggagaaaaccataagaatactcaagattaaagaggacgcgaccacagacaccaaaacaactctagccacccgctacctctagctaagccaagcccctaactcttgctatatactaaaaaaaaccctttctctgaaatccaactacacgcaaggagaggattcgttaaacacacaatttttttgtgtatgcttccaaagtaatgagaaaattcaggccatgcttgagcacctttggaataatagaattgacctttatccaccatttacaaaaataactatcctttggtcgtgatggaagatctgcacaaccataacggctaaagaggagataccaaacttgtcatgagaagacaacctatcaaaatttgctgaatggccttctcctcttgatcacacatcgaccctatttgcgagatttgatagtgtggcatccttttggaccgaaaattgataagtagacttattaggaggttgatttctaattcaatataaattgaaggatatataatcgaacttcacacattttatttttataagtcattgtattttttaaaacaatatttcagattaatcatacaattagtgtttttaaaaaataaattccagtataaatgaaaccatataatataattagtttagaaaaatcataaattctagtataaatgaaatgatacaagcaaaatataataattaacaaataactatttttctcacaataactaatttcctacaccatatacaacgttttctctttttttatcatcacaaattgttttcttccttttttttacaccaattgttttttttctagtagatggcaatccggtgctccttgtctgaactctctcaatctcaacttctcaagtggcaactcttaacccccttcaggtgtcaaaaaaaaaaaaaaaacctctcaagtctcaaccccttcaatcccagccgccaattttaggatccaacggctcctagatagcgtacggcaccacccgtaaaccgtgaacaaacccagcccgggacacaatctgcgccgcacatcaaaatcgggctcgagtcgacacacgagcgaatctgacctaaaccctagctcgcctcctcctcctcctcctcgccgccgccgccgccgccgtcgccgtcgagcaccacccgagcagccatggcgaatcgtaagcgagacgaagaaccgccctaccctctccctctcttgtgtcctgctccgcttccgactctgggggcgaatgggtggtttgtttaattggttcggtttggtttggtttgcagcggcagcagcagcagggccgtcggggggagcgaggtcgttcctgcaggccgtgtcgaccgtcaccgaggaggcgccgtcgccgctccgcgtcgtgcagatggagggcctggtgattatttttcttctcccctcccgttttgtcccttggtagaattcgaagcgcgtccgctatgctagcatgtttgttttgggcgacttgcgcttgggatgaagtaaggataagctcttgatttcgggaggatctgtttgtgtgatgaaacgcccgcagtgtgcgatttctcttcacccaaatgtgttgtttagctctttagatcgaggtaattacatgctttgccgtgtaattagatcggggtcctttggctctggaactggagggatttggtgaggttattacgaatatagttgtcccttttacaatgttttcttctacacatgatttgaaagtgatcggaagacttcctatcttaattaattacattgaatgacctccttcggtcattccggcaaaaaagaaagtgatcatctgcattgtgattgttgagaagaagtgtaggagaaactagggagagcagagggtgggagaaaattcttgcttgattcgcagcgcaataggagcctccaagagtgctctagtggagcacaaccatattgcacgacacacatgttgcttttagtcatgtacttatgttgaccatactctactagatcaaatttgctgcacctttacattggatgattttctgagggccagccgcatttttcttttgccctgtgtttgaataggcatgtttaggtatagtactcttatatttccactcacaaatttctctctctctctctctcaatcatgcaggctgtcctgaagatcattaagcactgtgaggagtttgcacctgctctagttacaggccaactgcttggtttggatgttggcagtgttctggaagtaacgaactgttttcctttcccagtgagtatttaacatctataacatatttcttttaatatgacttgagtattcttgtggttgtttagtttatagattaacagctactttaatatttgaccacagatgagagaagatgatgaagaggcagatgcagatggtgcaaattatcagcttgagatgatgaggtgcttgagggaggttaatgttgacaataacactgttggatggtatgataagacatttcattcaatacctattgctgttgttccatatgataattaacctctgccgcgtgcttctgcgagcagcctttgagtttacacgtgttacaactctgtttttgtagtctttgatcctctgcctttaatttatatgtgcataaatagttcattcgtatttctttgttctgaccgtttgttcattattatatttttggaatgttgctaacatctttggctgtagttaataatgcaggcaaactaaattgagatatgctcatttgtcaacatagtttagtgatgctgttgagtatgtgacactgaaaagtgagaacaaaataaatgtggaattttgcctctatgcatacatgtatagaaatgttgtttgtgtcatgtattcaccttgtctctgtttaaaatcaatggtgctctgcttgtttgcttggactgattattttatctaatcctcttttggaaacacttcatgagagtgttaaatttcttattgcatgaagcaaccaaacatcatcaagcttctggtagcaacctttagttatcgtgtatgtggttaacattgaccttaaagtggctggttttgtgcttactcgatgtattttccagtcttttgcagttgcattaacgacatattaacctgtgttgcattctagctgtttcatgcctcgttcaaaatatttgctatatttttaactccaataatgactaattatccaacgtatttcatcttgagcttaagtgatgtgtcctattatttgtattatttatgttgtggttttaagttttaacctccattcttgttgtacttgtttaacagattttgcacatacaactatcataatcatccaacaaagctgtagcctgttctgcttcatgttttgacccttttttttcccatgcctgtgtacaggtatcaatcttgcttgcttggatcttttcagactgtggaactgattgaaacgtttatgaactatcaggtatgcaaaaataaataaggtgcaattgatcaatctttccattgctgttgggttatcctctcccagctttgttgacctactgcagtaatagttttaggccaacttgcgcattaattagctcaaaatagctagcacagcatgaacaaacaaataggacagcaaacagtgcacctaattagcttctctaattagcatgtaacctattttgacacgaatcaaggttaagtctctgtatgcattacaatatctaacctgtttgtacatccaatgtagtatacgcagcagtacatgcatatcatatatcaaatatctatgagttggtcataagagttgcgtaattttctgcgatgttgcatgcagaacataacatttgcatgttacaggagaatatccggagatgtgtgtgcatcgtttatgacccatctaggtcaaatcagggggttctagctctcaaggccttgaaactcacagattcattcatggatctttaccgtaacaatggtttaactggagagaagtacggtttcttttatgtaacccagtccttctaatagtttttaaagattgcatatgcaaatgactacatgtttttacaggttaagagagaagaaattgtcatgggttgatatttttgaggagataccggtatgtacttagttatctttcatgtcaatatgtacaatttttgtgtcctgatgtatcctgtcttattgtctcatagattaaagtttccaactctgcacttgtcagtgccttcatgacggagctggaacctgaatcacctgtttcacaggtttagagttaacttgtgaattttttttatgtggcatctgttgtcatcatcctttagcagctacctaggatttatatttatcttcttgttacagtgtgattttgaccgccttaaattgtcaactgctccattcatggaaaggaacttggaatttctgattggctgcatggatgatctttcatcagagcagaacaaggttattttttgaaatgaacttttgcataaactatctgatgttactgtgacaaatatattttatatgactgggtgttgtccttctggtgtagttccaatattactatcgcaatgtctcaagacagcagtcacagcagcaggcatggctccaaaagagaaggtcaaaacaactgcttgtccattgtgatattgatcagttcattagctcttggaatgtgccaactttttaaacaagcgcactcttcctctcggaaataagcaaagcaggtgctgctatgaatatggcaatttacgtctcatattttttttgctactgacatgctgcaggcaagagaatatggcaagaaaagctgctggagaggagccattgccagaagaagacccatccaatcccattttcaagccgattcctgagccgtcacgtttggagggttatcttgtaaccaatcagatctccagttactgcaaccatattaatgggtatggattctcgcaagtttatgcctattctctaggagttccataatgcctgtgtcttttcgtcaggaatgaaccattagatgtagaaattttactgtgattattatggtcgtacagatgcatgtctcatgattgaactagtaacatgcaaaagtattaaatatacaatgttgttagcatgtagtggtgtagtctgatacacaaaatgttcctttttgaatgatccatttaattatggcaatggttacggtgaagtaaatatggcaaaatttctcttctggctcttgtttccgtcgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68118 - DNA, 2060 bp, Oryza sativa
ttgaaggagaaggagaagaagctgctacgcaaagagaaaacccgtctgcgcaatcttgttgcaccggtagttgcagagagccacttttctctgtcagaagatgatgtcgaaacagcatgctcgtcacttgatatggaacgactgaagagctctgtgatagcatggagaacaaagatacaacagaaaaggccagattactcagtggtgctctgagcaaagaaggctcgtctggtacttcaaatgaaggaaagaaaattcaagcaaacggcgtggatggttccaaagcaaaatccacctcttcaggtgagaaggtcacgcaaggcaatacactaagcaactatgagaagaaagaagagaaaccatggggaagggaagagatcgagttgcttaggaaagcaatacaaaagtatccaaagggaacctcccggaggtgggaggttgtctctgagtttattggaactggaagatctgttgaagaaattctgaaggctacaaagactgttcttttgcagaaaccggactctaccaaagcttttgactctttccttgagaaacgcaagccagcaccgtccattgcatcacctctttctgtaagaactgaaacagttggtttgcctactgagaaagcagctggaaatgcatcatccaaagcgcctgcacaacatgcaagcagtaaaacatccgacgagaaagctgctgctcctgctcctgctcctgtatcaaatggaacaccttctggaacagcagatccagaggcttggtcagaggcgcaagtgctggctcttgtacaagctttgaaggcatttcctaaggatgcaagccaaagatgggagcgtgtggctgccgctgtcccaggtaaaaccatggtgcagtgcaagaaaaaggttgcagagatgcaaaagaatttccggagcaagaaaagcgctgagtagaacaacatagtaccggcacaagtactttttgtggctagtggctgacaaaagcttctgtttgaacatcagtatcccttatatgttagagaatcatagctgcgtactcctgatgaattttgccagcatatcacggcctccagtggtagcaataattttggtttggagctctgtgagaactcgcattgggccttaaccggtgtcggcattctgcttacacaagttttttggtctaccaagaaagaagctgatctgctgttgttgatagctaatgttttggccttccccaacattaggtggactttctgctgacccttgggttgtttatgttcgagagccccttgaagagtattatttccttgcattggtggagtgatatgatctggtctggcacgacacagggagtgtagagaacagcatcggcatttatttatcaacttataagatagaaatatttgttacaacttgagaacttgctatatcaagaaaccatatttttgcctaatcagattcattattcatgtctccttgttaagttataacttgtaatgccagtggtaaatgcccttttgtgttgctcttgcgagaaaatgatagtagttcgtttcctgaaacagcactccacttgtttgatataatccctccgttttttaatatatgacgccgttgacttttgttacaacctttgactgttcctcttattcaaaaattttgtacaaattttaaaaatattagtcatgcttaaagttcatttagtgataaattaaaccatgacaaaagaaaatatatttatttaaatattttgaataagacgaatggtcaaacatgtgagaaaaaaatcaatgatgtcatctatttaaaaaacggaggtagtatatctaacttgccctctccttctggtaaactttttttgttattattcttatcactcggccccgttcggttgtaacgtgataaagaagctggaaactctctccttttttttaaaacttttttgttactattcttatcactcggccccgttcggttgtaatgtgatgaagattacgtgttagacacataaaaggagaaaacgagaaaactattagcggatgatatcattaattgatttttaattattttatattaaaa

SEQ ID NO: 68119 - DNA, 2111 bp, Oryza sativa
  unsure (1)..(2111): unsure at all n locations
aatcatttacaaacatatttgaacattgcaaactaacatataagaacaaacatgagaaacaaaagataatcaatcagtagggaataggccctcgcagtttgttagcgatatgtaagaggtggtcaatgtttgtgggtggatagctctggagaagctttaggtttgctgtgaaatccccggccaagagccgccttcgaacaagaattagcatagcacaacagattcgaagtaaggtggcctgcaataagataataagagttttatagtgcatttcaaaaaattctcagatggcatggaactaggaatggcagtttctaacctgaggtccctcaggatcacctaacagtgcatcccatatatggatgcagtcgcgaaacttgaattcctgcgtcaatagcaaggtgatccatctgaatgcgtaaaactgtggattaacctggaatatacaaagcattagagtaggagcagaaatacactgtaaaaatgtaacaagaaaaaagttattgaaatgcataccttggtcacaacctctaaatgccgccagagctcttcatcgtgccttttcaggagctgggataacttgctgattgtggagcgtatgcccaccacactgttgtcaagctgtttgcaaaagttatcccgaaatccactaagcagctcaacgaaacagaaaaatgcatccggctctgctgactcctgtttacataagaaattaaaaggtgtatgggcacagagttagccgatgcttgtattctatagataacatcattgtttctctccggtcatcacccatctagcagccatacttgcataataaaaaataaggtacatggtaaagctatctaacaatagtagtgaaatgtttctactttggtaacttcagaagaaaaaagaatgaataatagtcacttaggcagtataccaaagtcagataaagtacatgatacatggttccaacaggcagggaaccacttaccagtgaatgaattcaggaaatctgtatagaagaaatctaccacatatatttaagccttaaagccaaggaacttacatacgaaccaacgttcaacaattttaagcaaatagcgtcatgggaaaaaaaaacacttacagcattattttcttctggatcattcttgaaaacatagtagagtggtgccaaaacttcattcattccttgtacatatcttatacccggatttaattttgcaaatatggtaagtatacgctttagcgactcctgaagacaaacatatatcacatttagcctaactggacattacaaaagacaaaaagaactggcatcatatcagataataaatgcttacttgattagacaaggcatcagaagaatccccattgaaaaattgcatctcaggatgagtacgcttaacatctctatcaatctgctctatagtttcagattcctgaagtatcaaataacagtgtatatttttagtagctcaaacactatactgtacaatatattcattacaaaaattcaacgaagagctgcaaagggaccaagggagatctctcaatatcaaggagttgaaagttctaccatcaaattgaaccaaagcaaaatacagacttaacatgtggcagtacataaatttacgatttagtgaacattacctggaaaaattggttccagacactagttttcccgaggcttagaggatgttcatcatggacaatttctgcccttggaagcactccagttccttcagaattatgtctgttccctttggatatagtcatttcctccattcttcgagtaacttctgactgaccataaccaaaacatattattatgtatctttcttaaaaggagaaaactaccaaatgaaattgttaagatgtaaaacaagttggtaccacaataaaatactttagcatatccnnnnnnnnnnnnnnnnnnnnnnnaattactagttttaaatcagggcacatagtttctgacttgtatgtccatctctcataatgctaacaattgctatcaatacagacaatgtaaccacataccagccaatggttcagaactgaaatcatatatggataaagaacttacaggattaactagaagctcgtctttgaaagccactgta

SEQ ID NO: 68120 - DNA, 728 bp, Oryza sativa
agctccagtgggcattcaaccaggtggagtggccgacgaggaggagactgtcgcagccattgtggatgaaatggagagggaggattctgacacgagcgtgtagaggaaggtgattcgtcagatgaggagacggatattaatccagcagaataggctagtcaggatttttctgggctgatcgtctctgaagaggatagtgtgagatgggagtacaaagaaaatgaggttattcagggagcgatttatagtagaacagaagatatgaaggaggcggtaaaacattttgcagtgtcacttcatagagagttttgggttgccaagtccaaccggtcgcaatatgaagttcggtgtgttaaggaaaaagatggttgtccctggagagtgcacgcgtataaggggaaatggaaggattattggacaatgtcagtcattaccaagcatacatgttttctacctgttgttcagaaataccacaggaacattacatgtgcatttgtcgcatctgagatgtatgcgcatgtcatcgataatctcacatacgaaccaaggtcaataatccgacacatcgaggagacatacaagtatactattagctatgccaaggcctggagggccaaacagaaaataatagagatgagatttggaacatacgaagcctcgtatgacaatttgccacgtctgcttggtgttatcgaggaaagaaaccctgggagctcttacgaagtgaa

SEQ ID NO: 68121 - DNA, 4446 bp, Oryza sativa
caatgagctttggaagagattagatgagttgacagccaaatgcagtgatcagcgtgcagcggctccatcgactgccgttgatgacccttctcaagctcttggacctctcccaacggatagtccaactttggttgaagaactggattggagattcgaaaattttctcagtggattctgcatgaaccaaaagagaaatgggccaaggtgtatgacaccggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggaactttcatgcagaaaaagctagaggagttgcgtaaaaaggccatgaaacatcgagctctagtgcaaggtacccaacaacataggttcgagatactatgtcaagataaggcaggcaggggtatctaccgcaagagagtgaagcaggagtgtgttctcaaagccgacagcatatatcattgctcttgttcaaagccgaagctgctccacaggccatgcacccatgtcattgctgccgcagcggagtgtggcataccagatgcagtatatgtgtcgcagtactttagtaagcaagcaatatatcatacatggagcggcgagatttacgggttcggcatagctggggagtttatagagactaacgatgaagtactcaatattcctgacccatcaaagctccgaggcaaggctggaaggaggaggactcgtcgcatccgcaacaatatggacgagtcggaggctggcagggtgaagcgttgcagcaaatgcgatgaacgtgggcacacctacaagcattgtcctaaagacaaggagaaaccaagtgcggcggaggcaggactatcaggatcagcagcagatggagctcgccctatgggtgaaggcactacctccactcgaccacgtcctaggcgtcgtcgtgccacgtctggctacgtggtgtagttgcacgtcatcgttatgtaccattagtaacgtttgctttatttaaataggctgtactcttgttgtacgtaattattctcatgatttttttactatttcattaatttgcgagtcatcttttgttttacattactactttttgaattgttctaacacgaaacactatatttttcagagatggcacgtcaggatacacctcaactgttggatccggcgatagatctccgacaccggtctcaccttactgcggtgcagggggctcagcttgggacgttccgggcacagacatgaggtgagctactcacggttcacgactccttcgtcgagaggtacgaacagtatattactataaattagttgcgctgtaatcttttttgtaatgacatattaatttcttattgcaggctgcgtgaggccggcctcctaccgatgtgtcggctggtggaggctgccgccggccacgtggacccggccagacgatggactatggacaggtccctcctagcagctttggttgaccgatggaggcctgagacacacacttttcacttgccgtgcggtgaggtagcccctaccctacaggacgtatcgtacttgttggggctaccgctcgcgggagacgctgttgggccagtgaccacggctgcggactggcaggacgatctgatggcacgtttcgcactagtacagcgcgcaccgcacctcccgctccagccgttggcacaccaccgcaacaccggacctacgaagaggtggctgcttcagttcaccgtgagtgtttttgtaccgaaatgacaagcgtactacatatttattccacatgttaaggttcctaacattttaactaacgcttgcaggtcgatcagctacaggcggaggccgacgagtactcctacagccgctgtttggaggcgtacttgctctggctttttggctaggtgatgttctgtggcggtcaggggcacgcggtcgacaagggactcgtgcactacgccaggagcatcgccgacgccgcggtaggcgaggtgcctcagtggagctggggttccgcgttgttggcggctctgtaccgtggactttgtgaggcttgcacgaagacggatcccagcgcgacctttggtgggtgccctctctttctttctatctgggcagctgagaggattgcgatcggccgcccggaggtggaccagcacgcgtacgaggagtcactgtacgaggagcgaccagaggtcgactaccctacgatgggtactctgtggtgccgtcgtcaggtacgttgcatcgatcttctagctttgttaagtacgcaggccgcctacttctcccacgctgcagggtcagcgtctcagccagctgcgtcgacctcgcactcagcgcaattccagcagtacaccggggcttcctcacaggcagccggcacgtcgagtcagggtccaccactggaccatgctgggacctcgtcggaccgcttgctgtcttccaccgtgctcttcgacatcactgacttcgacttcgcttcaggctcggcagaggacgtcatcggcccctcacagctgggaggcgcaccgccggtgcagacgcaggaccaggcgcaggccactcctccgccagacactcgtgctacccgtgctgtgccaccggatcgtttcacctactcccaggaccacgtgcgagcacaggccggaggaccaagcgtggtcgcggcgcggggcagggccagtagagcagtcttctctttgtttatttgcttcactttccagtactgtatgcttgtgtaatgactacgttgttgttatatgtgcacgatatctttcggcgcatgcacgatacctttcggcgcatgcacgactactttctcccacaccgatgcagcctcctttattcgcgtgcgatacgagtatttgcccgccatttgccgcatacgaccaacgtaactttcggcgctgatcaagcatgcaactttcggcgccaatcaggcgtacccaccatgccccaccacgttcacatgtcaaggatatcactcaagtttttgcgcatatataagtcgccttaacgagtgaggcctcacaatctttcagaactcagtcacattcagtactctcttccccacttcttcattacaaatcctaccggctttcgtcaatggctagacgccggggtgttgaggatccaaactggcgcagcgatccttgtgtatacctactaccaccttggtgccagcgtcctctctgcctatgcggtgatcgatgccaactaatggcttcgaggaatcctgatatttgaggaaggcgcttttttaggtgccctaactgtgaccgtgaggtattttattatctgcaaatgcttattcattccgtatgggcaatcgctttattcttcgtaacactactctatttggcagacccgcactacggtttgcgcatacatcgagtgggtcgatacagaaaatcccgttctcgacctaaccacttgtttacaagaaggtcgctggtatttcgcatccgaaagtactgagcaatacttaaagagaaaagcggcttatgaacgacaatgtcgtgaacaacagagcgactggagggtgctaactacggcactccctccatgggaagcccgtccaagatgcaggtgtggtgatcgttgtcaggttcttcgttccataaatcctacaacattgggtcgaaggttctttatttgtccaaatattcttgacgacgatttcatggtaagaatattttgattacatgaatccttattttctcacaacatttactaactttgctcgctttacatctattctttcctcccaggaaccaccaaggagatgtcaatacagagaatgaatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatcgaaattgttgtatcatgttcaaattgtactactatttcttcatgttatataattctccttgtttaagtccatataatgtttctacgaccgagactgcgataggcctatattaattatccgagtactaatacgtcgaataaggtacaaaataatacctcacttaacatatgaaattgcgcaacaaccaacttcaatacatttttataacaatattaacaagttttaccaaaaaatacttctttattttttattaacattacatagaaaaatattttggccgtacttttt

SEQ ID NO: 68122 - DNA, 5334 bp, Oryza sativa
atgcaaaaagtacggccgcaagctctgagggggcggccaaattgcaattagccccttgccgccttctgtatgggcggcaagggcctaatcgtaattttggccgacggcggcagacggcgcggtcgacccaccgtctgccacgtcagcttgccgccccaatggtgggtggcagggtctatttttgcaatttttctcgccgatagattatttctgtaaatattaaaaaaaaaatctaaaaacgaaaaaaattctatcctatttgagggagaagctacagtgtctaatagaatctcagctcccttaaaaagttcagattgtcattacgagaatatgtaggtgtagagtccagaaaataaattacaagccaaaaacaaaaaaaaatctttcatggtttttagaagctgactactaacgagtagattctcaaaatcttaaactccccacaaacaaggcttacgaaaagtgacacatcctgctactcagcagcggagccagggccccggcgaccctgggcagctgcccgggctccgccggctgcatgcaaccgtacctcattagattaaacataattaccttgttgatcatcttccttaatcaccttatcaattgaagcggcaacagtatatactccctccatattgtaatatatgacaccattgactttttgaccaatgtttgatcattcgtcctatttaaaaatttatataattataatttattttattatgacttgatttatcatcaaatatcatttaagcatggcatagatatttttatatttgcacaaaaaaattgaataagaagaatagtcaaacgttggtcaaaaaatcaacggcatcatacattaaaatacatagggagtatacagtatacatacttaactaacggcttagcgaaaaatagcaaagcaaatgttcactctaaaatgatctatggatttgtatagacttgtgtatactatatactatatttgttgaacttgcccaggcttacaaaattttttggatccgccactgttgctactacaaatctaaacaatatgttcatatttacagcactaggatatactaagttagtttattttaaaacagatgaaataacttttaacaaatacccatggtatctcttaaataaaaaaacaaatggaatccaatgaatccacggtaaaagtgttatctcttgcgaataatcgtcagtttatgttgtttagaaaatattaatgataagcgtagaaatttcttttaagttgccttattgttcaaatttttttttaattgcttgcactatgccagatcaacccatctttgatgcctacctatgacggatcaaaatgtatcatcatggatgatatcatctctgatgggttaaagtaaatcctggcgtagatgaggctcaagaaaatgccctgttacagtaaataactcatctatgacggatctatataaggacccgatacataacgtttctaacgagctcacatatagggccgtcatatatgacctattactcgtggtgggtgttgagttttcacccgtcacgagtgggatacttcaccttaaacgtgttcaaatcttataccgttgatggtgattaaaaaaaacccacccccaccctaggggcccgctagcctgctcgccccttctcctcccctcatcttctctctcttatatcttcctccgccagcgcacccatccctcccgcctgatcgccacccgccaccctccctcccgacccctggctgtcgcggccttcttcccatgattgccgtccaccggatctagcctccacgaacgttgtcatctccttcgcccactgttggtggtttgctcgtctcgtcagccccgagctccttggcgccaggtccggtctccatgtggttggggaccaacggatctagacgcctccatgcatgctccgcttgtcgccttcttcgccctctgtcccaaatcgtcggccaccacctcatccagatctgctcaagcgccgacaacccgccttagcacctttgacaacccgcatcagcaccttataacttataagtagtgggagaaggtgctaaggcgggtcgtcggtgctcgagcggatccgtatgaggcagcggttgacgatcttgggacagatcaacgagaatagaacacgaataaaaaactttatcgagtagtggtttctcatcattgtcaagctcgacgccagaaactgtcattctcttataaggtgcgctaaaatttaaattttaaaactatttttcataaaattttattttaaggattggtttttaaatcattaagaacacatatataaaaagtttacctataaattattatttctactaataaatggtacgacttataagagcaagtttaatagtatagtcaactattagctccaaatcatctatagtcaatttaatatccaattcatacaatagttacctataacatatactccctccatttctaaatatttgacgtcgttgacttttttaaacatgtttgatcattcattttattaaaaaaaatcaagtaattattaattattttcctatcatttgattcattgttaaatatacttttatgtacatatatagttttatatatttcacaaaagtttttgaataatacgactggttaaagatgtgctaaaaattcaacgatgtcaaatatttagaaacggaacgagtagtatacaattaatacctgatcctacttgtcatacacatatttatcttatagctcgttactcttctctctcatattttatcttctcgaaatatatttatagctaatttatagtccgctattgtacccgctctaattagcgtcaggcgaagcttctcaacagaaaagccaagcaaacgtttcgggctacgttcacctgtgatcagaccggcccaaacaatgatgggccgagccaggccggggccgggccgggttcccataaatatttaatgctacggttgaaaatggctgtgccacagacaggtaggtcccacgggcacggccacatccccctccccccttcttccatcctcgcatcataaaaatccatattcttctccttcttctccctccgcgtcgcattcgcatcacccccccgaaaccctagacccaccaccaccaccaccatccccgagctcgcggagaggcagcgagagcgagaggtagctgctagtaggcgtcgggcgaggagatgtacgcggaccagatctccaccggccggaagcgctccatccacgaccgcatcgacggcgaccagcccgccgcccgcgctggcgccggcgccggcggccggggggcccgtaacccgccgtccaagaggtcagcgcggagcagctccagtctcctcctcctcttccctccctaccgtcctctcctccgcggcatatgctctttgcatctaagtacctcgctctgttccttcgtggctggcgcgctgtgtgtagcttaggaatacgcgtagcgtagttttgatcttgtcgcgaggaatgattgtggcttttaaagcttcggtgtcctcgtttctttgttgtgagaggagctgaatatcaccgtgtttgtggttgaaattgtgctgtgcgtgcccacccttttttacttcctgattgcgtgttgacaatgatcttgttgcgggcgagcggtaccacgcatagtttgtattgataccaattaagtcggtgtaatgcgtgaatttcagttatataggcttttggtatgtttgcacttggagcttctttgtttggaagttaaaagtccaaaattttctcttaccaaaaaaggatttgtgattccacgtggtgtgtacggtagtgtcggcttacagcttacaacaggattttcctgttgttactacttatgacttatgagatgtcctaaccaagccacatcgggtctgctgtccttttttgttgcaaaaagtcttaactttgaactagttatagtaaattgtagtgcttatagaaggaactacaacttttaagtagtcgtttggtttccatggttattagtgaggtattttccagaagacagcggtgcctcccgatgttggaaagtcagcccttgatgtttgatagtttttttccctaacaaaggtgtccgaccatttgttgtgttgatgcttacatcagttctattatcgtgttccaactgatcattgtaggcaaaatttgttgaaactgagccatggtatgtttaatcctgtttataaaaggtgcatgatctttattgtcatgcttatctagaagttagtctttctttattgaatcacataacttttattgtgcacaacactaccattcctgtatgcccatttcacttggctagctaattattaaaaccgtagatccttatattctgtaggcaacggcaaactgatgaaaaatggaagcatgatctttaccgggaagacgatgaaccagcttcaagtaataaaagaaagaagtttttgatgtaccttaaataaagacaggccttttgtattcttatttaattcttatctgcctgtgcattatgttaagaatcaattgatccacgggatttgcgattgaagcttcagaagaaaagctctcagcaaagctttgctggccaaaggggttctggtgtacgtgatctacgtgagatgctttctggaacaatgcacccacagccagtcaatgcggaccctccaaaggcaaagccatcatcagagatcgtgaaagtcacaaggcgtgaaaatgcagatgtaatgcctgtacgtcaaagtaagaaagtaccaaaaccgacgtcatcgaagaagacatctcagccgaaggtaagggttatgtttgttgtaatgggtgccacatgtatatagttttccagtatttagttggatctcattctcagttgtttgcaattagcttgagagactgcttttttggtaactacttttattttgatgtccagaatgaaacttgtagtaatagttttgagaaaatttcttatttaccatataatataactccaatcccttattttccaatggaaaattgatcttccctcgaatgccactagttcattttgtcttcctttatttgccactttcgtcatcttgctgttgactgtagtctgtactgcaccactggggagcggcattattgatatgcgaaaatcttttcttcttcgattagcttcagcaaggcagctaatccctccactgcagctgtttcctcctccttgaatgcatggcgagcacttcccttctgtcaaagcacttgggtaggtgtccttgttggtggtgtcaatttagcctaacttatcaaacaaaaacattcgagttggtggtgccaatttagccaactcaacaaaacaatcgagccat

SEQ ID NO: 68123 - DNA, 1157 bp, Oryza sativa
ccccaaacatggcctaaagcttgttgggatctggtagatccaacattgttgggacatggttctagaattactatactcaattgatgcttgatttaatcatgtcttgtagcctagactttttatccccacataatctagaaagcatggtcaaccaagcattaatctatcctccatccatccccccacaagaaacaatgggtacagatccacgatagctgaattcttcatgctggctcttggctctgagtgctctgcagaggtggaggagatggattcagctgtaacggctgacttgccaaaactgctagcctgataagtgatgtggagaagtgctgccttcgtaggttcatcttgttgcctatgcacgcactgatcttctgcagatatggacaggagatagagattgagttcacaggcagcactatgtttgtgagggtagaaaaggagttctttttccaaagatgtttaatagtcccttgacttaagggaagacaaaaatgaactgatgggcaatggcaaatagggtaagatcgtttttcacatggcaagtaaacaattttggttagcattttttttttttagaaatgttatccctggttttattgaaagcatggttctgttgattgggttaatcttttatggcaaatagtgaattttctaacacttttggatttcttgtgctgatgtttgtttcactatgttgtgctctttggagataagagtaactccaggtcctgtcatgatcttgttgtgtaaataggtgttgaattttaatcttttatcgaggaattttgggatctgttcatttcattgtcatttaaattgccccttcaatttggaatgccttctattttctgttttaagagcgccattgccattcattatacatttctgacttctgatcctgtatataaaatgatgtgcatagaattctggccgagcccactagccactggcttactagtcactgctatttaatcataggtacttctatagttggaaacttgagttggtttggtaattgggagaaggcaaattggttatatagcatcgaaagttaacgtttttggttttatagcaccgaaagataccgttcattttaatagcacccaaagttcaccccgtttccatttttaacactttcgtcaattctcgat

SEQ ID NO: 68124 - DNA, 1306 bp, Oryza sativa
ttctgacttgtatgtccatctctcataatgctaacaattgctatcaatacagacaatgtaaccacataccagccaatggttcagaactgaaatcatcatatggataaagaacttacaggattaactagaagctcgtctttgaaagcactgtattgggaccgctttttctccagttcatatgcccacagcgcatgatcagtcggcaagtatcccaatagaagctgctaactatcaaacaagtcaaataaatttgtagtgtagcaaacaaggagaaagattaaagatttgtacattgtaagccagtctaaatttagtcacattcatagctatttaacctaaaattcttgcagtgaattccataatatcatttagcttaatcctactacaacagttctcttcatatataaaattatgtcagttgaaattaagttgtgcaatgacatgtaacacaaaaaatactgaaaggctttcagtgtaataatgctctgctcaaatcactaaatgcttgtatacatatttacaaactacaaatcatattctatttgtcaattacgaatcctgatttctcctaaatttattcaactaacaaaaataatgccatgagcagttgtttgtaatcctaatgcacaattatagagcgtatgaaattctaccactggcttcaaagcagtttgctgaaactagtaagaacttatctttatgaatcatggcctcatggcaatcgtatagtttggtccttaaaaactgaatgtatgggaataaaacatcttaagaacctagagaaatccaaacatttcaatgaaacaaaaacttgattagagacccattcacttcagaatagatataactgaaaccgcattccccgaacacactccatgatatctcaaaagaccaaggtaaaaaaaaatgctcctaatccttgcgtgcagcataaaccatgtatcaagtatcaacaccaaaccatatgattgatccgaatcaaatcacgccaaacccccatccatcctaaattccatcatttatgggttgtctacggctttccaaaaaacaaatgaatccaatgcaaggacagcatccatgagctgtgacgaagcgaaatcctagtattcgtaatacccattttactctagcatggtgacacacagtgaagtatgtgaagtaataagagtagtaaaataagagaaggcaagacgattccaccataccttccagacgacggggcgcacgccggcggcgtcgggcacgcctggcacgcgagcctccgcagctcagccagatccaccaccttcctgcccagctgcaattg

SEQ ID NO: 68125 - DNA, 2442 bp, Oryza sativa
ggggaggcgcggaccagatcgggctgttgagccagtcggggacgtgcttccgctgccccgacctcgccgaggccggcgagggcgggtcgccggggttcgcgctggcgccgtcggccatgggcggtggcggtggtggggtttaggcgtttgggaaggaatcagggatgctttgggaaggagatcctcgggatcgaggcggactggacggtggtgggttggacttggatcggtcggtgcggttttctttttttcctttttctattcagtttcaataagtaaacccacccccctcgatttagaggtatttaaatagtatctgtcacttgtaagctccacgtagagaagagaagagagaagaaaagcgggctacagatttgtagccagtcgggctaccgatttatagccaccgcagcaatgggttccaatatattgtttagggactgtctatactgcagtcgcatgttttttgtgtcctatttcagtcagatttctgtaccacacgatttacatctaatagctcacaaaaactgctacaataacatattataaaagtctagatttatttttttagaccaatacaggccaaaaaagcccatctgtcttaaaaaaaattgacaagcccaaaataaagtctaaaaatggtcgctagaaaacagagacaaaggcacatgatcaaacagagcccacagaacaaacatatttagaaagcttgcaatccaagttgatgggcacgtgatgacagctaactattacagatcgggatcacaactaggaccacctctttccgaagagatcacacaacacacgctgcaacaatccagattatactagggagatggagctagaggaagagaaagatcccccaaaacatcaatccaaaatcaagatgaattcagcagagatcaagaagagaaagataggcttaggaaaagatcaaggttcagaaaagaaggaaatgtcaggaaagaatatcaaatatatcaaagaaactggtactaaaggtcaatccaaagaactccaaaaagaagaatcgaagagcagaaagagcacaaaagacaagtccaagaagaacaaaggtgagtgaacagaaaaattctccaaatattacctgcttggttcttttcagaatttgattcttcttttggaatttgtttgatcagatctgtaaagaaaagttaatgaggttagaaatgtagaaactgattagatcttaaaaaaatgaatctgttctaatatgaactaaatagagtcaatctgaaagtaaatctgaccactgtaagtaaattgggcaaatcattgtaactgtcattttagaactgggcaaatcactgaaattttcagaatggtaaatagtatgaatatgttctaatatgaaatcataaagtcaatctgaatgtaatattaatgtttctgcatatatgactcaaatccagcaatagcagaaagaattcacaaggaatacaccaccaaagtgaacaaacatgaatcaagaacaggtataaaatgaagtcaatgaaatagattactaatcataagaagtttacttgcaaactttttttaaaaaaaggaaatgacatcagatatgtacaaaaacacatcaaaactctgcatttcatcagacaagaaattaaattaattttcaattgggatgatttattttcttgcctgatgacatgcagaattaagatttgcttaattgaatttatgtttatcatcatctggcaaaaaagtggattgtccaatgattaatttcttctgtcaatttccaatttgcaaactagttacagtgaacagtataaaaaatacatagaaacgacacctgtaattttagttcaatatcaatgtaactacacgaaatactatacaaaaacaaacaaaagcatgatctaaggcaattttattttcaaattgaaatagtttcaaattcaaaaagcaaagaacagctcatcagaacttcaaacatagaagaaaagcagaaaagaaaacaaataatatcagaaaacaattccaaaggtatgcattctttaaaattcacttttatttttgtttcatttgaaagatttcagaaatcaccaactatcacagagtgatattgtgtatttgcatagtcttaatggttttaacattcagatatttgtatagtaatcaatatacaaacaagtttcagaaatcaccaactatcatagagtgatattgtgtatttgcatgtggtaggagcatattaaaaaaagaacaaataatggtcttaattttgtgatatatgtctagaaatcaatatacaaaatctaatatgaactcaatagagtcaatctgaaagtaaatttgacaactctaagtaaattgggcaaatcactgtaactgtcaatttagaactgggcaaatcattgaaattttcagaatggtgaatattctgaatatgttctaatatgaactcataaagtc

SEQ ID NO: 68126 - DNA, 2474 bp, Oryza sativa
  unsure (1)..(2474): unsure at all n locations
ggctgggtcaatagcgatcaaggggaatggaaaacgatcgagaattgacggaagtgttaaaaatgggaacggggtaaactttgggtgctattaaagtgaaccggtatctttcggtgctataaaaccaaaaacgtgaacttttgatgctatataaccaattttgcctataaaatttcaaggaagtcatagctgataagcatgcttcacagtttgttttgcatgagggaaggcaagagtcacaggaaccatataatctgttaaagggcatcggtaggtttcagcatgagagtttttatgagggtatctgaactattttgtgccaaatttatgcctagttaaccagctatgaatgttgtatcctgttgactagatccttcacatgttgtgcaaagtatagaattaactaatcgcagctgcagtgactttgcttattttcttaactaaactttcttggtatggttcagatccaacatcattttttttttgttgggaattctttataggctgacagtccacttgatattttcctgaaatctcttggacttgagaagtactcgattaccttccaggcagaagaggtttgattatttccgtgaatgtgtaaatcattttgatgccctctttgatatttatttggttaatagttgtttgtgttgcaggttgacatggcagccctaagacacatgactgacagtgatcttaaagctttgggcattccgatggtacatgcattgcgcctgagatctttattctgttttctgattattaattcgctcgtcagttagataagttttgggggtccttgcttcatctctcatttagccatttaagaatagttgtaatcacccatcaccccaggtcttaagctaactttttgtataatcgtatgtggaatcaactatgaactagttcacttcactccatttttgtataatcgtatgtggaatcagctatgaactagttcacttcactccatataaattagaatacatgtactggtatcatttttgctgaggaactggactataacctttgactgtagtactgcatatgcatgtatattttgtttcaggatataggtggcaccaaactaatgtaagtaaagttgaacatcagcaagcctgcattctttcttatgcgcaagtgtaaatttgatttaagatggaaacttaaggtgggtgttctttcagggtccccggaagaagatcatgcttgccttggaatcgagagcgtagggagggctggcgtgtaatgtagaaaggctgggcgattaggaattgtatgctcctctgcttgcttggtaaacccaaagtgtccgcatgtcctggatacggcgcaagaacaaaagcgctgggcgtcttgtaatgcgtcttctgactagttgagcattccgcattctcagccagtttaggatgttttagaggctggatgaaggttgacaatgtaatattattagtctcctgttaatttttatctggtcggcttgcttgtcaggactcaggaccagctgattaatcaaattgttcatgcggtacacagtattggagctgtgccgatgttcttggggttgctttgctgctgtatacgattattattccattgttgtcttctctccatcggagggagggggatgacacatttcaaactacctgaattttggtttattattattatatacaaatttgcgatctcctgcgtcggtatcttgtctgttgacttgttctgtggtctttgttatctgatggattgctgcattctccacagttgtctcgttcaaaatttcaattttacttttatgatagtagtttcttattaaacctccccgatacttaacatggtgaattgttgcattctccgcagttttttggacagtttttttttttagcaatatgcaagattttcaagttgctgggagaattataccacgtctttgagcaagaagatctgtgatacaataatccaattccaaatagaacaaaaacactttgcttggagaaatctaccagggtctgtctcaaaaaccagaagaaatcataagtttcctacgatggactactagaggtagcagatgatgagctcagaatgagttcttttcagcaatttgaaacaactttcctcgttttcagttagcatgctttcggtaccattaaatggtactttataaaatgtatataaaagtttctttagaaaatcaaataaatttattgtttaagcttatagtagttaatgcttaattaatcacttgctaaaaatagttcttgttttcgtgtcggagattagctctgaggcccattctaaacatcaaattacccatttttcgttagcatgcttcctaaacttttttctaatggctataaattcaacttttaatcacacatgattaattacttattaattattactacctccgttttttaatagatgacgccgnngactttntctcacatgtttgaccattcgtcttatttaaaaaa

SEQ ID NO: 68127 - DNA, 11181 bp, Oryza sativa
atgtgagaaaaagtcaacggcgtcatctattaaaaaacggatggagtataaattttaaaaaatgggttcatttttctttaatttttaaagaaacttttttttagaaaatactaatttctttgctccggtttttatgccccttaacgattttgctaaacatctcccgcgtgatttttttcctggcatttgacgtttttttgccacatgatctttgcacaaggcatagaagcccacgaacagcccagcagcccatcatcatgcctaaccctgattgctaactccaaccccggtccactcactgccccacacgaccacgcccgcactcgttccccgttcacatcacatcgcacacacgccacgccgcttggatccgggtccgtggccagcactcgcaccgccacagcgcacgatgcatttgataaaaaataatgtgtaagtaaatatgtacttattattttctttaaaatataaaattacagttctatataactaaatttacatttgtaaattcagttgatttgacatgtaagtgcactgtaattttgataaaaataatgtgtaagtaaatatgtacttattattttctttaaaatataaaattacagtcctatagaactaaaattacatttgtaaatttagttgatttaacatgtaagtgcactgtaattttgataaaaataatgtgtaagtaaatatgtacttattattttctttaaatataaaattacagtcttatataactaaaattacatatgtaaatttagttgatatgactgtaagtaaatttgcattagttattttatttcaaatataaaattacagtcctatataactaaagggacaatttcgtttctgcccctactctgatgtctaatattaattttacccctactttttagagttttcgtttttacccttacttttttgaactgaacgcttgtttcgcccctactttggatggtgaagttaacggtgttaagtaattgataaaatgacatttataccctctcatgtatgctcattaattgtgtttttgtccccattttatgcgtgtagctttagaactttatttttttagtatatttcaaattacatgaagcacattgactaatatttaaagggaacagataattacattttacaaaatgttgtcaaaattttgtttaagttctatcaaaatgatgaaattttgtcaaaattccatcaaattcagaattttttcaaattgttatattagtcaatgtggtcatctaattttaaatatactctcaaaaataaagttccaaagctacatgtataaaatggggacaaaaacacaattaatgaacatacatgagagggtataaacattatttatcaattacttaacaccgttaacttcaccatccaaagtaggggcaaaacaaacattcagttcagaaaagtgagggtaaaaacgaaaactctaaaaattaggggtaaaatcaatgttagacattgaagtaggggtagaaacgaaattgccccataactaaaattacatatgtaaatttagttgatatgatatgtaagtgcactgtaattttgatagaagtattgtgtaagtaaatttgtattagctattttattttgtaatccgttggatgcaaatctaagggaagaaaaaaatctgggtcaaaaaatcacccgagtgatgaataggcggtcccgccgcttaaagcaagaacgaacgaagccgctgttgaacgggggcctttgttgggcctgaggcccagaagagcagagcccactcaccaacacgagaaaccctaaaagctagacagagcgtcttctccatccatccatccatatatataaccagcgccgcctccctttctctccacatctcaaacccccgatccaatccgctcctctcttcctgaatcatgatctgtatggagtccccccctagcttctgaatccgctggctgctttgcttttgattttcttcttgctgtttgattttggtttggtttggtttgatttgggttggtggtttgctcgctggtacagcggcggcgagcgcggagtaaccacggcgctcggcgccccttcctgaggccagccacattagttttagccgatcatctgaccgagcgtctcctcgatttctccccacggattcgctcttgtcaagatctggcacatccacaatcctcttcttctccaccaccatcaagtcaaccgaaatcttactactagcttccgcccgcggatttgatttggatggatttttttttctttttatttgtttttggggtctgcttctcgttcatcgtttgagctggtgatgtggtgccaaggatgagcaaatcaatctgttcctcggtcacctcccatacccagcgagatggaaggaggattccggcagccattctttgcagctacgggtgagctcggatttgaatctctctctctcttccctgtgctcacccatgccccggctgccacattatttattaccaactcgcacacatgctttcctttcccatttcgaaataaatctcaatctttcacctcaaatttgattctttttactacattttttttaggattttggcattcttcttgaggaagtaaaaacattattttggagaaaaaacatttttttgttttgcttttctttcactgccttgaattagtactgacgcgtgggacccatgtgtaagtcaggtggcagcgtggcacccctattgggatgagctggcacagttacacgcctgggagatcgatcaccaggtgccctttcgttacatgcgccgcggctcatctcaatcgtggcttgtgtacatcagggcttcacattttttatttctttctttctttctgcttgttcatcggtatcaggaatgctggaaaaaaacagttgatactgatgcctccttgagcagaaattttggggcaagttagagcagtgaacaatctttgaactccagattggacattgtttgtttgagcaaaactttggatggttccgatttggaagaagtggaattcatgcaattatttaaagatgcttggtattcatgcagcatggtgtaattgttccaatatgtttgctgttcgtttcatgagttgattgatgatgccccagtgaagataaagtttcggtccgaagatgatttggattgtctggttttagcttcaagccttcttgtcatctaactttgataattggatggcttgtggctaaaaccatcactgctaagaatcatcagtgatggccaataatagctatgagatctgaggggtaaaactgccacagtacaatatatgcgttctttggagttatgttttatttggagttgccccacgaagataaaaattgtgtttggataattggatttgcagttagttttatcttcaagccatcctcttgaatttttacggtgtgtgttgagccaaaacgctaaatttgagctgtttacctggcacggtttacacgcctgggagaggaacaaccagggttcgcgtattggacaattgttactgtgtggtaaccaatattctttgacctagttatttagactttttaacaaaatgtatatattctttaataaaagcaattgagagtctgcaaagagcagcagcgcatatataacggaaagggcgctcgtctgcatcatttaaatccatgcacagcagcaacaccatagaactgtggtgattctccatagaactctttgagcgccggattggacgcttctgtgtgttgcttacaaccaactccggttattttgtctatacacatcagcaagaaggcccctacaaggctacaacggattgagatcctgtgtagtcgttactacctctgcaactttagctgtggctgtacgttttggtcgttggatcaatgaagcgagatctgtttgcaaagcacctctgacattttaagaagactagtaaccatgcacgtgcaatgcacgaaaaggctaaaattaattcaatcaaatatattgctttgtaaatttacaaatagaatagcattaaacatcattcatttgaagctacgcagatagacaaaccatattctttaatcaattgtacaaaatgcgaatctagcttatacaatgtacctaaccaaattaggaaacccacttcgagtgcagattcagtaccaaatgtgcaaaatttcaagtacatgaccaattcatctagagaatgaacatccaatacccaactctaaagtataaaccatcagaagcaaatgctgagaaagaaaaagtgtagacaaagcttaaaccgtcaaaaatcagacaccatggtctctatggaccatgtgatcgtcaatgggggatgaccatcattgatgggtcaaggttgattccgccggcgcctaggatctgagcaggcattcagattatcacttgggagcttgatgcgtacatgggggacatggtcacagtgttccttctgtcctgccctgattcccttaaagcaaaagaaaccagcaaaatgacatgtatacagtccaaactgctatcgtcagaaaaagaattgagatccgaaaatttagaaatgattgcagcttcaatacagtaacatgaagatatctgaacctcatcaccaaagtttatcaaaaaaaacaaaaccctaattcatgtatggccctaatatcactgtaccagcaaaatggctagtggtttcactggagcacaagcaccttttgataaaatcacaatctatagatttggaaagatcgaaatgtatgatgcagctagagataaaaaatttcaccagaactgtataacaaaaggaacataagtaaaaccacaatctaagacaagcaaattaaacagacctcatccaccatccatttgaagagaggagatcaaggctatggctatggcaggtcccatcttaaagataactgccaaagcctgcactctctgaagtagagatatgtggtattctttccagaaaagagataaaaactgaactgaacacatgcactgtgaatttcaatggacagatagaggaccctttccaagtgaaattaataacaatattatagcccgcttgcataagattacctgaagccactctaaatatctttttcttgccaaatctgaaggcagaactctatgacttaatatatgacatgtttctcctgtgtgggcctaatgtaatgcatatgcctagtactgaatggaatggaatagatttaatagaaataatctatatatgaaagaaggtgctgattatggaagtgttgaatgcatgggaactgggagcaattgatcatcttactccagctaaattttaaaaaacataaatatatttatagatgaaagaggggaaaacatatatacaaggacaaaaactgaccagatcttcatgtagttgatatggttttatccaagggattagacaactgctgcttatgttgtgtgaactacacaaatcagctacctcttcttcaggaaagtatactcatacatcaactgcaacacatgcagtatctgcaatcgtgttaataaatgcatcaccgagaaaatcatatgcctgtaaaaagcaataaatggtcagcatagtcaaaaattcttatcaaggcaaaacactataacaaacatatagtgggcagactatttgtacatgttgacctacgcctccacaccatgccgcctcatatcaaaaaatgtattcatttgtacgacaattgcgcactacattttttggaacatcaataagatattaatattaccctcgttcaattcatatccatgcaaacaataaagaatctctgcatctctattttaacaaaatgattagctgcttgctcatcttgttcttgtaataaatagattatgaaataggatgaaattcatcatattctgtctgagagaggcaatagagaactgaggatatacaaaatgacatgaacatattaatgtagattgcagcactaaaacacactatatctaatgttatggctgtcaataaccacccaacatgtgccttatggaattggaagaaatgaaccaatttgagatcaaatcagtggtggaacaaaattagttgatcctaaacagttataggaacaaaactatatataaattattacttctagaagcaaccaaatatactttttgaaacagagtcatgccattttgccaaaaaagtgtgctttagtagcccttcaaaaatatttttttcacttgtccagtatgcatcatgttagctgaaaagtgttcattactaacattgaataatattgaaagcactattcaaaaaaggttaatcttttaagtgaggatggattatagttggactaaccatcttactttgtcattttgatacagtgtagtttaattgttgttgatctactgtgtcaaatatagtgcatgcgacatcatgtaaaaaatacagctttaccctctgagttgtcattcaggtaacttctcatatatttattctattaggatgactttcaactttacgtgatgcatcaacatataataattgttatcatgaagataaaacatggcagaatatgcattcagcagaacttacctagaagtatattatactggagaggtagatggcatgagggatgagtgttatccagctgggattgattcgcagccaccggggagagattggagaggcgatgcggcgtgcgatggtggtggaggtggtcgaaggggagagagcggaacggagatgcggagggaggcgtctgctttgaagctgctcaatcaatttatccctagacgattcagaggaaccaaaataatcaattgtaaactgaaatgagattaaaaaaaacagtgcacatggaaacacacaaacatatccaaggagtgtatgctgtagcagaaaaagacagatttataacaatggcatcaacatgtactgacaaacatccacatatgaaatgtattatccataatttcaaattacctcaatactgtatagatggaaccgcaagaaagcatgcattttttcccgtaagagacagatgaactattcagatatatagggaggatttaacactattagacagtgaaaccaaacaatgtccatcagctttaagttaggttggacaccataccaggtagaggtgcacgggagggggaaagcgggtggctcccgtcgatctggcggtggcgcaggtggagcggcggcgcaaccgacggctccctatgacagcgcaggtcgagcggctggcggctcccgtcgatccggcagctgcgcagccgatggaggaggtcgatcggtggttcccggcgatggcgcaggtggagcggccaatggatcccatcgatccggcggtggcgtaggttgagcaacagcgcagccgatggaggaggtcagagtgggtaaaatttcaggtcaacgtgtccctcatctgccaagcaaaagcataaaaacttgatgtataatataagcagtaaaactaaaacaaagatagaaagcaatatgaaccatgagtaggtgtagataacagagcaacctagtcagattttctatttgaatttggttcagataaatgcaaattataaataattaagggaggcagagctgaggcaagctttagctaacaggatatttctacttgattgcaacgtcagtatccctgcgaagaaatgctcagcatcgatagtgagctgtgcagcccagcatctcagaaatcagggtacattcaatttcatccaatggaaaattgcatcagttgttcggtatttacagccgaacctaagatttggaaataatagtctcaatctcctatgggaaaaatcagttactctatttgcttcaagtgactctagcatcggtctcactgaaatcaacaaggcacggattgttcaagcataataaaaccaaagctactgcaagaagatagattgaaactgaatgggagagacgatgaaatctagggtttgggcgacaaacacacacctcgagaacagacgaatcgaaagttgtcttctcgttctcaatcctgctcctgtgaggaaaaaaaattgaacacttgattaaaagaaagcaaggcaggaggcgcctcgcccactgcaacctgctcgggcggccgacggcaagatgacactacggcaagggcatccgcggcggcgcatgaggggaggagaggaatagattagggtttagggagggggttggcgatgcttgagagaggaataagatacctgggtggggcgtcggcggcggaggcggaggcggtggacagggaggaatgtttgtgacggcgaccacggtggcgccgatctggctgaggacagatgcgacgacggcggaggggtggtggcgtaggaggcggcggcgggaagcggcgggcgcataggaggcggcgatgggtggcgtaggaggcggctccggcgggagacggcggccacaggcggatccgaggcggcgacggggtagggtgagcggctccggcgggcgggcgtgcggcggcggcgccgacggaccaggcgcgtgattagcgttgcggaggacgcgtgcgaaggagaaggggaggcagttttttttgcgaaatggaagcagttttttttttggcgaaatttttttccgtgcgcgacgtggtctgtgcggtttctttgtccggatgacaggtgggtcccacgtgatagcggatctgcaggattgctggattgtggatgagctcgtactttttatattagtatagataaatcaggagagagaagagcagcggactactccctccgtccaaaaaaaaaggtaaaccctgggtttgcgtgtccaactttgactgcccgtcttatatgaaatttttttataattcgtatttttattgttgctagatgataaaacatgattaatactttgtgtgtgacttgtctttttaattttttttataattttttcaaataagacggatggttaaacattgggcacggaaaccagggtttgtctttttttgggacggagggagtacatatttgtagtcagctgtagcacagactctaagacgtagtgtgtctatgataggtgggactagtattaatagtatagtatgtaattattgtatgaatgaactattagattggctatagatgaattggagctattagttagctatactattgaacttgctctaagagccactgttttctttatttggggaataagagcaaggtcaatagtatagtccacggttggctccaaaaacatccacatcagcaatacaatggtttttcgcgcctaactttgatcattcgtcttatttaaaaaaaattaaaaaaattaaaaatataagtcacgagtaaagtattattcatggttttatcatctaataacaacaaaaatgctaattataaaaaaattcaaataagacggacgatcaaagttaggcgcggaaacttgtgactgcacttattttgggacggaggtagtattatttttcaatattttaatctaactttttctgctgctcacgataaattagtcgcccactttcactctctctccactaatttcttctccagatcattacttttgccaccgtgtacagattatcgcccacttaaaagacctattttacctgctctaagcgaaatggcatatttgcaaatgaaaaatatttcgcgaataaaacttgtatatatgtgtttttagcgatctaaaaataaagaggttgaaaaataaattttgataaaagaagatcccaaaattaactttaaatttaaggttgaaaaatttaaattttggcagataagtataagagcaggcacaatagcatactataagctagctataaacacatgtcgaggagataaaatatgagagaggagacagctgcagcacagactccaagacacaatgtgtgtatgatagataagaccatatattaataatgcaatatatgtttataggtaactgactattaaattaactatatatgatttggagacggtagttggctatactattaaatttgctcaagggaaaagatgagaatataatagtgtggcgtcatggcctgtaacgtctgggcggggcggtctcgcgtggaggggccgtgacagactttgatctttgcggtctctggggacgtggaacgggccggcgtgacacggttgatgatgctcgaggggctaagagcaggaacagactattagccagctataaacatattttaatgagataaacgatgagagagaagagcaacgggctatagatttgtagccagctgcagcacggactccaagacgcaatgtgtgtatgacaggcgggaccatatattaatagtatagtaagcaactattgtataaattggctattagattggctatagataaattggagctagtagtgggctatactattgaacttgctctaatggtgttggagctgatgggcgatgaccggacgtggctcatctcaaaggtgttcgttgtgcgcttgtgctcgtcggcatggactgcagcgtcgtggaggtccgtgcgtggacgcatcgtgattgcctcgagtgcctcgtcttcctccgtgacgaggaggcggacaccgagaggatggcaggcggacctcttaacgcggtcgcatgcgaaaattgatcttcgtatgcatgcgtagtaggaggctcgcttgcgaagatatatcttcgcgcgtggtttggtccgtttgctcgcgaaaatggttatcttcacatacacctgggggcagatggcccagccaaccgcacgcgaaagctcttttcggccgtctgggaaaaccctttctgtagtagtgatgcatcaaggtctacctcaacaacctcctctgtggcgactacaacggcgccgtggccattgtccccgctgccaccgtcgcatacgctgagcactgcctccactagctcatatcggctgacggctaccaagaagagcgcgcggtggtgtccccgaaccctctcgtgtccgtacagagctagatgaagcgtggctacttgtggacggtctcacggtggggagcgtgacaccaccgcccatctcgctggcccactgcgcgacaccgccaccgatctcacgtgtctacgcagcgaaatcgctgccctatcatgccagtgtggagtgaggctgtgttgcgttgccatccccgagaccatgggaccactgttctccacctcccgctccaaactccttcgcgctactgaagcgtgagaccgcggaccatgtttgccacttcgtgagactagcgcacgag

SEQ ID NO: 68128 - DNA, 12062 bp, Oryza sativa
aatttcatatggtatatttctaagaaaaaaataagataaacaatattttcccttttttattcaaggagaagccaaattacactcgatacccattgtcctcatagttacagcgtagtgttgttgcccctcctctatatttaaaaggtagaataggttacatggtttgactctagctctactgtcatataccataaataaaactctaagtccacttgtaacaaaatatagaactcatgtatttgatattttttaaaacaaacttcagcttagcgaatataccatcacgcctactcttatctttatagctgggtttaaaaccaaatctagtatcttatctcgaaaagtacttgatacaaggtttaggttgttttggactaatggattgggaacctatacccagctcgcaaatggagcaatagattagcggacgatttattaattaagtactcccttcgtttcagattataagatgactttaacttcaaattgctttaagtttgaccatgtttatagaaaaaaaatagtgatgtttttgacccaagataaatttattataaaaatttatttaattattagtttactaaaactaatttggtaatataaatattactccctccgtttcatgtaagtcattttaacatttcctatattcatattaatgttaataaatatagacatatatgaatatggtaaatgctagaattacttacattgtgaaacggaggaagtactatagttatctataaacttagttaaacttgaagcagttttaattttgaccagtcaaaacatcttataaccggaaacagatggagtattagctaaatacttttaaaatggattagtacgattttttaaagcaattttcctatattttttttaataaaaacacaccgtttaacgttcaagaagaatgcgcgtatgtgaaaaataaggaaggagaagttaggaacatgcatatacgaactcgggcttactagaagatttatcataatggccacatcatttctactgagttatagagctcaacgtaatgcagatgctgatatcccttttttaaagtctatatcagcaagctagttcccaaaccggtcagcattggagtgaatagtttggaggcctttgactgatgttcaagaagaatgcttcctaagctacgtttacaatgttgtcctgagatttttggcttaaaaagattgtgccggtgaaacactatttctttttagactttgcttccgttaagagagtagtagtgtagtaccaccaccaccaatttccgatgtttgtaaccttgccttctttttccatttggttatgcgtacccacacaactttggtttctgtttgtcattgttcttgagctatactggtaggtacaataggttcgtatgaagtaaagattgtttagtactcctacgtgaaccagttctattaaagtctatttggcacaacttcatattcgagatttcttggagctaagtattcctagctttacaaatctatgtatccggatatatgattatgttgataatattcgaatgaatcagtttgtttttttacttttaaagaaatataaaattttaaatcaatctaatttaatttattaggtaaggacccgcttggtagagttttaacttctaaatttaattacaggagttagatatatagagtgaagttgtgaagctatctaaacttgtacatttatatagtttactttgtaagaacgctctacctatatatctgttgaaaatataaataaagttacaaagttctgtcgtcatatcattttctatatatctgttgaaaatataaataaagttacgaagttctatcgtcatatcatttccttcaagagaagacgttgaaaattttggggagaatattccaaaattcaataattaccaaagagcatcgaatatggtaaatattatctcaaataatccaaaccagcatgaatgcagaaggcaacaagtcacaatatgctcaaggtaaaatccaagttctcaggaataaatagagcgtccgtgatcaaaagaagacatttaactctctgaagaacccgtgatgccacaatatgataaaaataagagtgaaaattgagctccctctccagcttctataaaagggaaagctggcaaagccagaatgacacagagaggcagcaaccctcactccctcagccagagtcccagaagccactctctagctcgtaatctgttaagagtccaccttgctagtatattggagaaatgattgtaatataatttgtgtaaggtaagcaaactttgtttatatcatccctaggggtttccgaaagggaaaaccatatgtatgttattttgtggtaatgtagtagttttattaagttttctttgctaagcccttgttctatttatgtgagtttacataaaaataacctgtagggtccttaccgtagaactaagctactacattaccacaaaatagcatacataaggttttctctttcaagaacccgagagatggtataaacaaagtttgcttaccttacataaattatattacaatcctagctccaatatactagcaaggcgggctcttaaattactactactagagctagagagtgacttctgggactctatcagagggctgctccacttcgtgtccttctggcttcgccagcttctccttttatagatgccagagagagagagagagcgcgcgcgcgctcaatcttcactctatagttatatgtcttcttttgatcacggggcgctctgtttcttcccgataacttggattttaccttgagcatattgtgacttgttgccttctgcattcatgctggtttggactatttgagacaatatttaccatattcgatgctttttggtaattattgaattttggaatattcttcccaaattttttaacgtcttctcttgaaggaaatgatatgacgacagaccttcgtaaccttatttatattttcaacagatatgtggtagcttcacaaatctacgtatatggatatataattatattgataatatttgaatgaatcattttgctctttactacttttaaaagaaatataaaattttaaatgactctaatttaacttattaggtttaaagacctgtttggtagagcttcaactcctaaatttattatagaagttgagtcaagagtgaagttgtgaaacaacttaaatctagctcaaactctatagtttgttttgtaagaacgttccacctattttcaatcttattttaggtggaggttaaattatttggctgaactccaactctagaagaggtggagttgaaggttaaccactgccagacctctaaatcaatgtgcatctgaaatagcagaacctgtaaacaggttccaaaaggaggtccgtaaacatggttaacgtccgcgcagcccaatattaattgatccggaacgggattcgcatttgcattacgtgtaagttgggccgggcttggtcaggatgaccgatacgggcctagatgggcctgctgctgctgctgcctgctccccactccgctgcctctgcggcgggcggcggtcctcctcctccgcgccggcgtccaccgcccggccgccggcaggccagtcccccgtccgtctcctccattgaaaaccggaacccaggttggaaggagagagagagagagagagagagccagcaggcaagaggaagttgcccggaaattttcggtaagctctgctctccgctccctttctgcccatgccctcttcctgttcgtgcttatgtctgcttgaatttagtagtgctataattatactgtactagtgtactggttctaataaacctttggagagagttcctcttgctcactgatgcttactagtcagtctagtccatagatttgctaggaagctcccaagaaagaagggagccggatcggtaaagaatgcagtattcgcttggatctacccgtttaattaggtagtctattccatcactataagcccactaagtggggcttgtcacgacctcacgacacatcacaccactcagttcttggtcaatgatcggcaaaacagaagaaatttcatcctggagtcgctttcgtcggttgggctagtgttgactccagagaaaaaatacaattcatgcccagattactactccaattccagtccagctccttatctttcgttttattgctgaattgccagctacaagatttcctagcagctacttcaatacttttgctaacccccgttctcaattctcaccgtctctcctaccatggccttggctttcgccggcaaatcggtggctgtgtcggccatctccatgattgtccgcaagtctttcgattaccttgagaagtatgcgaaggcggaggggatgaagtcggtgcaggagcggcttgagaggactctcccacaagtccaagttgtctttgatgcaattgatatggagaggataagggatcagagcgaggcgcttgatgcctggctttggcagctcagggatgccgtcgaggaggcagaggatgtgctcgatgaggtggagtactacaagcttgagaaaaaggtgaaaactagaggtaacaaggtgagcagctctctgtacaagtgcaagagggtggttgttcagcaattcaatagtacttttaaggctggaacttttaagagattgttggatgccatcagaaaacttgatgaaattgttgttggtgtggagcgttttgttctactcgtggaccggctggattcttgtacttcaaggcacgtatgtcatcaggaggttagtaatcctcgtgagactagctccttcagtgttgatgaaattgtaattggccgtgatactgagagggttaagattgttgaatggctgattgaacaagacaacgttcatgaccatgatgtttgtgctgtaaatgctttttctatagttggcataggtggcatgggcaagaccacgctagcacaggcaatctacaatgatcaaagagtgaagcagtgctttgatcaggctatgtggatttgtgtgtccaatgactttgatgtccctgctctgatgaaaaagattatacaagaaatcactagagaaggtactaatgttactaatttcaatacacttcaagaaatcgtcagagagaatctgaaatccaagaagttccttcttgtatttgatgatgtatggaatgatgagagaaggcctgactgggagaaactagtagctcctctgaaatttggtcaaaagggaagcaaaatcttattgacaacccggatggaatcagtggtagatattgttgaaagggtactaggaggaagaaccaagtctctacgattggagggactgcatgacaaagatcttttagcaatttttaacaggcatgcttttttcgaagtaaatcctgatgattatttcaacctacaggagataggcaagaaaattactaggaaattgagtggatgcccattagcagcaaagatcatgggtgggctgttgaacaactctctggatagcatatactggaacagaatgcttagagaaaatatctctaatattgagcataatagtgaaggcattatgaaaattttaagattaagttatcatcatctggccccacatctacaggcttgcttcagatattgtggcatgttccgagaagattactggtttcgaaaggatgagctgattaacttttggatgggttcaggactaattcagctatctgcaaatgaaaaccagaggccagaggatataggagagttttatttgggtatactaacaaagaagtctttctttgaactgcagttaaacaaatccactaatttgtatgaaggctatggtgagtgtactaatgaacactatgttatgcatgatttattgcatgaacttgcacgtacggtttccagaaaggagtgcatgaggatttctagtgatgaatatggcagtattccgagaacagttcggcatgcagcaattagcatagtaaatcatgtagtgatcacagatttctcttcgcttaagaacttgcggaccctcctcatatcatttgacaaaacaatacatgaaagggatcaatggattgtactgaaaaaaatgctgaagtcagcaacaaaactgcgtgttgtgcacatacagaattcgtcgcttttcaagctgcctgacaaatttggtaatttaatgcaccttcgctatctgtatcactcggaatcgcagaagaaagtggggaaatattccttttggtgtccatgttctatatacaaattatatcatcttcaaatgatacagttgaatagatgtctgttggtatcctggcgattgggaaatctaattagtctgagacatatatacttttctggtactatatatggattctccccttacattgggcatttgacttcccttcaagacctacatgaagttaatgtcccacctaagtgtggtttcatagcaagcgagctcatggatctgaaagatctccgctatttgtgtatccgttgtcttgagaatgtcaatgcagacgaagctactttggctaagctgggtgaaaaggaaaatctcattatgttgtcactcacttggaaaaacagccaacaggaatcagacacagaggaacgagtactgaataaccttcaacctcacatgaacctcaccaagttaaagatcaaaggatataacggttccagatctccatgttggttgggaaacaccactatcatcaatttgacatatctctatatctctaattgcagttactggcagcatcttccacctctaggcgaacttccttccctgaaatatctgtacttaatctgcttgaactcagtgaaaagaatagatagttccttctacgggtgtgagcgaccttttggcttcccatctcttgagtatctatttattgaacatcttccagcactagaagagtgggttgaaatggaaggcgagcatctgtttccccggcttaaggcactagtcgtcagacactgcaaagaattgagaaatgtaccaacactaccatccactgttaattatcttgaaatggatagtgttggtttgactactcttcatgaaccctatgtgcctaatgaaaatgcagaaccccaaaagccatcactctccaggctgaagatctgtcactgcccatacctggaaacacttgagcaacttaaccagtttctttctctggaggaactacatattgaacattgtgaaaatcttgttcaattgccgatggatcacttacagatgctctcctttctaaaacacatgacagtgttgggatgcccaaagttaatggtccctccggcaaccatcaggttgccgttgccaacgaaaaaacttcatgttgggtcatgtggtacttatgagacttgtctggttaactcattgtgtggtcttacttctcttactactttgatgctatatggttgtgatatagcagcacttccacctgttgaagtgtgcaagagtttgatagcgctaagttgtttggaaatcgtaagctgccacgaacttgcggatttaaatggcatggaagagctaacatccctcacagagttgaaggtgattgggtgcaacaagcttgaagagcttcctgtcgtttcatctcagcggtttcaagcctctgaacacaaccaagttgtcactgcctgtacttcataccttaggaaacttaagagactgcaaattagcgatccatttgtcttgcaatgggccccactgagaagcgtcacctcagttacaaatatgaccatcaacagctgtagatgcttacctgaggagtggttgatgcaaaactgcaataatcttcaacgcattggagtgagggatgcttcccatctggaatttctgccctcaatcatggcaagcctcacctcccttgaatccttagagtttacaagagttatgttaatccagtcacttccagaacttccttcctccttgcggaggcttcaaatccttggttgtaacccggtattaatgcggcgatgtcgaaagagtagaggtcgtgattggcacaagattgcgcatatcccagatctgcggattgtagaagatataccatcgtcatattcatggaattcatacttgtaatttttctatatgcaagtcgtcccttctttttcctgagctggttcctgttttgtaggctaagctgatgtctttaaagtttaaccctaacttatttgccccttggtgtattttgacacatttgtaacatttaaggcattttcactgacgcctcctatttgatttgcatctagcaatatggaacagagtgttctgattatttccgtgggtttcgactatcctaccattttccttttgtgtttttgctgaagttttcttgggtatcggttaattcttcgttcttacagtcctgattgcctgaacaactcacagaaagtatgatgttgatgactacctgatggttttctgtgatcaaagctaatgattgatagccaccacttatagttaggtctttaaataattagattccttaaagctgtcaccaggaacttcggatctgcttttctggggatcaaaggaatcatgtctgaattccaatcagaggccagtcacctgatcgatcaagttcacttcttgtatacataggtttttggcattgggagtgctttgaattctacttccatgctctactgttgcttatgcttagatcactgtattcgattgtctaaatgcaacttgcatgaccggtatcgatcaatccttaattaaacttcctgtgacaaaacaaagccccagagcatcagaggttcttgctaattaatctgctaggggttcaagaaccggaaactaaatatgtactcgtggtttttcgttgataaatcatgagtgccgtcatcaaagtacaaggtgagagtcaaagtgggggtgttgttgacatttcggtttatttagatgaatttacatggtacaaactagaaaatgtgtttcttttgagactagaataatatcccagcctctacacctggagatacacatggaaatcaatacttaagttttacaaggctttcatgctgagcagaataataaaagaaatgtaaagcaatatttttgtagcatttgatgaattaataaatttaagcctgtgcacaacctaccatttgacccagttctttttgtctttattaaatgtatgaatggttgatagattatcagtttttctttttcctaatatatgaggatacaataggacgacgaacacagcttacgaggtttggagtgttcaatgcttctcatctggtgtttctaccctcaatcatggcaagcttcacctccctagaatccttacaatttgcagaagccatgttaattcagtcacttccagaattgccatcttccttacgggctctacagatctttggttgtcaggagagcaaaggccatgactggcacaagattgcacatttcccagatctgcggattgagcaagattctgcatcacagtgttcatatacatgggttaagggcccctttgatttgtaggaaaagtgttggaaatttgaaggattttaatcctatggaaaaaattcctatgataacctttgaaacaaaggattgaatcctatactatcctttaaaattcctatggaatgactaatcctatagagattttggagaaaagttagcaagagttccaacctcttggaaaaattcctttgagtctatctctctcatccgattcctgcgttttttcctgtggtccaatcaaacggtcaatcctgtgtttttcctgtattttccaatcctctgtttttgcactgcattcctgtaagaatcctatgtttttcctattctttcgtttttccattcctacgattcaaagggccctaatagttctattttttttccccttcgatcatgatgctgtaaaaccctgtcctgaatgtaagtcctcccttctttttatttagttcattactgtacacagctatttagcacaaaacattattgaacagatcaagcattctggttattcacttagtttttttttgaacgactcgcacgagacggtgcgaagttctattgatagagcaagaaaaaaatacaagattacaaccctggagggtcgtaaccaggaaaaaggaaaaaatataccaccacccacgcaccgacagcgccaacacacaagaccgggagaaggctaacaccagactggccgctgctaagcgtgaccgactgctgctagaccaacaaaggaacacagacgagatcgcccaaaaaaatcactctcacaaccaacacaaagccaactcttagagcgtgcttgcaccaatccatcgagaggcttcggctaggggatgccaaaacgatgtcttcaagaagagaagcgacggtaaaccgccgccgccgtccgtcggggctcacaggagccaggattgggctttcgcccgacaaccacccttgagggatgagacagcacgacaacgccctcaagagggagaattaaccatcgttgtcggcccggccatggccgggctgagttttcacccgctgctcaccacctgcgaatccacggctgatgcaccaatgctcccaccacccctcaacctctgccgacatgtgggacccctgcaccggcgccccccgccggccagccttcgagcgccgaagaccgcaccacatccaccaacagctcctcctcgtaccgaggtcgcctcctccaccgccggcagcgcctctcgcgccaagccggcctcctccaccggatgcgcctctcgtaccaatccggcctccctccatcggccacgcctctcgcgccaagccggcctccatctccgctgtccgcgcctctcgcgccgagccggcctccgctgccatcggctacgcctctctacgccaagccggtctccgacccatcctccaaacgctgccgcgccggccagatgcagccgtctcctacgccctcggctagccgtccgaggccgccatgcatcttcccaccttaaccacggtggtcaccaccgtgcctcctcccaccacagccacggtcgccaccatgcctccacattcacggccgccgcaagccgaccgccgtcgccgctgctgaccttatcattcctgaactgctctcataaatttttttcccctcccataaccagataaaaacccatcgagatgacttctgaccgctgtaggtcatgcaagtgaagttgctgctgcttcaactcatcatcaattcatcaccaccaagaggaacttggatggatgcttctcgggggtgtaagggcattattcagggaagtccatggtttctagcgaagagactcctctaacgcactgtcctctgatatgcggcacgctagtcatgagcacatatgtcagccacttaaagttagagagcagtaagttagaggatctatttctggttgctagagccttttaatgctggtacttcagggcccaactcttgaggatgggttatggatttattcagtgaggattgcagttttattccacaacatcaaatcctatatccctgcaaagacacaagttggggaagcgctctctcaacaagtcagcagcagatgagatgcctgtatttatagtgaattgatcgtcttatccgtggcgcatcaccagatgatatttctactctctccgttttaaaatatagcggcataataataggtagctatattttaggacggatgaagtagctatttcacgcttctgtcgttcacaagccgatatgtcatactactaccacttcatgtctgatcagtggtcacaaggctcagactctcggagtcctgatcagatgcagttatatttttattttcagaaattgacactggataagcattttgtatgtatactctacttctttactctccttcagctcatgcttagttttattgtaccgagtgggcgcaacctgcatgatcactgtcaaatgtggatctccctgtaccaagagcccaagaccacagatcatgtttatttaccaaatcatcaaagctgatgttcctgttacatgtacctttagtaaatcgtgtatactccctccgcttcatattttaagattttctaacattgtccacattcatata

SEQ ID NO: 68129 - DNA, 3638 bp, Oryza sativa
ttacattgtgaaacggaggaagtagatgttaatgaatctatacacatatatgtccagattcgttaacatctatatgaatgtggataattctaaaaagtcttataatataaaacggtgaaagtagttcttttatatatataatgagaagaatttcattaaaaagatgaaattacagccttaatattatggattatggttgagaagggcacgataaatgtgatataggagtatatcaaagtccatggcggggggaaaaatgtgagtgcaagttagcagaagtgtatttacagttggagtatttactacaatcaagttagttaatccgtcgatgaaaaaaaaatatatacatggacagacacattgtggttatacttgtcaggtgagattcttccgatataattattgaagaaagctcaaatagtatacgaagaactcgaagctaagcaactgtgaagagaaattaagtagctacaattaggttataaataatttgatttctactctaactgtgacgtggggatgtagctcagatggtagagcgctcgcttagcatgcgagaggtacggggatcgataccccgcatctccatttttttatttttttttagaattctactttttctaaaattgaccctttaattttgtatttatatttcttttataatgtatatgcattctgcattttatttttcctttacattttttcttatataatgtaagttatgcattctgcattttcttttgtcttttttttttcttataagtggttggaaaattgacatttgaggatgaaaagctttaggcatgcgcatgcagccctcaatctttaaacttttgattcacccggaatgaagaatgaaaagcatcacaattaacacactacgcatcacaattaacacaagtatttttccagacaggtgaaatacatttttagaggcagataggtcctctatgaaaacgattgtgcaaatagttatttccataggtgaagacaaagccgtatgtaaaaaaaaaaaatctattgcggtagtgacatgtatcaggcatcattatcgcggtagtattgtcataactccgcctataaaaaaaattatacatattgatattcacatatatgttgtgtgtattataatgatatgatgttgaatactagacgcatgcgtaagactaaaaataaggaacccttgtcaatgaatatatatatccatgttcagattaattgttgtgcccgtacaataattataagctttttttccactcacaggctcacagcctcaaaagaaacacataaattaaggaagcgaataaatatttaagggatgtccaatagacactgattaataatcaccaagtaattcaattcatcagctagtatatgattaagctgtagcactacatatttctaaatttgtctagcagcaactcataaaagaacatcaaattctcctgatatgtaatgttgatagagtagcatgcagctgtgcaccgatatttctccacgcatgcctgtcacatgggagagtaactagataggttagtgtgttttggcacataaaaataaaattagagtttatttcattatgaaaaaaaaccgccccctcgtactgcatggtccataaaaacatccacaatgcaatgaaaaaacaagtaatagacattaaagtatttctaggacctagtaatcaatattgtggaagtaggtagtaagtttatgacctaggaataaaaaaaattaaaatctctctctctctctctcttttgtcttctctcttcaatattaggatttgcttgtactttatgctgagttggataaaaaaacaactaaggccaggtttagttcccaaaatttttccaccgaaaacatcacatcgaatctttggacacatgcatggagcattaaatatagataaaaaaattaattgcacagtttacatggaaatcgtgagacgaatcttttgagcctaattagtccatgattagccataagtgctacagtaaccacatgtgctaatgacggcttaattaggctcaaaagattcgtctcgcggtttacaggcgagttataaaattagttttttcattcgtatccaaaaaccccttccaacatccagtcaaacatctgatgtgacctaaaaaggtaaaaaaaattataatgggacccacattacaaaaacctactaccttagccctgctacttaccccctccgtcccaaaaaaaaaaaaaaacccaatcctagcaacgaacctggacacatgcgtgtccatattcattgctatgattggattctttttgggacggagtagtattgcctagttaggtaacatatattaggttgccctaagagcagatataataaggctaactcatcagctccaaaaattactgtcatcttattcctatgtggagggagagaagaaagcggacgactaattcttcgccgggcgttaacacaaattttgatgcactaccggcgttaacacaatttttgatgcactaccgcccatagcctaggttgtaaaagacacggtttgtgagatccacacaaatcaatcccatgtgatctgcgatctcccgttcttcgatccccttacatagactttcatcgagcgagtcacttgctgccgatttccccaccggcgactgcgacggtttctcttccgcccttgcgccatcccttctttgcgcgcttcctttttcctcccaatgtgcgcgaaaggttccgccacccctaaaattgccccctccccaattcccgccgcaaacctagttccccaccaccaaaagccatatctcaccggacgaagagaggtttgcgccgcctccttgtatcatcgcgagctcatctagtcctccagatattcctacgttgtcggaagcgctatatccgtatggtggtccttgattcccactgccagcttggtttgcttctccgtgatcacaagccatgctggagtttatttccatcatctatgatttcatcgtttcctttttattattttgtttgagcatcatgatatatttatccatgactatattttaggtggatgctaatgttctagatggtgatcaacatggtatgcagctagtcagtgaagatcaagaagtttaatctcattttagtagtcctttttgttaaatgttacttcctccgtttcatattataagatatatattgccaatagaacctatgtcgaatgttatcagtagatcaatgtcctttttgcacaatgaccgagtgctgctgcaccaaaatggtggaatggccaaaagaggagtggcagaattaatctcatagttgccatgctcatgcaaatattaaatgtctcaatgtcttatattgcagtcagcttatagctagcattttgtatgaattgactctaagttagctcttaatgatatggataaattttagagctagttattgactatatcattgaccttgctctaaggacgactgcatatgttttcatgatgcctcactttatatatactacatggagccatgcttaattgaccatttgaaaaagtatttctagatacggtctatataggctttttgattgattatgcatagtggatcattcgaatacgagtagtataaccagtcatgtgactagcatatacccctatgttgataa

SEQ ID NO: 68130 - DNA, 23130 bp, Oryza sativa
tactccatgtgtcccataatataagagatttgggtgaatgcgatacatcatgtctagattcatcgtattaggatgtgtcacatccataaaaaaatctcttatattatgagacagaggaagtatacaaaattagagaccgtacccatatcgatcgtaaacaatttttttctaaaaaaggtaatcagagtgaaattaattatgtatacaacgacctacctccctagatcgagatccatggcgatcgacagtgcatgcagctagctaggttttggccgtcggttcagctccggcggcggcggcggagagcgcggcgagggcgtcgtccatgagggcgaggtagttggcgcgcatggcctcgaactcccacccctccatctcctccacggccgcctccacccgccgccgctcctcctcctccctccgccgccgattccgccggtacgccgacacgccggccaccaccccggccgccgcgcacaggaagcacagcagctcgttgctcgggctatcccccttccccatcgctcgccgtcgatcgatcgtcgtcggcaattaataatgcaagctcgatcgatcgatctagggtttatctctctctcttgttttggttgtggaaagagcaaaagtatatattcgtgatttcgtctatatatattcgatcacgtgcacgaagtcatgcaatgcctagatggggcacgtttggcggctaaactaaagggctttctgttattcctagcaaaagggggaaaaaaaggacttctgttttggtggttccgtgatctaatctacgtttaaaccggacgattagacttttttttatataaaaaaattatacgatagagtcccctaacggttgggcgggttggcaggattggtcctgcgtgttcgctggctctggcttcagcgctcagggcacccctactgggatggcctgaagctcaagtcgagcagaccgtctctgacatgttcgcggcatccactttcttcgtgcgggaaaatggtgagtctatgctcttctggtctgaccaatggatcgacagctgctcggtggcgtccttggctccagatctcctcttcgttgtttcccagcatctccgaggttcgcgcacagttgcttctggtctgacgaacaactcctgggtctctgacatctgtggtgccctcactgtcccggtcatctcctagtttctccttatttgggatgcggtgcttcatgtacagctctcgccaggtgtcgaggatcgtctcgtttggcgttggatgtctgaccagcgctactcagcgcgttcggcataccaggctttcttccatggccagcattcctttgcctgtggtgatcttctctggcacgcaaaaggtcctgctaaatgcaggttcttcctttggtttgcattccagcagcgctgcgagatggctgatctcctccagaagcgtggcatcgatagtcactcagcctgccctttttgcgctcaggattttgagatggcgaaccacatcctcctcgaatgtgtgtttgctcggcaggtctggctccatgtgctgtcgcctcctggctgggctgccctctctccccccgtggcagctggttccaggactggtggtcttcctccagggcctgcttacctgagcatctccgagctggcttcgactccctggtgttcctggtctcttggtagctgtggaaggaataaaactctagggttttcgactatgcgctctcctcggtcttagtggttctggagtccatccacttagagggccatctgtggtctttagctggcattgccgcttttggggacttgttgggagtgtagagtggctcggccccttcccgctgcttggagtttgtatttagccaccgtagttttttaagctccagcttcttttttgcttttattttctccttccctttgcataagctggtctggctgattgcgtcgtgtaactataactcttttcttctaatatattgacgtgtaatccttttgcccgttcgcgaaaaagatagtcccctaacacatcttctaagagacatatacgtacattcttgatctcactaaaattcttatacgtaggcaccaaaatttaaaccctgatgggtggagtcacgtacctacgactccatcaccgcactattggttttcctcggattagacttattgatttttaaatattagtacttaagatagatatctatggttagttagcatggaaaccactacgaaaattgtccgtttaattgatatgcatatatctcacatggttttcttacaaagttaacaaaatgatagttttctttagaaatatagtataaacacaaacctttacaacatgcgcacattcacctatatgaatacacaccataccatacccgctatgagcatatttgtatttgtatgttacctacgactgaaagaataattagctgtatgcccgtaaaagcaagcaccagggttcaaatggattggtttcacaacaagaaactaaccagttaagttacactcactttgcaaaatgatcgttttttatctgtcacagcatataagacatatctctcctgccttagatttttttcgccaattaagtaaagctcactttgcaaaatgattgtttttagatctatgcacaatatatgagacatatctctcctccctctcttgccttagagactcagccctccaattccattatcagaaatgatgagttttctacaagatatctacgggttgagaaggcatagaatgagccttcaaaactagacatgaaaaaaaaccccaaatgatgagttggcatgcaatcctagccttcgctcacccatccctaaaaaaaaattgtggtaaggcggcaatacagggccaatacccctcttgctactaaaagtcataaacaatgtggtaaggcggcaagtatctccacagtaccacattggagattctgttccacgtctaagtgaatgcacaaacagcacaacatgcgtatcacttacacagttctttctaagtatactatagccacataagcccacaaagtatttttctacgaatttgctagacctaattaataagaaataaacctctaaggaaaaaaaaagaaaacaaatgcaaatcgcaaatttaagaggtcgaaaaaataaaaatttcggaagcaacgcttgtggccattaactgaaaacatcaaagtgatcgatatattggtgatgcaaatgcgtgaagtaaatctcttcaaagtttccaagccaacaaattgcatcacagccgcctacgaaatccaacggaaattcaaatcaaattaattaataactagaacaaagatctgtaataatgcgcatgatggatcatatcaatcctactactcgatcttggcgagcttaattaattagctccagtctgcggcggcggcggcggccttcttgtgcgccgaccaccagtcgaccgccttgccgcggatctcccgcttgaggccctcgagccgcgccgccctcgcctcggcgacgtactgctccctccggcgcgccgcccgcctcttctcctcgcggtggccccgcgccacgagggcgcccagcctcgccaggtggtacagcaggaccccgccggcggcgaccgcgatcaccaccttctccagcgccggcgccgccgccggggccgccgccctgcaattcgccattaattagttaattggtagagctaatcgatctgtgttaattagttacgagttacgacgctaagctataattaactaacctcttcgtcgcacacacgtatataatgcggccgtaccgtattatccgttagtaattttcccgacttacggggcgtctcgtgttaaaagaggcatcgaatatatatattttaataatataattattttgtgttggaaatgctcgtatatttttctataaactttatcaaagtgacttaggctgagttcgtttggaggagttcccaacactcccctctaaaaaatgacgggtcagacatacaagtgctagcttgcttctgttagttctaaaaaaaaaaagcttgactctgttagagtaatttgaacagaatgggtggagggagcaatgacgacctaattacaaagtatgatttcttaattatatctctcaaatacaacttatagaggtgattgggaaagcacaaaatgtatacgtatggtgtggaatctgggggcaaagacagagagtagggattggagctctactccccagcctaaataccgattgaaattacactttgaaatttcaaaaaaaaaagagataaaaaaataaacttgtgtaaattacactaatcctgcccttggcttcatctgattttagctgtacaaatactggggcactaatatcatgcacacacaccgttgtttcgctctcactgggactcccgtcacctgcaggatcttcaagcccgcgagttgaatgtttcaagtcatagatttaggttggtatgggtacatttatgcacggctaatttttttcgatgttgacttcgtcaatcttaacataacgagagagctatatatatcttgagatattttaagttcgtcaacttgaaaagttactttctttagacgcacgttcatagtttaggaagcacaataaacgagggagttgcaaaaactaaatgaagttttaaacagagccatggatgatggaataaatattgtggctttaatttattaatttttaatttcgatgcagtgaacaccgtaaggatgcaggttcagactatactctgtaccattgtcacagtaaaacttcatgaacccaaccgggtaatattcatatgaaatgaatgaaaaactaagtttacacacgagatggtctttttttttggagcaatccaaagctaaacaatttaactgaactaataatcaaaaacgatgaatctgtattgaactgaacaacttcgagtggaaaagtaaaggattgatggtcttcgaatctcacgtagtagtcctttttagcatgtgtgtaggcgtcgtatacaccgagctgtgacacaatcaaattaaccgaagagaataaaacatcatgtcagggagtaaattaaaagaagaaattactaaaggatatatatgtgctccttctgttttatactagtataaatagttttgatatttttctaatcgaatttcttttaagtttaaagaagcttgtagaaaaatataaaatatattcaatatcatattaataagactaatttagtatttagatgttattatttttttataaacttgatcatacttaacaaagtttgagattataggagaaaaggcaataaaacctaacaaagtttgattggtaaaatagtcgaaacgaaatataatacgataaaacggaaaaagaggatcaaacttgatcgaagaaaaagttggtatattatctcgcttaatcaatcctcgatcgatctaaactcgatagggggtgcagtggctacgtaccttacatgatcagtccaagacctggttgaggatggccatctgcttggcgatggccatctcgacctcgccctcgtcctcgtcctccccgacgccgccgcggcggcggagctcgccggcgacgtcgtccatgaacctcgcggcctcctcgtcggcggccgcctgggagccgatgagcgcgaggtcgacgagccaggcggcgcagtacgacaccatcatggcggcgccgaagcagaggaacccgtcttccattgccctagctaattactccagctatatatctgccttttcttttttcctttctgtgtgaaaaaaaataaaagctagtactagtaattaacaataattgggtataaggcgccgtatgtaacaccggcctccctcagcttcacggtgcgtacgtgtgcatgacacgtacgtacgtttatacggaacccgtaggatgtacgtatgtacgactcatggaattaggtaacaaaccctaaagtaaatactagagggccctttaaatcaaaagaattatgaaggaatttcatagaattgaaatcctgtaggaaattttccaacgtagtcctttgatttaaaggattgaagttttccaaatcttacaaaattcctatggaatggcttattgcatataggttttggaggaaacttagccggaggtccaacctcttggtaagggcctccttgaatcacagaaatgaaaaaacggaggaataggaaaaacataggattctgacaggaatgcaagtgtaaaacagaggattgcaaaacacaggaaaagcataggaatgaccgtttgattggaccacaggaaaaacacaggaatttgaggagagataaagactcttctatgaggttctacctcttgttaaaattcctccaaaacttatataggaagatcaggcatctcataggaattttataggattccatagggttcattcctttattcaaagggctttgtaggaaaaattcctacaggaataaaattcctatgaatttcctttgaattaaaggggcccaaatcgtaggaatgaaaaaacggaggaataggaaaaacataggattctggcaggaatgtaagtgtaaaacagaggattgcgaaacacagaaaaaacataggaatgatcatttgattggaccacagaaaaaacacaggaatcggatgagagagatagactcaaaggatttttaccaagaggttagacctcttgctaaatttcctccaaaacctatatgcaataaaccattccataggaattttataggaataggaaaagttcaatcctttgaatcaaagggctacataggaaaatttcgtataggatttcaatcctatgaaattccttcataattcctttgattcaaaggggccctaagaatccttttgagtctatctctctcatccgattcctgtgtttttcttttggtccaatcaaacgatcattcctatgttttttttgtgttttacaattctctgttttacgcttatattcttgtcaaaatcatatgtttttcatattcctctgttttttcattcctacgattctaaggggccctctacttatgtttcccttgcccaagaaacaaagggtctaaaaatttaggtaccgtttgacatgatttcagattaaacgcggacgctcacacatacacacgcgtgcacatgtactttatccagtattatccatatacacacctccgagatattgtgccagcatatccgattagatcaccattgacatatcttgacattgtggtggcgtgagttgcgaacttacaacgattgtggtgacgtgatagtgtgaggtgtggacttacaacggacatgcagtatgagggctagttcggtgatgggggtggggggggggggggttattacttattaggtgatgaggaaggcatacaagaaagacggattatgtctttagataaggtattggcaggaaacaatatgtttgttgtatgatattgttattagttaaaaaaagtatttgcaaaagaacaacagttttttttattaacttttaaaattttactaactgttacaaagttttatatgtaaaataacttgttttccttctttttttactcttttcagaatttgatctgttgcaaatgaccattgggcctaagcagcacaaccagcccattaagcctaccaacatgagatgaatttttttatttataattttttttattaaaagttttacaaaaataattttccattttgaaaattgacggaagtagtcgcctaccgccctctgggaaaaatcgccctctcagagggcggcgaaaatgacgtggcagacggccgttcgctctcgggcgacggccgtcaacgaaatttgcaggcggcccccttgccgtcctccgctagggcgattttatactgtgcggggggccgcatgcaaatgggcggcgagggggggcatggaattttgcaggcggcccccttgccgccctccgcttgggcgattttgtactgtggggggggccgcctgcaaatgggcggcgagggggcatggaattttgcaggcggcccccttgccgccctccgcgagggcgatttttgcctctccccctataaagcccagtccctcctctgtgaaatttcattatattcactaaaaatcaaaaaaaacgaaagagagagaggggagggcagcagaaggggagcggcgaagccctgctggttcgctcaattcatcacgggtatgctcccatacatcttttgcatttgtactaatatgttatgtttgagtatatatgttgcgttttagttttagttccatatattttagcacatctgtaacacacagcacatatgtgtagatccagagcatagaatataatagtatgaattgagacatagacagtagtgttaattataagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttgatccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggatgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaatatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaaacatcttatggagctctttaagaggctctgtgcacagaaccaagagaagaaatttaatgagttgtgggacaagttggatgagttgacaacgaagcaaacagatgagcaatctcgcagatcactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatcattcacggcacgcaagcgtactttagggatcgatacaagaaaattcgtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcatacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgacaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaagaccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgtttaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttatagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggacccacgatggagacttactggtgtcgacgtggggttagtgcaacttcgctgcgttataagtttatcagtcgtctttttttttcttcacataacatgtctaattccgatcatgtttattgcaacgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccaatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccatgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgtgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattacttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactggagtactacttgtgtttgtctcgtctacatagttcttttaattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatattttctttcccactagcacacaacacacgaaaatgaaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgcccgagcggagggcggcaagggggccgcctgcaaaattccatgccccctcgccgcccatttgcaggcggccccccgcacagtacaaaatcgccctcgcggagggcggcaagggggccgcctgcaaaattccatgccccccctcgccgcctatttgcaggcggccccccgcacagtacaaaatcgccctcgcggaaggcggcaaggggggccgcctacaaatttcgttgacggccgtcgcccgaaagcgaacggccgtctgccacgtcattttcgccgccctctgggagggcagggcggtaggcgactacttccgttaatttttaaaatgaaaaattatttttgtaaaacttttaataaaaaaaattaaaaataaaaaaaaattcgacatgagatgtccagagccctttatctccctctctcgtctcactctccataacgccaccgctttgactgctgtcgatacgtttcaatgtctcggctttgactgccacttgagctcgggcaatcttcatgccctgtttagatgggactaacactaagtccctatcacatcggatgtttaaatattaattataaatattaaacgtagattattaataaaacccatccataatcttggactaattcacgagacgaatctattgagcctaactaattcatgattagcctatgtgatgctacagtaaacattctctaattatagattaattaggcttaaaaaatttgtctcgtgaattagctttcatttatgtaattagttttataagtagtctatatttaatactctaaattagtgtctaaagacagagactaaagttaagtccctggattcaaacaccacctgaaaccacacactttttactgccatcccccctagtgtgcagtcgctggcgttgcccatctcgatctatcttccccaagcttcaagtgtcaaatccagacaacgaccgacgacatcaaccttcatgtgtgtcgggaagccagggatccggaccgggctttggtaagcttccctccatggcttgtcaattcacggcgataaggtgttgcctgttgtcatctgtccatctctagttctattgtgcgaggcggatagcaatgtcagagagataggatgttcacggtgtttttttttttccagagtattatttgtcaacttcctagctaatttttttttcttgggaagttgttctggcttgtcccgagtcctgacctcactctttagtctaggtgtttttagtgagatgtggatttgacggtgattttcgggaaggctcttgttgacccatcttttttttttttaatttgcatgaccatatccaacggtatatattgaatttgtgttgcatgtgacgagtgacgactattattcaacatgacgtgggttattctagaattatcacatgattcacttttcactttgatagttggggctgttgccagtcaaggctgcagctacggctgcacattgcttctgccgtacttgcttgactgtttctgttggctgcagcgctattgttgaccaggcaatcgaactaccaccatcttgacatacctcttcaacttacttctctggttctctagtatctagtatcactctatagccatatcttaatttgtacaccacccctacagtacaccttaacaactctttttttataactataccataacaacttgcacctgtgttcgttccagtgacattgggtgagaaagctcctcgttttacgcgcgcacgcttctcaaactactaaacggtgcgttttttaaaaaaatttctataggaaagttgctttaaaaaatcatattaatccatttttgcaatttaaaatagttaatactcaattaataatatgctaatggcccacctcgttttgcgtatcttctcaatctctccaatccccttctcctcaaacacaccctaagtagcctttctactattccctataataatttctaaaaagaaaaataaacagaacaaaccaagattctatcaagtcacatcttgctttttagacaaaagtgaactcacatctatctagtctgatttaaccaaccatatgaaatttttttcacaaattaaaattccatctgtcgaccacataaaatgtagccaagtcttagacgcatgacatatcatattcggtagatgtatttttcttataacggggatgcatatacacatatagagatatagtttgatttatcaaggtggagcatatcaatttgatactaattcagtagaatttagtcgattctgaatttgcccttcctttcctactactactcgtggagaaatttgcatatgtgccatccttaaaaactggcttcactagaatactatcgttaaaatggcattcgcctcttaagctgtgggaattcgcaacaatgccattttctctatttgttgcacttgtaaatcattttccatccatttatttttttctcggacctttttgtccctggttgcaccttctctcttctcctctcatcctttcttctctcttttctctcctccacacgcagggagaaggcgaggtgacggcggcgcgccgcgagccgaggctgtgcgccggcagagagagggcaaggtggtggcgacgacggggaggtaagaggatgctcaaagctcgcacgtccatcccccaccggatctgcctgccacagcccaagcaccaccgccactcctcgtcgttgctcgagctccactaccaggaccaccgccttccttcctctgcgcgccggcaactcctcttccctctacgatgccagtggacagcgccgccgcctccctccttccgcacgcctgccgcagtcgccgccggcccatcgccgcctccttccttcctccttccgcgctagcgccggtgccgcctccctccttccacgcgcttgcaccgccaggttcgcttcctggtttgctgcgagtggaggagagagaatagaggagaagagtgaagatgcagccggaggcaaaaaggtctgaaaaaattaaatggatgaaaaatgacttataagtgtataagaaatagcgaaaataatattataacgaatgctcacagcttaaaagtaggataaaagcgaatcccattttaacgatgaacatcctaacaaagccagttgttaaggatggctaatgtgcaaatttcttctcctcgtgcaattcgtatctcatttccactcgtgccattttcgctcccaagtcccaaaccacggcgacccgccgccatccatccccctaaacccctagctagggtttccaaccaccatggcgaccacgccggcggcagcggcagcggcggcggcggcggggggcgcggcgatcctcgacactctcggggacttcacctcgcgggagaactgggacaagttcttcgcgctccgcggcaccggcgacagcttcgagtggtacgcggagtgggacgacctccgcgccccgctcctctccctcctccatggcggcggcggcgcggagggcggaggcaaggccccggagatcctggtgcccgggtgcgggagctcggtgctctcggagaggctctacgacgccgggttccgccgcgtcaccaacgtcgacttctcccgcgtcctcgtcgccgacatgctccgccgccacgcccgcgcgcgcccggagatgcgctggcgcgtcatggacatgaccgacatgcaggtacggccacgaccccccgtgcgcttcatccgcttcggtgtatttgttggctgctttggagctaggattttcgtagtgctgttgcggtgtgtgtgggggcgaatctatacggaattgcggctctgcttggaattgattttgtactggaccacgcaattaggcattagccaccgaattgaggataaatcggcaccgaccatttttggtactcgttgtctttagtggaatggttaactgaatttcgtatctgatggctagaatggaggctcttgctaatgccatgctcttggaggttgatgagtaggcaatgctgagaattcaagcatatttggttgattgtgaatgcttctgaacatattgtcatgcaaatcatctaaatgaatgaacgcatgtggtgtgttattttcacccttgggcagcttgcaccagatgctcatgattttagtttgtcgcgtgtgtgacatgatggatcaagcaaattacagaagggggcaactcatttggttgaaaccctgaatgagcctagtggaataattgtggggcttttatgttttatgcttcttacaatggtagcgaactgttacattctcaatgttttctgtacacaatacacttttaaagagttcttttcattttcccttgccattttttaagaattagagggttcttcacttcttctgactgagtgtttttttttttgttttctgtttgtccatcaacctgtaactcgatatcttattgaacctacctgatgcatcaaattgccagttcacagatggatcatttgatgtcatacttgataagggtggactggatgctcttatggagccagaggctggcacaaaactagggatgaaatatctaaatgaggtattaagtgtaacatgtttccaaatttaaatactgatgtttgatgttgtaatagaaataccattttgaattttaaatggtgcatgttagtgttgcattcttgattttttatatatctaatggaatttatggaaatgttttgttctttatgttatgtctgacttagtaagcgcctcttgcttgtcttacaggcaaagagagttttgaaatcaggagggaaatttgcttgccttacccttgcagaatcccatgtcctaggtgagcttctgtcaattattgagagaactgattacctgacaattgaagtcttttcctgttacatagttacacttaggacctccaatatgtcttacagttttgaagtattctagtgaatatactttcaaattttcagctatacttcttttgttttgcttttagttgaccaaagatatcgagtattgatttttcatgtttccatagaaactttgatcattgcttttatgactgcatcaatattcttcttatacatcttagtgactttgactattcttaataaatatacttccaatgtttccagggaagctttaataactatattagcgtgaaactataagttaaaaaaaaaaactttatgattatgaatgtgtttttaacaatagaaataatggtgttttcttctcttctttcttggaaatcaatgatgtactttttgcagataatctgcatactttcatagatattgtggtctgaatcaaaatttcaaaactgttccacaaatgatataaataaccaatttaatatctcggaggttattttcgtaattgactaacagtgttttgctcctttctctcctgcagctctgcttttgtctgagttcaggtttggatgggatatgagcattcaagctataggtaatgaatcctctaagtctgccttccagactttcatggtggtcatggtaaaaggaaagatgggtgtagtacacccaatacaatcactattagaccaatctggtaaattctgtaacatgaaacaggtactgctatattcttctgatggaaaacaaataattaattcctgtcggtactcttactcttatattttatattggtgctgcaggcaaatgatgtgattcattctcttgagaaggaaaacaccatccgggagtcatacagttctggtgttgatattactttgtcattacgcgatcttcagttaggagctgtaggagatctgaaggtgattatcccaggacgacgaaggatgttcattcttggtgatcagggaaattcactttattgctataaggctgttctcttggatgccagaaagcgaactgagacctttgtatatcattgtggagtttttattgtgcctaaggtcagctatatactgtcaatatgcagctttgatttttgttgcagtacttactgttatttaattttactcaatcccctactgatcattttcttgatctactatgtcgtataagaaacaagcatatgataaaatgatcagaaaatatacttgaaaatcaaattacactagatggaatagaaaactgtgttgatcaatgttatttagggtccacatgtatccatgttgttcacttcctataccaatttcaatgcatatatcaaatactacatcattttcaaaatatatgacgccgttgacttttctcataacatttgttttattaaaaaagttagtataaatatgtaatactataagttaagattatagtctctttgatgataaaacaggtcacaacaaaataaatgatacttatataattttttgaataagacgaatggtcaaatgtcatgcgaaaagtcaacgacatagtacattttgggatggaaggagtattgtgttacttttttaagcacatgcctgttgcccgctgaaatgtgattctgtattgcatacttggtgagggatgcatccagtttattcaaattgtatgaaacacaaatcttgaggccacccaatctatttccttcttggcatgatttatctttttatgtggttttgacctgccgtaccttacattgaagtattacgagggagatggtaaaccttcatgcaaatatgttaattgtgcatgttgcaatggaaagattatgtggtgcaacagaagtttaggatttgggacaagtaacatcactgcaagataataattaacttactagtacacaatatggtaaatagtattaaaagaggtgtgcgctgcatattatagggaaattgtaacggaagaaataaattatacatagctgaatagtatggagatgtgcgcatagtggggatatagctgagagtggggatagggtaatcactcctgtagtcctgctcccatccccatttatagtggaaggtatgggacgcacttcaaatttgtaaatttgagtcttgtataggcttaaagtctttctctatctctatttcaccgttttgttcctctgctttatgtctattgtggttctgcatcaaaaggtttgctatgtgggtactagctaggcttcttttgacaaccagagttgctgagtagccctctagtatttgtgttctcttccattaagctatatgaaagccaaaacagttactctggcactcatgattgctaatgaacataatttgctttcaggttcgagcacatgaatggctttttgcttcagaagaaggacagtggcatgttgttgaaagtgcaaaggctgctcgtctaattatggtacaactgtgatggatgcaagcctagtgtgattataatttgatatttgggatcactttacagcattttcattgcttatatttgtgccatgaacttacctttaccttaggtattcttggatagcagacatgcaaatgctgacatggatgttatcaaggtgattgtttgcaaattaggatgttgtgcaaattccacaggctaatacacactatcctaatgttattgttttgcttctttttttttcagaatgatttatctccccttgttaaggatctggaacctggaaatcctgaagaggaagctcgtataccgtaggtgtcaatgcattctatttgaaattttgtcagcatttttttcctagaattcgtgtttccatgttaaggaaataaaaatgtcaatttctttggaagtacaactgtaggaaaaggatcctaatgaaaatgtcaaattattaagacaaactttacagtttggtagttagtaaaagaggggtttatcagtgcccacgattatagtaaggctttgcaattggtccagcatgaaaactcaatctagttctaatagaaattcgctgatgccaaattagtctggtgcacctatcctgtatgtagtcctatttgagacagcatgatcatcaccattattatatctcctggtgctgtttgtttatttcaatgcacattccctggttattatatatattacatccccttat

SEQ ID NO: 68131 - DNA, 12068 bp, Oryza sativa
attcctgcagcccttagttctaggatcgtgtttacaaaatggccttgagcaactaaatgtctttaaatgctgtttactgcaaccctaacccctctatgttattattcctttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagcgcctgtggtcgtcgccctagtcttccgctgtttttcgttgtctttgtgtgtgctgggccttcgctgcccatgtaataattttatatacgcttccgcttgttaaactctgatttgtatcaacttttggtgtaccttgcctcctgggacaaggaataatacacgcacgtcaggaacgcctgttgggtgatttccggtcgtgacaagttggtatcagagcctcctttgaccctaggacgagccgtagatcccaagccttagcaatattttcaaaaataaaaatcctttattatttgtgaaaacccgctattctctctttgtcttgctgcttcatttatcgtcaaaatctgatcttttaaatgttgttttcccttttgtttttgtttgtagatggccggcagcgttacccgtcgtggtttgcacatgactggcttcgtcttggagctgcgaggcatgtgcgtggtcttggggtatccacatggagtggattaccaggccaggccgcttccggatcaggagggtgaggatgcagagcctcacgctggttgggaggtcactgcagtgatcctctccggctctcccgagcggacttcactggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgggacgccagctcggaggatgacgctaccgtcgtgcatctggcacgcatggtggaggcgtacgacgcggctcgtatcgacttccatcagatggtgcgtcgtggcatggtggagaacaacatgaagatcctggagctgcgtcaggagaacctgcagctcaagaaggacctcgacgcgttggaggcgcagctgcatcagctcaagatcgcccagggagagatctgccgccccaagcgtcgccgcgtctgccgcagccagaagatcaccgcccgcaagagcacctccaggcctgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttgtcttcttgagtcgtgtggggcatggttacgccggtgtgtggtgtaactatgtcggagcctgtcttattttgtttgcctaagcaacttgaaccttaatgaaccaatttaatatcagtaataaatttaagaataatggtagtcgtgggtggttagttttaatcgtcagctctccttctctgtttgctggttctgtgtggggttttcagatggtgacgaccaggagaaatgttaacaccggtgaaggcaaccaacccgaaggcagcaaccccaacccccaaggcaatccacctccaccaccaccaccagacaccaacgccattctcacccaaatcctcgcccagcaagccaacatgatgaatgctttcctccaccacctccaaaacccgccacaacagaatgctccaccaccacctccccaacactccaaactcgccgaattcctccgcatccgcccacccaccttctctagctccaacaatccagtagatgcgttggattggttgcatgccgtggggaagaagctggacactgtgcagtgcagtgatgaagagaaagtcatcttcgccgcccatcagctgcagggacccgcatctctatggtgggaccatttccaggccacgcagccagagggacagcctattacttgggcccgcttcaccgccgctttccggagaacccatgtgcccgctggagtcgtggctcttaagaaaagggaattccgagagttgaagcaaggcaaccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcagcaacagcagcagaatcagcaagggactcgtgcgccacgtcctcctacgccaactgtgcagcccgttcaaggccgcagggacgcttcaggtccgcagcggctgtgcttcaactgcttcgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttccccgttcattccatccccgctacaattttgttcgactctggagcttcccactcgtttatatctgtgccattcgtggaaaaaaatcagttgggggtagaaaggcttagaaaccctctgctcatcaccacccctggcggggttatgacggcaaagtattatagccctgccgttcctatagaaattcaggggattccttttccctcggatctgattctgttagacacaaagaacttggatgtgattcttgggatgaattggttggctcaattccaaggagtagtggattgcgcgaggcgcactgtcactctgtaccgaggaccagaacaaccggttgttttctttgcacctccaacctctgtcagaagttcagaactgcatcagataggtctgtcagaaatccccatagtcagagagttcggagacgtgtttccggaggaactacctggtatgccgcccaagcgagaaattgagttccggatagatcttgctccaggaaccactcctctgtacaagcgaccctaccgtatggcagcaaatgagctggccgaagttaagaaacagttggaagagttgaaagaaaaggggtacatacgtccgagtacttccccttggggtgcccctgtgatttttgtagaaaagaaagacaagacgaagaggatgtgcgttgactacagagctctcaatgaagttaccatcaaaaacaagtaccctcttccccggatagatgatttgttcgatcagcttaaaggtgccactgtattctccaagattgatcttcgttccggatatcatcaattacgtattcgtgaggaagacattccgaagaccgcattcactacgcgatatgggctgtatgaattcacggtgatgtcgttcggcttgaccaatgcacctgccttcttcatgaacttgatgaacaaagtgttcatggaatacttggataagttcgttgtggttttcatcgatgacattctgatatactcacaatcagaggaagaccatcagcaccatctccgtctggtgttgggaaagttacgggaacatcaattgtatgccaagcttagcaagtgtgagttctggttgtccgaagtcaaattcttggggcacgtgatatctgctaaaggagttgctgtggatcccgaaacagtgaccgccgtcaccgattggaagcaacccaagacagtcactcagattcgcagtttcttgggtttggcaggatactaccggagattcatcgagaacttctccaaaatcgctcgacccatgacacagttgttgaagaaagaagagaagtttgtgtggagcccgcaatgcgagaaggcgttccaaactctcaagcaaaagctggtttcctcgccagtgttaatcttgccggatacccgcaaggacttcatggtgtactgtgatgcttcgcgccaaggattggggtgcgtactcatgcaggacggtcatgtggtagcctatgcctcacgccagctacgacctcatgaaggcaactaccctacacatgacttggagctagcagcggtggttcatgctctaaaaatctggcggcactatctcattgggaatcgctgtgaaatatatactgatcacaagagcttgaaatacatcttcactcagtcggacctgaatcttcgacaaaggagatggttagaactcatcaaggattatgatgtgggaattcactatcatcctggcaaggctaacgtggttgccgacgctctaagtcgaaagagccattgcaatactctcaacgttcgtggcattccacccgaacttagtcaacagatggaagccctgaacctaaacatagttggtcgtggatttttggccgcgttggaagccaagcctaccttgctcgatcaaatccgcgaggctcagaagaatgatccggacatgcatggactcctcaagaatatgaaacagggtaaagccgcaggtttcacagagggtgaacacggaaccttatggaacggaaagcgggtatgcgttccagatagcagagaacttaaacagctgatacttcaggaagctcacgaaagtccttattccattcacccgggcagtaccaagatgtacttagatttgaaggagaaatactggtgggtcagcatgaagcgggaaattgcagagtttgtggctctatgtgatgtgtgccagcgtgtcaaggcagaacaccagcgaccggccggacttctccaacctctccaagtgccggaatggaaatgggatgaaattgggatggatttcatcaccggacttccaaaaacccaaggtggatatgattctatatgggtaatagtggatcgattaaccaaggtagctcgatttattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcgtatcacccgcagacagatggacagaccgagcgtctaaatcagatcttagaagatatgcttcgcgcatgtgtcctggacttcgggaagacttgggataagagtctcccctatgccgagttctcctacaataacagctatcaagccagcatacaaatggcaccctatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgacgccgtgatctggaattcgcagtggatgactttgtgtaccttcgagtcacgccattgcgaggtgtgcacaggtttcagacaaaagggaagctcgcacctcggtatgtgggtcccttccgtatcatcgctcgacgcggagaagttgcttaccagctggagttgcccgcctccttgggtaacgtgcatgatgtgttccatgtgtcgcaactcaagaaatgtctccgagtgccatccgagcaggccaactcagagcaaattgaagttcgcgaagatttgacctatgtggagaggccagtgaaaatcctggacaccatggagcgcaggaccaggaaccgggtaatccgtttttgcaaggtccagtggagcaatcacgccgaagaagaagctacttgggagcgcgaagacgagctgaaggcagcccatcccgatctcttcgccagttcttccgaatctcggggtcgagattccgtttaaggggggtaggtttgtcgcgacccaaatcgactctaaaattcatcctcgaaattgtgcaaagaataattaaaattaatgtgaaagcctccaacaattaaaatgtgcaaagataaaagtcaaatggggcttggaggatttttgtatatttcctaaaagcctaaaatgcttaaataaattttagtggaattttcagagcacaaataataattgaaaagaaataaacaaagttaaaaaggttttataaaaagaaaaccctaaaagaagtctgtttcccccccccctttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccggccgctccgcgtgcaatcaagaggggggatttactccccgtaatcccctcccccgtttccccctcttttccctctctctctccctcggattcgctcggaatcaagcccgaaatcctcgccggcgtattcaatggcggccgaatcttccgcgcgcgattcctccctccccggccgctctttccttcccccggcgctatttaaaccctccccgagctccgcccttccgtttccgccgctcaccgctcgctctcgccgtcggaatcgtgctcgcaccgtgctcctctctctccgccgtcgccgccgagctccgttccgtcgccgccgtgcttcggttagccgccgccgccgctccgctcttcctcccgactcggcgacacctccctcggcatcgccgcatcgccgtcgaccccgtccgcgcctccacttcgcccgccgaccgccggagcaccgtcgtcatcgtcttcccgaaccgcgccgccgccttcttccgcttcggccgccattctcgtcgtcgtcgttgtcccggggtgagccgaagaccgccgttcgccttccccctttcctcctctttctcgggtgccactccgccgcgccgttggtcgccggcggcgaccatcggggcgcgggtgcgcgccgttcccgtcggccgcgccggcgaggccgccctcgggcgcgccctcgcggctaccaagtgggcccggcagtcagccgcccgcgcccgcgggttcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatggtattttttaattgaaaattaaatgaagaaattcgcaaatatccatttaaagagcatataatcttcaaatggccatatcttggccatttgaactcggaattggaccgttcaagtctctaatttttccttaagatgtaaagaacccatttttgtgctttgtttctgctgttatgtggagttatttagtgttaaagccttttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagaataaacaaaaccccaactagtggacactctattcatggttccactagtatgaatttaggtagatgcttcgctgattaattaggcaacattaggtggttttataactttagacttgggaaattctcatatcatttggacaccatggaatggttggcttatgttggaagtggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgctaggggctcagttccgtctgcctgtcccgggggttccggccgtaggcggaattgggtcggtactcttgtctaaggctaggatgggttggaaactatgtcacatcttccgtccgtataccgtggtggtatgtggcacgtggcaacacgtgaggaagatgtgtcttgtgggtaaagatgtacacctctgatcagagtaaatctattcgaatagccgagccctcggatatgggcaagccgagcaatgtacccaagtcagtgttataattcttaaaattttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtttagttctaggatcgtgtttacaaaatggccttgagcaactaaatgtctttaaatgctgtttactgcaaccctaacccctctatgttattattcctttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagcgcctgtggtcgtcgccctagtcttccgctgtttttcgttgtctttgtgtgtgctgggccttcgctgcccatgtaataattttatatacgcttccgcttgttaaactctgatttgtatcaacttttggtgtaccttgcctcctgggacaaggaataatacacgcacgtcaggaacgcctgttgggtgatttccggtcgtgacaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatgtatgttgattactaataaataatctctcacaacatgaaggtggcgtcgggcatggccatcccaacggacccttcaggtacttaccactgcaggccgattccagcaggatactcgaaggtcgaagttgagttggtcgaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctaggctccagcaccgactcctcctcaggatcctgcaccgtctcctcctcatgctccgccagcaccgtctccacctcaggatcctgcaccgactcctcctcaggatcctgcaccgtctcctcctcatgctccgccagcaccgtctccacctcaggctccagcaccgactcgtcctcaggatcctgcaccgtctcctcctcgtgctcctacacctactcccccgcaagctcctcttccggcaccttcaaggtcaagggcccccccagctgcaccgcctgcccacacaagggcaacgaagaaggcgaaagttgacgccgcaaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggctatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagccgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgttcagttagaattcttactatacgtctcctttaattaattaggtcct

SEQ ID NO: 68132 - DNA, 1182 bp, Oryza sativa
cttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatatatgtatgcatatatatgtattgaaacatatatatgcatggtttatatatatatatatatatatatataaaccatgcagcaacagagccatgaaaaaaaaaaaggtcagctcgatctttagtcccggttatttcacccgggactaaagatagcgatctttagtcccggattggtactcccggtttggaaaccgggactaaatgggggttacgaaccgggactacaaagggtttctccaccagtgtgaattagcctattgactaggagacatacgtattagttatcaagaagttcatattttcggtttctctcatccaaaattttcaacaaggatgaaaatgagaaatctattatctattatattatattatattatattatattatattatattatatactaaaagtccattaaccttcctacaaacgctcccgagctgccatgtagcctcctacaaactctcataagccgccacatggcgttctaataaattagaaaaaaaagggtggacccactaattttgccaattaaatctccacctaaaagaaaaaagattcggtatccccaccaccgtacgcacgcacgtacacgtactcccctccacaccattcaaactctccgctattctcctactccttccgtttcacagtataagtcattttagcattctccatattcatatttatactaatgaatctagacatatatatatatatatctaaattcattagcatcaatattaatgtggaaaatgctagaatgacttacattgtgaaacggatgaagtatttttttagctaacttctcctattttatagctagcacttaatatataaaaaagataataatcgattatctaaatctacaaaattctcaagttacatattttttctcatttttttcaactgttgtgttatttatcaattaaatatcaaattcaagatctatattacccatattttgttatttaaaaattaaaaatta

SEQ ID NO: 68133 - DNA, 966 bp, Oryza sativa
tctgagacttctcagactaagactcctattctattcctactccactagctttagaacactactaaattagagagagagctttgattcttcttgcttgaggtgtctcatggagtggaggatgagagggctttatatagccctccaatgatggttgtggcggttggaatggtcggaaatgccctccaaccatcattggggagtgatccaagccattcagaagaaaccctgcgtccaacggcacctgggagggttcggccgaaccatgggctggaccattctggccaatctttggcaggtggcctcctcttttgctcctttggcgatggcagccgaaggagggagggggagggcggtggaggcggcagcggctgcttcgggcacggcggcggcagggaggtcagcggctgcgactacggctctcggtatcggctcagggagggtggttgcgacgacggctcacaacgtcggctcagggagggggcgacaacgacacgggggagggagcagcggatccggcggctgtgttggcagggagagccggatccggcgcttgactccccaccggcggcggcggcgatgttgggaagggtggctctcggcgtcagctcagggagatggatctggagggctcggcggcgtgtctccttctccctctccctcctccaccgccgccagctgccgtcgccaccaccgccgcgggctgccgccagctcggggctagccggatttttgttaatgtgttgatttttgtgatgcttgaatgctcaggtgaatggaaattttttactgtaaattgttgatgtaaatttctgtggattttttagtgcttgggtaaatttctgtgaaatttttgaatggtggagtgttgacagaggcggatggagcggtgtcgctccgtctgtcgtttttttaaaacatggccagcattttgactggcggagtgaaaatgttttttcgctggtagcc

SEQ ID NO: 68134 - DNA, 5471 bp, Oryza sativa
ttcactggcctttgctttgtgggcgctctaaattcagccaacgaaatcccaaaatagccgccatgaaaaatggatttcgtaatagtgttccattcccttcttagtgaagtggacagcgttgacaaacttttgtatggctcttagtactacaagccttcacaagttgtccttcctctctttactgatccggaaacggttacgatgatgctgaaatactttcgcaaactattctttgatcctttagtgattagtatcataccagcaagttccgatgggaagctgatgacatgatagaccaactgcaacaggatattggtgatgatgataggatgatgacaaaggctaactccgacgatgtggaaaaatgtgattttctttttgttgtttccagcaagcttagagctagtgcatataccgatccactgattgggcgatgaacgatcaagccataacagggtcagggtagtaatccaatcaaattacacattacttcatctttttaattgttacactctctttctctctctctataggatagtcgtctttaaaattttgctcatatgcaacatggtgatttaatacagaatgaccatttaagcttctgcagcactttataaacgtaagcaaattttatgagcatctttcccatccttgaaaaggtctcacaaggtactatgaggtacgaggtaccattcatatccaactgtccattacaaagggtatgatgggaagtaaaatctcgacatcaaggtgggattcattcaacgtagcgctgctatggagcttgccatttgtgttgccgccgatctcattcctactcgcctccttccagattgctctgattcgttgagctcgtccaccgacctatcgagctcgcccgtcacgccgcccgtcgtgctcgagcttgtccgcctgtgcactcgagagtcgagcctgctcgtgcttggagctcctcctctgcggcttcgtgctgtcttgattccataatagcttggccaatgaatttaacctggccactgccgaagtgaccagcaagagagagttcattttaaatcaacaaggtagcccgcgcattcgcgtaagtatatatcgtagggctgtatttcaaacactataaagatgggatataagccagagaatatttgttgttaaaaaaaagaatgataaaataaatcatacatcactatatacaatgtaattaaggaaatgtaaattatctagcaataaaaaaagaaaaatatttaccgtaaaatagatggaatatactactaaatatgataagaataagaatatctctcatatttaaataaaaatctttttgtcgtggtcatatataaactcctctattgttcttgcttcaaaagctatgtgcatttttaataaaacaacattaataccactaaaataaattatacattattaatacactaaaaatcatctacaccgcttaacttggtgttcaccacttatttccacatctatgtataaatagtctaaacataccacttcaatcgaataatacaataacaccattaaaaatagacatgaatgtctctctaacggataaagttgactataattgccaaggctttcttatgtaatgccctggaacatcagtcccacatcgacgtagccgtaaccccaaagatcagcctatagcatcatttaacacttaatacactattggcacactcacaaatgattctattagttagtatgtccctttatatacattgcctacattagcctttcactgatgccacctgaactcaaccatatgtatacccttgcagtatttacgatagcatagtgaatactataccctgcattgaaggacggagagggacaacaaggaggaggtgatgaaaatagttataatttttgtcccctacttatttctgtgtagtatttttaacaaaatcgtagtttaaaggctatggacaacacataagtgctggacggccggctttgatgttttttttcttgattagtatttctttgattttactattgatatattagaatattcttctttatactactctggtattgtattactttccgagtatatgaataccaactttattatatatccaaattatattaattatgatgctagcttatctgggaaatgcaatggtgtgagcataatgatcatgtatacgatttctctatgtcatgacgatgatattaggatagtatttggtaatttaagcgtggtgtttagattgctggatatcgttatttggggttatatgctgcgaacatgtcgaggtgggccgctgatggtgacagctcagtacgggtattcctccgcgcatgtatataatcctaagttactttcctggggagggtactcatccgtatttagccctagttggatggtcatgacggattatcgtaagaaactcggcaatcaggagtggcttctcaagcaccacgagggcatttggaaagagggtattagctaaataatcatataactaggaagtatgtataatgtgtatgtatattagaagtataggaatagattctttctattttcgttccacttagcttagatgatttattatgagagtatgcaattctcttgctgtgtgtcactctaccctattcattatcttaaccccttcttagactttgattattacaagtaatatataaattattagtatagctctctctattataatcatcccacgggattaaataaatacgatacccttggaatactctcgggtgaaatactataatggtatattcgtgcgcttacagatgaaatcggtaaccataatataccacgagagtttctgcgccattgctgggaattatatttctagtaatatcgttaagaaacaccaatagggtcctcgacattcgtgcctccaattgtgtcacacataatggacaattcctgaagggaaactcaccagtgcggtgacgcatgaccaatgatgaagccgagccatccatctttgatgcaccaccaccaccaccaccaccgctgccgccgcttccagtgccacttgatagcccgccgcagccaccagctgccaccaaagccacagccgccaccttgggataggtttggatggggatttccggtgtgtgtggcgggagcgacgagtccgattgggtgtagttcaaccagccgcttctagcaccgattgcctgtcattgctaccaaccatctccaccactgccaccatcgccgcctaaggttagatttggggatttcgagtgtttgtggagggagcaacgagtctgacagggtctagttcaatcggacgtagttagggttacatggtgcgatgccaggggcacttccgtcatttcgaaattctctctcctctttttgcctggaaataataaaataatgcctcgggtatcctacgaccatttacacaagttcatatgtggaatccaacgcagtgtcacgtttctgtgttgtcttccagccaattacatgattttagatgtccagtagcaaattctgcctacaaattttagctctggaaaacatgccagatgctaatagtatttgttaatttagacctatacttgtcaagcactcaaaaaaaatccatccaatgcatccatacatctaattcatctaaaattcatgcaaaattcatccactgcatccactgcatagcaatacaatgcaaaaaacatccgactgcatagcaatatctaattcatgcaactatacaatgcaaaaaacatccactgcatccatacatctaattcatccaaaattcatgcaaaaatcatacactgcatccattgcatccacaatgcataaaaaaaacaagggagaggaagtgtacctgggaggaaaggaggccggtgggggcgggcttgacattggtcttgaggatctgagaggcggcggcgtggcagcggcggtcggcgaagcggccgcgacgtctgtcttgaggacttggcggagaggaagccggcggtggcggacttcgagaggaggccggcggcggcggtcttgggcgtggaggaggcgctggcggtcggggaggccggatcttgaaccgggaggcggcggcggtggtcggggaggccggatccatgagggctcgtggacgacgagggaggaggaggccgtggtcggtgaaccgggagggcgacggcggtgtcgaggaggacgaggcggcggtggcggcgtcgaggagaaggaggcggcggtggcagtcgggaggcgacggcttggaggaggaggaggaggcggcggcggtggatgtgagagggtgatagagtgagaggcggcgtcggcggtggatctgagagagtgagaggcagcggcggtggaggaggaggaggcaacggcggcgtcgaggaggaggaggcggcaacggcggtggatctgagagagtgagagagttagaggcggtggcggcggacagaacggataaggacccgtggatgaggattgactaagtaaaccctactcaatcctcatctctatcgggcagagtactatacccgatgcggatgacactcatccgtgacgggtgctatttctaagcctgatacggatgacactcatttatgatgggcattagtactaagcacgattgagatgattacatctctatcgagcatagtactaaagcccgtcatagataacttattaaaatagttttaaaattatgataagttataaaatcatttataatcacatataattaacaaatgtcttatttacatagtttaaaattcctagtaattttctaaagttcatataattaacaaatgccttcctcacatatagtttaaaattccttttaatttttaacaaatgtcttatttacatagtttaaaattcctattaattttttaaaatcatataattgacaattggctttctcacatatagtttaaaattcctaacaattttttaaaaccacataattaacaaatccatttcttcaaagagttttaaatcgtaattaactggaatggcatgaaacatatgcaattcattcattaaggctccaatacaaattaaatacatactgataccaatttggaaattacattactacaaagacttcatttacagtgatatgcctttcgaatggtttgaacgaacgtacaccacgttgcccaggcatgtgatgggccgtcagagatgagaggatatgtactagtgtttagacctatacttgtcaagcactcaaaaaaaattcttaggataactgaaaggcagcaaattaaataaactagccatttttctatagtactagttggatgcccgtgcgttgcaacgggtatatatacatttgaaaaatcatcacttaaacaatcgtaaatataaatcacatcatgtcacctactacctcgtggacaagattgttttcgtgaggcctctacttaacctctaatctagtaatctctaccaagcattgtgagccacggaggcatcgtggttgcacattattctatgagaaaatcca

SEQ ID NO: 68135 - DNA, 3448 bp, Oryza sativa
atagacatctaaattcaccccctgagctcgattgtgaatcatgggtacctaaaatttctaagtaaagcacacagaaacaacaaggacagcaagaaacagcaagcacatagaaaagcacatggaaattaccctcctcgccggcgcctgtgggactctactcgacggcgcctacagcccccgcgctgcagcctgcgaccctgtgaaccacatcggcgcgtcctgttgcgctgctgccgcgggcctcccctaccgcaccacccccgtgggccgctggcatagcggtgccgccgccatggaccactgccgagctgagcggcgtgatgggcgtgcagcactgcaaaaaggcacgatggtcaactcgagcaacatgacggcgactggtggggacgtagtttttatcctcacgcagggatgtgttggagatccgggatgcatttagtggagctggaagcaatacacgcacggtatatccctaaggccttgttcagtttagaggggattgaagaggattttattccctctcaatccaaaatcctcttcaatcctctccaaaccaaacaaagcctcaaggggattaatcaaacaagaccccagtgagtctggaccccccccccggccccccaccacccgcaccccaccatgtactcagcgtatccccatcctccccccttggagtcccatttggtcttccgccaaccccaatctcgttagccgcatccgcaacggagtggagcctggtgtttttattggacggggcgacctgcctgccccgcgttgtgctatggatcaactatcagcagcggggacatacaacgagctttagcccccaagacggccgtcgccggtgaagggacgccactgcaccgcagagttttcattcacggttcacggagcttcttctgcgatgcagctatggtccatccatcggcgggaggtcaactcaattgttctgctcaatatctccatcgcaattcaagaagattacagaaataagatccaagagcagagcgtttcgaaaatgcaagtcgcagagagctgatgttgtattgactttcctgtttagacgtactgtcgaaacagggatttgtcagtattaatttcagctactgatttcactttgtcttgtaccattattaactcgttaattctctcaacagcacattgcagagaaagctatcagcggtgaactgttagtctgcgattgtgatgcttgtattataattcgtaatcctattactggatgcttcattctttcttgtggtgaatgatactgctacttggccgcactatttcgtgaaatgtgttagatggatctccctccccttgagcccaacggctcaagggggccttgacccgcgccctaatcgggggcgcccagcccaatggctggtgggcccccgtcacactgtgccatataaagaggggtggaggacgggacgggataacatgacacaaggaacgaggttcgtcgccgccgccactccaccccacaaaccctaaccgatcgagggggcacagccagtgacgggaagtccaccgccgcgccacgcctcgtcgtcgacaccgtcgctgccgcaaccgcatcaccgccatcggcaccgagcacaccgtcgccgccgtccacgtcaagcccgcgacgacaacgacgatggccggccggacttcctcctcctcaacaacgactggtcacatccctaaaccctctcactccctctttgttcattcatctattgttgttcatccatcgcaaatagaaccacccgactagatctaaacctaggggatccaatagacaaccctaacaatggtatcagagccaccctagagtttagattggttggggaaagaaatccaaaagaaaggcaaagaaaagcaaacgatccaacggatcgaaaagatcgaatccctaaccctaatcttacctcgtcgccggccgtcgttgacgccggccacggagggggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggtttcggcgacggcgacgccgctccgtgcaaccgcaagagaaagaagagaagaggagctagggtttcggcgccggcggccggaggcggttttgtttgcccgatccgcccgcgcgaccgtccgatcgaaaccctagcaatcggacggccgacggcggccggaccgaaatcggcccatgtgggagcgcacggcaagccactttcccggcccaggcccaggttgcggcctggcgaaaggggagggggcgcccgcccgcgcgcaaggcggccgtgggccgaccggcaaaggccgaaaaagttcattttaggtccctcggggccgaatcaaaagaaaggaagttcattctaagtccctgtttcagaagcatttacaattatagttgttaattgtgtttatttctaagcaatttgaaccaacgtgaaaattgtttagagaatagataaatgtgagaaatgcttctgaacatgtactttgtatattttcatgcaaattacaatagaattttgaattgtttttacatgttttacctctgtttaaatttgaaccaacgggagaattttacagagagtaaataacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgt

SEQ ID NO: 68136 - DNA, 5645 bp, Oryza sativa
ggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcttgacttcctgacagtgatcatggcaaagaaaggtgagaacattattacatttgtaaagaatctcattatgattggttattctagatccacatggtggatttattctggagcaactattcatgtgtgtaattgtttaaagggattccgttccatgaggactacgcaaagaagtgaaagatccattagagttgccaatggagttgaagcaaaagttgaggctgttggagatcttcgcctagaactcgcgaatggcttcacacttttacttccagacgtttttatgtcccttctttgcaaagaaacttgataataagtgtatccaaattggattttgagagatatgattgccattttggaaatggcaaatgtgaactatggtataataatgaatgtattggtcttatgttgcaagatcagttttatttgttatctctttctgagaatgtgaatgttgtgtcctcgttgacaaaagaaaagaaagcgaactcctgatgtctcatcgaaattatggcactgttgtttaggccatatttcgagggggagaattgagagactggttaagaatgtaattcttcctccattggagttctcagttttagaacaatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcgtttctactgtccaaacagttatacaaagtttgtagaaacaagatacgccgtcttcttggaagacgaaatgattagggggagctcggtaattcgagaaattgatcttgaggagaggcgggtgtctgtactcgctccgtcgactcaggaactttccttctctttacctgctaatgttgtgccagcaatgcatgccgttgcggtaccaacacctgttgttatctctcatgtagcaacaatgaatgaaagtgaggaacctgttctacaggattcaacagaaattgttgccacatcagaggaggagctgcaacagcctcaaacagataatgtgcctgaataggaggcccctagaaggcctgaaagagtcgcatatggaggatgatcccatctcatatgaagaggccatgagaagccatgaaagatgaaatgaaatcaatgatgtctgggatttagaagaaattcctaaaggagccaaacagtaggctgtaaatgggtctacaaaaccaaatatgactctagagggaatatagaaaagtttaaagtgcgactcgtggcaaaagttttcacgcaaagagaagagattacaatgagacattttctccagtctcttgtaaagattcctttaggattataatggcactagtggcacattatgatttggaattacatcacatggatgtaaaaacgacatttctaaatggagatttggaggaaaaagtatacatggcgcaaccgaaaggttttgtcatgaaaggaaacaaaaatatgggatgccgtataaagagatccatttatgggttaaagcaaagcttcaagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactacaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtatgcgcaagtgtgcacacgacctgacttggcatttgttaccgggttatttggcagatttcaaagtaatcctggcctagagcactggaaattggtatagaaagtcttgcgtgattgcaaggaacaaaaggcctcatgatgtcttacagaaaagcagaatcgctccagatagtgggatatttggattctgactttgcaaaagataatacaaagttaacatcgggatacatgtttaccctggcagtaggagctatttcatggaaaagctcaaaacagtctaccactgcagggtctaccatgtatgccgagtttatagcatgccatgaggctatggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatatgtttctgaatagagatgtgtatagtggctgtcgaatccatcggtaattaaccgtgacgatgaaacatgctctatatgtaaatctgtgatggaatagaaaaagctaaaggaaatagtgagataaagggggagaatgttagatggatctccctccccttgagcccaacggctcaagggggccttgacccgcgccctgatcgggggcgcccagcccaatggctggtgggcccccgtcacactgtgccatataaagaggggtggaggacgggacgggataacatgacacaaggaacgaggttcgtcgccgccgccactccaccccacaaaccctaaccgatcgagggggcacagccagtgacgggaagtccaccgccgcgccacgcctcgtcgtcgacaccgtcgctgccgcaaccgcatcaccgccatcggcaccgagcacaccgtcgccgccgtccacgtcaagcccgcgacgacaacgacgatggccggccggacttcctcctcctcaacaacgactggtcacatccctaaaccctctcactccctctttgttcattcatctattgttgttcatccatcgcaaatagaaccacccgactagatctaaacctaggtgatccaatagacaaccctaacaaaatgtacatgttctgaagtagtatgatcaatatcaagcaatccagaaccgaaaatcaacaactaaaaattgctttgatcaaagatagcttccgctatttttagaagaattgaggatttggagcaaagcacggttttcctcaagcccatttcgctcattcactttacgaattgagcagatctatatcattccagctacgccttgcctcacaaactttttttttcatttttaatctcgcgtaagatttaattatccatggtcgctgaaagagatgattctgatgaaggaatcctccctgccggcaccacccccgctgccgccgacgctcgccgtggacgtgtccgtcgtagtgggcctgctcacggccgtcctcctcgcgctagctcttcttcttcctcatctacgccaagcactgcaagcaccgtggcctgggcgtggcgcgcggtgtcgctgtgctgggcctcgggttccagccgtcgtcgtctttgtgcaagcggtgccgctccggcctgagcagctgtgccgtgggagcactccggtgtcccggttcggcgacatgggcgacgctgcgcggcacggcgagggaccaggtgaccgaatgcgccgtgtgccacggcgcgttcgacaccgccgagctgctccgcgtcctgtcccggtgccagcatgcgttccacccaggctgcatcgacgtgtggctgatgacgcactccgcgtgcccggtgtgccgccgcagtgccgctgatggtgcactccgtgtgcccggtgatagggaatcaacgtttcctagctatgtatcggcgtcaaagggggaggagcgctgcgacatgcgcagatggaagcgtgcatcgcggacacgagcggttgcgtgagcgtggatggaggcgcagccgtgtaggggtgggtggatgcgcgatgcgagcgcggatggatggggagtgggctggtgcgttgatcttgcgggaggatcctgggagagctctcagccattagattgtttaggactcaccaccgccactacgaattttttaagtagtaaagataccggaggttaaaagatgacggcaactcagctactatacgagtaaaagttcacctcctattcactttacgtgacatggaagcatatatgaatataattggaaattagatctacagtataattcaatgtcgaattataaaaataaataacttgcaaagaaaaccaacaatacagtttgattcaactccatgtagtcaagaaatatcaacttccaaacaaaaatctctttgtttttccaccatgcgtgcaagttgttttagaagcacgcaacacaagacttggtactccgatttatatatgtatgtctactaagttacaaaccacaccatgaattcaagtcattatctaaagaaaactttaggttcaagtaccaaacgaaaactgaagatcaggtctgaattccaatacgcattcaagggtacacctcaattattgatagaaaacctaatattggcatgattttgtaggcactaaatccagctttggaaaatatactttcccattctttctcctctctctcaaccccatctatgtacatcatgtagagatcaaacaacgcttgtgtctctttgaagatgtggggacacccgataaagtcatggtgtcccacgaatacgtatctgcccaggatgttcagttacgcatgaaatgatataaaagcataaacttcgtttatacaatacttaagtcacttagttcacaacacaacataaatacaaaccattacatatatggcctataaagccttatttctaaaaacagataaactgctagacttcaccacaggaactgcctgagcgtaggatgacctagaaaccatagttgtcccactctaacagatcaacaggtcctccacatgcatcttcctcttcatgatctgaacccatttatgagtacaaatggtactc

SEQ ID NO: 68137 - DNA, 3548 bp, Oryza sativa
agggctgaaaagtaacaaggtgtaatattgctccatatatctctcccttctgtctagtaagttaaaggatgctcgagatgttgcttggagtgatccagtccaaggtgtgtaccaacctacctccgcatccacttaccattgttcgttactcgatgggcagctcagaacttcatggacccaaagggtagttctgaactctcggggcccatcgagcccacatatataaatcatataaacatggaccatgtcactttgcttcacacacttgaaagctaatggccagtacaccgaaaggcctgcagaagtttaatcaattggagcaatatacggctagattcgataactcgatcgtgtggatgggcgaaactatgtcattcttattgacacaaggggggttgattattatatcaattttaaataagaaataaccataaatatatccatatattcaacacgaccataaacaggtccataaaaccaaacactctatcatgtgtaccacccgcttacatgcggtgtcaacaattctcagcatatagccataaatagttctataagcatgctttcatatgcagtaataatatccataataaatcaatagtatgttaaataattaacagtttgtttaagtgtttatcaaattttatcctaagtttgttagactctaaggcttattaaggtatttataaaaacaacagaaaaatataatgcaataatagcaatataattaacttgaaagaattcgtgcagtctatcgtactccaaaggacaagtacgctactaaaataactcgctatctactgggattaaattgttcaagggagggtgcatgtcttgcaaccttcgggctcgatgtagtcgtacaaaccgtctcctactggcgcggagatttcactcgctccgaataccggaccaacgtcagcgttttctatttatgcaaccatcatcatcacaataaataatagaaaaacaaagataaccaaaagaaatagtatcacaaagtgcaacaatgggtgaaaaggatttaaagaaataattttagggatttatggaatttcggagaacggcgaaccctagggctaaaattagggtcgcggcaacgggtgctcggattgcaacgaaactgatactgatggattcggaataattctaagagtttggaataggtctcggattttgtttttgaggtcaaacaatggtcaacctgatagaataagaaaaaggatttttctgatttatttttcaataggaaaattggatttgctgttcttctcgttctgcacaggaactggccagaatcccacattgccggcggcagaggaggccggttttggacaagggggcgccggttttgtgatctagggctcgaggcgattccgtttttgtggtcggctgcgagaaaagcgctggcggtgaggctggcggcggcgggcagtaacaggaggcggaggcggccatggtggcggcaactccggcgaactccggttcgggaggcggcctggtgaggttcaatgaggcgagaggagtcccagggtggtgacggccaaagctagcgggccctggagcggtggcgcaccatgcggctggcggcggccgaacagagaggcgacgccgagaggcggtgccggcgatgttccgacgatagattggatgggtaaagagaggggaaagggagtactcggcatggggaatccgattttaccttcaatttcagaggatcggcgatgtatgcgacgagtttcggagctcaatcaatgacgccggtattagggcttcggggatttttcctccggtgacgacgattgagttaacgggagtaggggcggatttgaggaggtgaaagaggttgaaattgcgcttcttttgcctccggtcttgagcgttctagtggagggacgaaggaaatacggaggctggaagctggaggtgtcgcggcggcattcgttcgtcgttcatcctcgtgagagctcgtgcgggcgtgtggcgtgcgaggggcggcacgagctgggcgcgagcacgacgcgaggcggcacagggttggcacgaggcagctcgagcgcggcttgcatcgggctggctcagcctagcttggcctagccatgtagagaaaagaagaaaatatggggaagattaaaatagttaggatttgaattgatgtggaatttagatggtccgacattcgggatagatttaaatcttattcaaaggaattatttgaggaatgatatgcactttgcgacaaaattaaacgagaaaagaaacatcgaaaacaaacatggaaaatagtattttaaatgaactactaacttgacggttatttttttagaagatcaaagcaaactaaatcggttttaaaaagttgtcaaattttagggctgttacagaagatgtccctctgcgagcctgatccaaccactatgtttatgattatcacctttcctccagcatctctagtaggtattgcatctttgcaccgtcgaagtatcttgacacaatcgtcatcaccaaaacaatgcaagacatactgaaacataaacatttagaagtataaaataaaagaagtttggaggctaactagatagctaaattgaagggaaaatgcatctctaaaaccctcgaactattataaattgtctagtcaaacctatgaagtttgtttttattaagccagatctgttaggtgtattcattatggctaatgcgccagcctggccgctcggcagaatccgtttagattccccgccgggcccacaaccacagcttgggaagtcgtgaggcgccacgtcagactgtcctcaagaggccaatgtctgacgtggtgccgggggctactgtcggagatatgggctcgggggtatgtgaagtgaggggaatttaccttcccatcctgccgcgtggccctacagcttggccctacccccgcacctcgcggatcgcagaagcagccgggaggcctcgaggtgccacgtcatgcccctcgggccctcgcgccaccttgccccgaggccctcgcccaactgccatgtggcggggggagcgagcggggaggggacccaggctgaaccgctatcaatgcgcgaggcgccccaactgcccctcgccgcatttcatgcggcaggggcagacgtgcggtgccacccgactgacgcacggcagtcaggaatgaccggtctgtgaccggcctgtcaccggtcatgaccgattggacgggcggccgtgcccccacgtcgcctctgtatccggcggagtggaggtaggtatgacccatcccatcggagtgtcattcggagctccctccacgaaaggacgaccaccacaagtcttcacccatttatgagggaatgacaaggttgtcccccgtgtcaggcggggggcggcgctgggtcccgctcaaggacaagttacggcttagcttccgggcgaagggatagatcgtgatccggtcaaggtagggtgggttcccaccctgtagaagagtaggtagaggcggtgcatgtggtatccccttgagctataaaaggaggatcttgcccaccgagaaaggggac

SEQ ID NO: 68138 - DNA, 14098 bp, Oryza sativa
gctttgatgggtgatatcattttcatgttggtcattttgtctctatgccgactgcgtcagctaccatcaatggacaattgtgactacaacagaaggataagctacatgcttaggggctcatcaacacaagcatgaggattatattttcaatttggacttgttcaggatacattcaacatggattcatggtcatgagtcgatttctcaagctcaacgattggactattcattattccccacgagggccatcagctgagtgcttgcgccagtcgggattcaattatcacatctacttttgtattctccatgagggataattactcggatgagaagccactcaaatgagatacgcttgatctacatcaccgaggatatttatcactcaggatcatattaattggcgtattttatacgtcatattttaagggtatcggtagacatactttaggtctaggcctaatatgtctgtaatccatattttcaggtgtggcctgtcacgttcttttagggacttaggcatctttttgcttaggcaaaagtgcgagtgatcgagtgcccaataccttaaaatccttttataccacagttactcaactttttaggagttggtacaatgcattttaaaaggtgccgaacagtgaagctttatatggctgccccgctgactttttatatagtcaaggcactgtttggttttataaaacaattgattggatacaatatcgttgctttttgccgcgtaagtgtgcattttttattgaccaatattatggcttgggctgatcatatattatggtcatttttcaggcgattggtaaatcatttatgagtttatttactcggatgttacaccacatatgccatatatttccagatgtggtgaaaccatgtatcttttagggactcaagcacatttattaaagcagtgtgtgcatggtgtatgcccaaaaactttggaaatttatttattcacaacatacaagcttctttatagttgttttgctatgtgaattttcaatgatatagtcaactttagattgtacgcatcatattttacaaagcagtcggtatatcacttggatcatgttattcggggattcacactgcacatgctacatattaatatcaagtcaaatggttgactacaattatcaaatccattcggttggttggattatttactccttgactatatgtttagtttgttcaactaatcacatagtcggggggctccacctattaggtgcatatagtggatgcacctaagtctacatttaattatttttcagccctccacagtcttcagatttagtaaagttactagggagaccacggtgaagatgattgaagcactcggctttggagtaatctagttcgagagaagattatcttttcgattgggaaggtctcaggggctactgtggagattataggtaccccatacccacacagtatggttatctgactagttataggggatagcttatacctatggaatatgtaacggatcatgacttaggtattccgtttctttgtatattacggaacggcttaaagtcctggtttgataatattgcaaattagatttaggaaaccgataccgtattggttaaggtttctatcttgtaatcctgccctccatcctatataaggtgggcaggaggcctctaggggcagatattcataccccagatcgtcagatcaatacacacccagcggattcaaatcctcaaataagagtagggtactacctctcatcgagatagcctgaacctgtctaaatcctttgtctctgcatccatccatatttaggtctcatgcgctaccccctttatagtgctgaaatattgtttcgacatgtaatccattatcaaaaaaattctcaagttcttgcagtagatcacacatcgcacccccaccaccaagtttttctattactacggactacaactacgcaaattagtgactaacaacagaggacgagttcaagcgtgatcaagaggtgcttatacctttatctcttcatcctggggtacttgttaggaatagtcccacattacttatttaaggggagttaaaccaacttaaaagtaggagagcccctcaccactcgagttagattttgagatattgtaagacttcttcctgattgggccaatgtctcccggttttggccaacaagtggtatcaaagccaatctctagttcttgtgcacactcagcgtggtgtaagcccaaaatctagtggaccgcgggtgtgtcctgtatgtgcccatgtgtggggccggtctctattgcttgtgcacagtcagcgtggtgtaagcccaaagcctagtggaccgcgggtgtgagtcccgtatgtgcccgtgtgtggggccggtctctagtgcttgtgcacactcagtgtggtgtaagcccaaagcctagtggaccgcgggtgtgagtcccgtatgtacccgtgtgtggggtcgatcagtgctaagcggcaccaatgtgtgacgggggagattgttaggaatagtcccacattgattatttaggaggagttaaatcaacttaaaagtgagggagctcctcacctctcgagctagcatttgggggtgtaggaaggtttggggccaacagaactgtcctttccttcttcgcgatcctccggaaagtcaaactctgcacaaaagcaatccaacaatcagattataatctccaaatgaattaagaagcaagcggccaccaacagaccaactcaccaaccccggacaatcggaagatggaagtggttattagagcgaggcgagatcgggtcaaacactgcagttgtagtactttgttaattgattcgtggttatcaaatggttattaccggtccactgcccgaaatcatcacgcgattagattctcacgaggacgcaagagctatagataattggataaagtattagcaagtgacggttatatttaagcttgtgcgcgcgcgcaaggaaagcagcgggatggacattggcccaagatgctacagatcggaactatcgcagcaccgtcctcatcgccgcatccttcctaaatttatcaccatataataaaatttaaaacttcttaaattaatcatcataagcatgatgttttaatcgatacgtgcatcgcagcaccatcctcatcgccgcatccttcccaaatttataatcatataataaaatttaaaatttcttaaattaatcatcataattagcatgatgttttaatcgatacgtgcattgtgagagaatttatgcatggtgtattgattgatgtgacttaaattatcattggtcttggtgcataaatatatatatgatgattattttgagaataagagagtagttgggaactaacgtgcagtgcacgtaaaacggagcgactcattagtgcataattaattaagtattagctatttttaaaaaaatagattaaaatgatttttaaagtaactttcgtgtagaattttttaaaacacacactgtttaatagtttgagaagtgtgtgcgtgaaaaacgagagagtgagagaaagttaggaacttgcagcaacaaacgcgcgtaaatcagtagccattcactagtgcacatggttggcgctacatactgacactgccctcattggcttggatcttcctatgtcacgatttcctttattttatatgcttactctaccgctgtcaactaattaagtaattttacagttcctgtggcgttaccaaaaaaatacaatattttaaataatttttatgtaaaatttagttcctcttgatatctctggaatgaaaatttacattgaaagttttaatacctcttggtacctctcagtgattataaaatttctccaactaattactatatcccttcctgtttgctattatattagtgtcctctgctaatcaatttcccatgtttctcctatcgagtccaccaaagtctattacatctctcttttagtttgttgaggtcacctaggtttgcaacttccccaactccacgttggagttagcctttgtcatcatcctatcatcatcaccaacgtgccatcgcggttggtctatcatgtcatcagcttcccatcggaactagcaggtatcttcctcaatcactgaaggatcgaataacaatttgtgaaggtatttcagcatcattgtaactgtttccagatcagtggagagccgaaggataacttctgaaggcttatagtactaagagccatacaaaagtttatgaacactctcgagtccacttcactaagaacgtgatggaacttctcttcttcatcatcaaagagttgcatacttcaatgacatcacatcaagcaaagacattggatttatcttataatgtattgttaatatagagttcaaccttcaaatgaatgtatttagtatttagttgtacctttcaaatgcaatgttattacatacatgttgcatttgagtggagtgctaagcatattagttttagacatttcacgtcaattgtacatattttatatgcttattggaccttatcaatagcaacccaaagtccctctcttctttcccaaaattgacgcagaagaggctcatttgacaagtgcaacgggatgctgaagaaattttagtgagaagcaaatgcatggtggtgtctcatagtccaaatatttgcactaaaaattatgggatatatgttggtcaggctgcagtgttctctgaggatcacaaatatgaaaatttttttgatgggactcttgattcacgtatagatttcaatagaactacttccttggttttcctaggttttgagcagtgataaaaaaaatcattttcattataaacttgaaaatggaggcagttcattttggcgatttttcagaaattatttttaaacgtgatatccacagtaatttattttgatccaaaaatttccagaagtttgcacagataaattatatccaacattgtttatgtctgccacaatatggaatttaaactttatgtttttatttttatttctttgaaggcgctataaaattctttaatggacagtttcattatttgagtattaggatatgctgtcacatgcacaatatgtttgtgcaatcatgctgttattaccaatttggcaaaatttgctacaggatatcgaaaaatcatgtaattgactgggagataccacaaaagttgtgtaattggttgtaggacacccgaaataatattttattattttcgggtaaaaagaggtgagaaaattttcaaaatgacggaagtgcccccggcgtcgcaccatgtatcccgactcttcgccgtcctcccacaccctccccccccccttcgctcccaaagaaacacccgaaatccccaaagctaaccctaggcggcgacagggtggaggcggtttgtggtgacgtcaggcgaatggcgctggaagtggcctgttgaactagactcgacaacgatggcgatggagctgtgatttttgtcagcgggcaagcagcactggggatgatgtcactgaggaagaagtgagatgggaggaaagcgtcgctacgtctaacgagcacggaggttccaatgaagccattggacatgtattgggatcctaatggtaagtctcagtgcttttttgttacaatttaggattgaattgtatgatttttttagggttttttcacgtaggatggacgctagctcaacttgcagcgttgttgtttaggttggttcatatgttcagtttgatgagaacggtagaccagattttcatgtgtcttgtgaaattagttgggtactagacaaggataccatttgttgcaatgaccttatgaatgattttaatgacgaggtcaaacgtagttctcaacaacagataacaataactttttgggacaaaaatactaagaggtatgtgcagagatagttctttgcgctgcttgatacatttgatatgtactgggagatgaggaggctcactttggttgttgatatgagtgatgacctacgaaataggaccaagccttgtatggaacagggcaacatgaaaattttgccaaacgatgtttgcaaagccaaatttcattgcataaactcatatgttcacgattagggtacttcacaaacttcattgtttgggttctttggggtcctcaatgttcgcgctaccagttgtgtcacacacaatggacaattccccaagggcactcaccagtgcggtgacgcacgaccaaagatgaagccgagccatccatctttgatgcaccaccatcgtcgccacttccagcgccgctcgatcgcccggcacagccaccaccagccatcaccgaagccaccaccgccacctagagttaggtttggatagggacttcgggtgtgtgaggggagggggggagcgacgagtccaactcagtctaattcaaccggcagcttccagcgccgctcacccgccatcgccaccaaccacctccaccatcatcatcgccgcctaagtttaggtttggggatttctagtgtttgtgggagaagcgacgagtttgactgggtctagttcatctggaactagtcggggttaaatggtgtgacgccaatggcacttccgtcattttgaaatttctctctcctcttttttcctggaaataataaaatattgtctcggatatcctacagccaattatacaacttttatagtgtccatcggcagtgtcacgttctttacggtgtctcccagccaattacacgatttttggatatcctatagcaaattctgcctaccaattttagctctggaaagcatgccagatgctagtagtatttttctacgcctatacttgtcaagcactaaaaaaaattcttgggttatttaaaaggcaaccaagtaaactagccatttttctgtagtataccagagcttaaaagatgacggcaactcgatctactgtacgagtaaaagttcacctcctattcattttacatgacatggaagtatgaatataatgggaaattagatctacaatagaattcaattcgaattataaaaataaataacttgcaaagaaaaccaacaatataggttgcttcaactccatgtagtcaagaaatatcaacttccaaactaaaatctctttattttccatcatgcgggcacgttgttttagaagcacaacacaagactttggtactcgcggtagcatcttgaatgggaagacttatgtatgtctactaagttacaaatcacaccataaattcaagtcattatctaaagaaaactttaggttcacgtaccaaacgaaaactgaagatcaggtctgaactccaatacgtattcaagggtacacctcaattattgatagaaaacctaatattggcatgattttgtaggcactaaatccagctttggaaaatatattttcccattctttttcctctctctcaaccccatctatgtacatcatgtagagatcaaacaatacttgcgtctctttgaagatgtccctctgtgagcctgatccaatcaccatatttatgattatcacctttcctccagcatctctcgcaggtattgcttccttgcaccgtctaagtatcttgacacaatcatcatcaccaaaacaatgcaagacatactgaaacataaatatttagaagtataaaataaaagaagtttggaggctaactagatagctaacttgaagggaaaatgcatctctaaaaccctcgaactattataaattgtctagtcaaacctatgaagtttgtttttattaagccagatctgttaggtgcattcatctttgtacaaggtcttgaagttcatgtttgtttatttaagccttgcaaatatcttatttattatatattagtcaaattaattggtgtgaatatcttgttttttgtaaggaaatacttgaccttcaaccctggataattactcactttattgactcttcaaaagttgtgttttggtatagtatttatctttgctaattggaggctactcttgaacatttatcgatccttattaatcatagagatgaaaacattggggatttcacatattaattagaatactatatagtgcgaagactggattgagtatatgatcgaaatcgtggcaatatatagttgttaccatgataattgcactaacacaatgatttttttctggcgataggtccatttcctagtaatgtgagaaaggacattcaattattgataatcgttcatcttattaaaaatattatctaaatatcttttgtttttgttacaacttattttatactccatccatctatttttgataggcatatttttaaatctgaaaaaattacttttgataggcatatttcaatccaaccacctattctcttaatgactttcttgaatttaatatgtgactccccattctttcataaagatcggctatatgggcatcgagaaatgtaaatattaatgaatcgcttgtttacgaggaataactagtagcttgtttaaatggatgataagtagaattacctatccttagtcattgtgccaaaatgaaatatgactatcaaaaatacatggagcgagtatcattaatgtatacttctaaacttcataaaaatataaaatttttaaataaaatggatggttaaacccatgaaaatcaattgttttagacatttaaaaatggaggtagcatatagccacatactcaatacgattttccctaaaaaatatacttcctccatttcaggttataagattttataactttgattaaagttaaactgatttaagtttgactaagtttataaacaaatatagtagtatttacattaccaaattagttttaaactaataattaaatatatttttataataattttatattggttaaaaatattattattttttataaacttgatcaaatttaaaatagtttgacttttatcaaagtcaaaatatcttacgacttgaaatactaaataaagatgcgacacaccttgagtagtacggcatctgccggcgggacgtactcaaacatgtcgccggcgacgaaccgcacgtcgccggcgtccggtggcgccttcctgaccacttgcgggaggtccagcacgctgcacttgacatgggggaacgccgcggcgacggccgccgcggccgcgccatggccgccgccgacgtcgacgagggagccaatcccgcggaacacgtcgccgccgccctccctgaacacgacctccatgacgaagcggctgtccgcggccatggcgtcgttcaggacggcgccgtacgcggcgtcccttccggtcatctcccacctggggaagccgtgcgccatctcgaacagcgacatcgccgcgccgccgccggcggcgacaggctcctcctcttcctcctcgtcgtcgaccctgaaccacgcgtgcaggctgaagaacgggtgagagccgtggggtgcacgagaaaccttagcatgggagacatgtcgtgcccgccgccggcgccggcgacgaggaggcgggacgccggggtgagcgtgtacacggcctcgccggaggaggccggctgctgctgcttcatggcgaagatgccggagacggtgagcacgcgcatgaggcgccgaaggtgcgggaccttagcctggcggagcgcgacgtcggcgacgatgtcccggagcgtggcggcgccgccgcggcggtggatggcggcggggatgccgagctcggcggcgcacttgagcgccatggacttgatgtaggagaagaagtggtggtagagctggaggtggccctggagcaactcctcggtgctcatctcgtagctatgttgtgttgtgtgttcatgcatgcatcgctagctatgcaaacaagcgtatttataaggacagacagctctctagattagattagtagtattatgatttgtttaattcagttttagattggtatattttaagatggatggagtcgtatatcatgatagtcgaaaatagcgtgggacttatgatcaggtagtagtaccgagctgtgatcattggttcgaaattttggaaattttgaatttttggaccccaccggtaagcacatatcttccccgaagattttgttttttaaaatatttgtggatttgactgataatatattcaaatttaatcaaaatatgttaaaatttccccaaaaaaatcggttagaaaatatcaaaattcatgaattttaaaaattttggcagccacataaattttggtgactaccgaaattgcaaacactctctgtgattgaaacagacaaaaaaagtagctatcgccaaacaccctaattcatttttttaagggtaaattggaaccatgccattataattttgcaaagtttgagatatgccatcggtatctcaatgacatgtaacaccctaattcgtttttttaagggtaaattggaaccatgccattataattttgtaaagtttgcttgttgccggcagcgacacttaacctagtacctgttattatcagctacccaacgtgtatgacctggtaaaagaatattgtattgtatttgttgtttcttacaggctttcctcccacattatggtagcactaagaggacaattaacatgggtatggtcatcgtctcccaccaatttttaatttaagacaacatcatattttctgctgtgtacctgctcattgaccatgaactttaactttgacctggttccaaaacaccgtttaatttgttataagaatcatcgacagcaacaggtggttaacaaattttatcgaaattaaaaagtataaattaaactaacactttaaatttggcctgcatgattggttgaaacaaactactcatgaattaaatttgaagtatatggatttatatcattccggctagctagtaataaaatttattcgaatgaaatttgacctgcataatcggttcacatctctgtatttggaacctttgcttccagcttcgacatttctaattaacgccgtcacttctactgtataccgtcaacattcacgcgccgccaccttcatcaaggcttcagtagttcagttatgcccggaagttgttataaaaatccattcccaatcatgcgccgtgtacttaaaaaaaactaagttttagacattgacaaagcctcaaaatgcacattgttattattactttcttgatctatatatttataaaatataaaagagtagtaaaagtacaattgcagagaaaaatcgatgttaactctacatggataaatttcacgtattaataattaatgatctaaggtatgaaaaatcctgaccggatcagctaacgtttatgtgttgtactgaactttattacaatatttagggataaagaaattactccctccatctctgaataattatagttttagttagtaaagggcatgtcaagaataagactaaaagaccattatacatttcattaatatggaggaaaaataaggagggagagaaaacgaggaggagaaatgagtactattggtttactggataaaaatgaggagcaaaagatgcagtagtcttctctgaaattccaatttgaagacaagttctcatcctaaaactacacttatttatacaatgactagaatagtaaccatagaattaaatgagttatcacgtaggataaaatataacatgtcaagtcagtaattgaagaaagaggagtaaagcgtgtcttacattagatatggtttctacacaatattcacaatatattgacagagtagtagtattaaattcgaatataatcagcagtactatttgtgttggaaaagtagtagtttcttaataatttggaggatataaaaatcatggctagtttctttttattgtgattgtccttagagactgaggaagtggtaatctataatggattaaatacataatagtagtatgaatttataaaagattgtttagtttcgtaataatagaatatgcatatataatcctataatatttaatagttgaggacggagtaaataattatggcaagtagcagccatcttgaccacatcgtcacctgaattcaagattatgtcgatgtccatttaactacgcctttttaattttcttcatgtccatgtgtcgacatctctgttttggaaccttgcttccagcattgacatttctaacgccgtcatttccactgcataccgtcaacattcaagcgcagccaccttcgtcaagggtccagttatgccagatggtcattataaaaatccattcccaatcttgtgccttggatttaaaaaaataacattttgaacattaacctagtctccaatgcatatttttattattactttctcaatgtgaacggaatttaagaaatagaagtttttactgtaaagctatatacacagagaatagatcaaaactattcctattctacgactatcatatactctcttttattcattctaatttattataccaatcaaaataaaatttagccctaaaatatcttgtggcatgtaacagatgggccacttcggcctatgtgttgcatgtacgtaacctaaacagccatctacccccgcaccttatgacctaacaaacttctcttctcgctagtgttgttgggtctcacgtgtcaagttggtggtggtggtggcagactcactaccaccattgttattggcttttaaagtagtatagataataatatcaaaaatataatttggtaaaatagtttcacatattaaattctaatatattttattaatcaatgatgtaagattttaagttttgattgcatgaattctaggttgtcctttagagaacaaagataaagggtggagcattgggtaggtcgatgttaggcgcgagccatataaaaatcgctgggagtactctcacctgtccagcattgccaagagcccgaaagcccaagaaaccatcaccatggacatgacgcaaacaaccgagtgggacaagagcataagctgtcaagggggagaaatcacctccttgcctcacccgcctctctgccactgtgccgaagaagccgagaggattcagatcctggtcattttaaaaaaaattattttacaaaatgaccactgaaaaactaattctaaaaaaaattcttttttgcgcatcggagtgcctggtaccgtcgtttaataaggcggtgccatcacctctcacgctgtccacatgccaacgtggcaccatgggggccaaccgacgttgatatggcggaaggagggcgccacgttagcatcggctggcccccgtattgtcacggtagcacgcagaggacactagaggtgatggcgccgctatgttggacgatggtgccaggcactccggcaaaaaaaaaaatcatttctagaataagtttttctagaggtttttttataaaataagttttaaaaaggactaaaatttaaaaaaatccagcgggatctagttgtgttgttcgggaaattagaaggggctctttgcagaattattcttgcatcagagtccgcacctaatcgtcaccacgctatatcagcactcagatcatgtcgtggttggtgtggattagtaagaccctatttaaatgggacttagatgggacttttaagtccctatcacatcggatgtttggacactaattataaatattaaacatagactattaataaaattcatccataattttggactaattcgcgagacgaatctattgagcctaattaatccatgattagcctatgtgatgctatagtaaacattctctaattatggattaattaggtttaaaaaatttatctcgcaaattaactttcatttatgtaattagttttgtatgtagtctatatttaatactctaaattagtgtctaaatacagagactaaagttaagtccctagatccaaacaccacctaatggatactgaatcgagtttaggggtttaagagttcaagcacttagatgacccatttacataaatatagaatttgtgtgtgcacttcactcttattatgacaccattgactttttacacaatatttaaccgttcgtattattaaaaaatatagtatgaatatgtaaaggtatgggttaatattatattttatttgatggtaaaacaagtgacccccaaaata

SEQ ID NO: 68139 - DNA, 2447 bp, Oryza sativa
  unsure (1)..(2447): unsure at all n locations
gtattattttttttaaacgttgacttgttggatctcactagcatcccataatatcataatattaagagaacattattgtgtacttgtgtactcggtcccgccatgaacaccctcctcctttttcgttcttccttcgctactaatatagataagcgaaaacaattttaatcatctcatatggttccaacttcaaaactgtatgaaagatcctgattattgtttatgttttctgtaccgatcgttttattctaatattctaatatctctatccaaggcaagtagcagccttctagtgcttaaccatattagagtaagttttgttgaggtgatggtcacctctaattttatccatatcattttctagtagcatatacaacacattgcctctaatacacttatcccattatttatttttacttaatctattggtcactttctcttatcatctatctaggagcagtttgtgtaaaggttgctcattgcatgatcagtggctctttttctttctccccattgctctcttttccacattatcatatattatcctatttctttcatcctaaaatattagacataactattttttctcatatctcaaaatataacataagacgtgcatgcatacatacaaacattaacttaactatcacctcttgatattttaaatttagtttattttaaatcctctacgatcaaaccctcaatctcattgcttgcatctatggacatgatccaactgaggaggtgattaagttttttcttagttttttattatcagttactccctctgtcccaaaatataagcatttttagctatgaatctggacagccatgtgtccagatttatagccaaaagttgttatattttgggacggaggtagtattaagctttataatttgggatggagagagtatatggcatttggaccaagagctctctcatcacctgaatattctctccctctcaatataaataaatgtagttttagaagtaaggggagaaattaagagggagagaaaattacctaggtccccctagtgaacgagaagggtaggtagcgagtggatagttgatgtatgtatgtatgtatgaagagaaatttaaattagatatgattgatgggataaatagtactacatgatttacttattttgaaacaaaatttgaatataagaaatatatacttatttttggactttggggaagaggtagtatttttaaaaaaaaaaaaaaagtggatgtcatttgatacgctttttaattttcttcacgtgtacagagtacagactacagtgcacggcggccttaggacgttcgtcagttgtatccaatatttatttcgccgatcgtgacaaatacattgttttgcacaacaagataacgtttcaaatttagttttgatcactaattttaaacagtggtctgcatggcggctttcccatgtttgttgggaataaaagcatcatcatgccaaacattggcagccaaagttgggcttaaaaattaaaacatgtagtagtacatcacccaacaggtttattactactcgctcctcggtttgatttctcccgagttgattattcaaagctcccaaatactcgctcctcggtttgatttctcccagagttgattaccgattcaaagctcccaaatgttgcgttcatatttaacttctttttctgccttcggcttgcatgtcaaatcccattactcactcatattaactcggactcgctcacatcatcaggttgtttatcagacaacaggagccattgtgttaacacataattcagacaatacaacaggagggagccaaacgccaagataaataaacagatgatactataactcgaagaaaaccaattattcttttttttagttacttgctactatgccccctggctacagagtaaggtatacatttgcgaacaagcaaaatttgtggttaacacatactgctttgtaacgacattagcatgcagcttgagttcacttgccactgaaagaaaaaaaaaagctatgggtgtatgatctggcaagtttttttgtgctctatacaactgcagaaaatatttaataaaagaatcaaaaatgaaaattgatgggagccgtgaccgtgatcatggcagcaagatgccacctcttgctcaaaatggagattccagtggctgtaccaagacagatgatgcatacaaaaaggtttcctgcacctgtcgacgagctgcgttgtcacaccccggatcctcggctctgatcagaaacaattgctggccatgtatggattggcaattttgcgcacagaacaaacatcaacttctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68140 - DNA, 4846 bp, Oryza sativa
taaatgctgtgtactgcaaaacttaatccctatattattattcccttgtacctcccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctcttttcttcttcccctaatgctatttgcaaaaggtttacccttttcttcctccttcaaatttcaactagtactagatggtcaggtcagtgatgaagaagacatcgtcagttgttcgccgaagctccggaagactgcaggatctgctagtgaagtggaggaagcagtgaagccagctgtgaagcaggagtgaagatcttggaaaacccgtcgcagaacctaagccaccctatagggtagtgttgttagtcgtgtgttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcagaagtcaggacattggtacctcaagctcccgagtgaatgaaacaccagacaccagttgtgtggcagtggtccaacacctgattaaccagaaccaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagtgaagattcagatcaagtctcctcagatgatgaagatgaaatggaacgtaaggcatgctctcgttggggagaagtcggtcatgttgccagcttgtgtgccactacctgctttcattgtgaggaagaccatccacccggtgaatgccccatgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcctccatgcatcccgaagcagtcctatagcccgcgttgcaacagctccaattccaatgagtgcactaccacaaggtgtcgatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaaggagggcattactccaaaaactgtccccaaccaaggcaaaatcgacctccacattaccgccaatttacacgaagcagacattccaaccgtattgtggtcactggagcaaacgccgtacccgtaaggcctcgtgttaatcagaacccatagcagaaacaatgcaccaatgctcctcctgctgcacctgactcggcaataaaccatagcaaccactctctgcatcgacagcctcagcgaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcaccgaaccaatcaaggatgcagtcactagaacaatgccagctatatctctccagaatcaaaatgagcagccatgtttgtggttttcagttcactacttatcatggtgtaatcgaaagtttgcagcaatcatgtaattcataaatataatcatgactgtaaacagtgagcttgctatgtttagagatgattcatgttgaggatacaatgtatcgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagccaacgagacagtagttgaggataggagttcggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatatggcagaagaacaatttggatgccccccatctcgaggaagcactaaggatgatcatcggcaattaaaccctagtggtatagatacaaatagcaggcaatgtatttccctgaaggtagtcagtacagctttttgacgaaccacatcaaggtttcaccgaaaggcagcaagccaaaggacctcatcgtccccagaagcgtccgcaatccacattaaagaataccacctgatagagataggccgaaagatgattgataaaaagagattggcaaagatgttctctagcatgaaagaagtaggccgaaaggtgattgataaacagaaacatgttctgcatcgctcacggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaagtgcaagtaccggttaccaggcaatgccatgacttgggagatgatccaatgggaaagaacacatcaaggttaaaggtgtaaaggaatacgttgaatgctaaatgatgacaacatgaagagaatagcggaaagtaaactgaacataaagtaagtgaatctgcgttgcttgttcgtgggagctattcccagttatgaatcaggtgatatgttcgaagatagtctacagaggtcagacaacgaagcttcagatttggcaggataacgattagacaataacaaatccagcagtaaagccatttgggaagacgtcaaagtatatcaagtaggataagttggctctcttgggaagcataattcaaaggtaaagttatcgacccttgcatcaaatagcagaagtagctatcacccggagaccagggaagctaatatgaggcagttggtggcgagttcgaagcaaatgacaagcatggtatcctagtaatgacaagcaggttacgacgcatgacatgaagttgataacttgtccgaggttgactccgaagatatgaatcatgagaagttctggaacggaagcatcactgcactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaagattttataa

SEQ ID NO: 68141 - DNA, 8014 bp, Oryza sativa
cgacggcaacggcgaggggggagaggtcctgacggcggcggcggcgtggggcggggcgactttggggaggagccggcggtggcggggacgacggcgatggcgacttgggaaattttggcagcctggcggctagggtttcgcgggagccgggacttagaaaattttggctccccgcgctccctatatataggcgcagatcatcgcatgcgggcggcttaagggaccgcatggaaaaatatctttccatgcggtcgacataagccggccgcatgcgaaaaagatctttccatgcgggctgttaagccggccgcatgcgaaaaagatctttccatgcgggctgttaagccggccgcatgcgaaaaagatctttccatgcgggctgttaagccagccgcatagaaagatctttttaccaaaaaaactcatattttttttcctctataagtaaactgtccatatatatttttttcccaatatttcgccacaattatacattccaaatgtttttggcactaagaaaactcatgaaaattgctcaaaactcgtaatcaaatgttacatgctaatgattacaacataagggggacctaaattcatgcacgtacatttgctaatgattacaacataagggggacctaaattcatgcacgtacatttggaatacaatgagaactaaaggttacgaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacctgagccacacgttctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccatatttcttgaatggtcccataatacgacctcttttctccactcgtgtcaatcgcttcgacacggatcccactgttttgtgaggtgcttttcatgtccttcgtagtcgtactcaaggtaaatccattgatgtcgtaaccttgccatgaattgacaatacttgaaggcccacatgccaatctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaatactttttgcgaaattcgattgaaaaagtagcacaactttgttataaccacctttgtatggactggtttgactgcccttatagcaattggtaggaacactgttagcaacctatgacagtcatgcgcattgtatcccgaaatggacaaatcctttattgatactagcttcctgatgttcgatgcgaaaccagtaggcactctaaccccttgtaaacatttacagaaggcttttttctcatcaagtgtcaacgagtaacaagcaggaggaatctcggtcttcccatttggcagcagtactgtgtgaaggggatgccgtgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaagattttataaaaagaaaaaccctaaaagaagtcttctttccccccccttcccttcttgggccggctcggcccacttccctctccctctctctcctctcccgcggcccatcggctccccgcgcgcgcgcgcgccgctgacaggcgggcccgcccgccactctcgctgacaggtgggacccacctgtcatcgcctacctcccgccgcgccgccgccgcgcccgtgccctagcgccgccgccgccgcagattgcgccgcatcccgccgtccccgcgcgcattaaagagaggggaattactccccgcgtttccctctcccgattccccctctttcccctctctctctccctcggatccgtttggaatcgttcccgcaaagttcgccggcgctttcaatggagccgagatctccgcgcgcggtttcctctctctccggccgcgctctccccctctcggcgctatataattgctccccgtgcctctctcctccgtttccgccgttcgccgcttgctctcgccgtcggtttcgtgcccgcgacgttctcctctccctccgccgtcgccgccgaactccgtttcgccgccgtcgtcgctccggtcctcctcccgactcgcgccacctccttcggcttcgccgagtggttgccgaccccgtccgccgctccgcttcgcccgccgaccgccggagcaccgtcgtcatcgtcatcccgagccgcgccgccgtcttcctccgctccgtccgccgtttccaccgccttcgccgtcttggggtgagccgaagaccgccgttcgccttccccctttcctcctctctctcgggtgccactccgccgcgccgttggtcgccggcggcgaccatcggggcgcgggtgcgcgccactcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgccctctccctcggctgacgcaataaatgagtttttaattaaaagttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagatgaaacaaaacctcaactagtgggtactctattcatggttccactagtatgaatttaggtagatgcttcgctgattaattagtcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgggctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagacgtgtcttgtgggtaaagatgtacacctctgatcagagtaaatctattcgaatagccgagccctcggatatgggcaagcctagcaatgtacccaagtcagtgttataattcttaaaatttgctcaacaactaaaatgtggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatgccgtatggacaaatctacaaggtcgttacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatatcagacatccagtcttccctttaatctgcccagataatgaaaagtttgcaggtaggtcattgatggtaacgaatatgattgcacgtagattgaagtgctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcgagcgtcggcgggatgtcgaatcataccatctattttccggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccatttcccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcttgccaattctccaatcctcgtgacctgcccgctagcacctctggttcaacatggcgtagcatatcctctaaatcaaaaccaccatcgaaatcatcactatcggtggaaacatcgacaatcattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaactagtatgtacaattgattacatgcaaaatttgcccatcaaaacatatattttgaagctagattttgcaaaaaatagttggaacaaaccttgtcaaaatattaaaaaaactccactttccaccaacgaaatataacaaaaatggagccaaatgaagcaagatagagagttcttcacctttcgtatagagttcaagtaaaaatttcgagttgaaaacctcccccctaattggtgcttgctttaggagagagaaagcttcgttttcaaatggtcaagctcgggcctggaggagcatatatggccgatcatcgcatgcggtcccttaagccagccgcatgcgaaaatagacctattatcgcatgcggctgtcttaaccagccgcatgcgataatggatcttcgcatgcggctaatcaacccgccccgggggggcggtttttgcaggcgccgccacaagcggcccgcatggaacctaccgaccccctcgtacagaaaaacgatttttgtagtagtgtcgtgaatggatatattggaaatggtacacatttttaatctcaccaccatattactttgaattgtttttgaagaaccagaaagtttaagacccaaaccatgatccaaacttcgaaaatgttcaaaaatctcattcttagtaaccatgatgataaccgaagaatatctataaaatcgtc

SEQ ID NO: 68142 - DNA, 1664 bp, Oryza sativa
  unsure (1)..(1664): unsure at all n locations
gggtggcggcagctcggcttcatgcttccccaggccaggcggcggcagcncggccggcactcccgtcggngacgcccctcacccgcttggatctagaggcggtgcctctcactcgcctggatccggcggtgggtggtggcgatgcggccgggagtggcggtgggctcgagagctggtcgcggcggaggtgggctcaggagtggcggaggcgggctcaggagcggtggcggagcggaggcgagggaacggctgggagcggcagcgggcggcgtgcatgcttggaaggcggtgatggcgacagcgccgacaaggagggcggcagctagggttaggttttggattttatttgttttcagttttttatttttgcgtgtaggcaacataagcacccgcacgcaataatcagattttgcgtgcgggtgcatcactcgcacgaaaaaaaaaaacagatttttgcatatccttcggtgcagacggacgggatatctgcatgcgaaaacaccttttcgaccgcacggaaaaatcgtttttgtattagtgaataaccaacacgtaccattttcctccaacaaattacacattagctggaacaacagcgtccatatataaaagctatcctggtgcatccgtatgtcatcacaaaaataataggagcatttgatgaagcaactatcttagcatgacgacacggtgaatagaccaaatcaagatctttcttaatttttggcaaatcacgaataagatctgaatcactaatcctatgagatgataaaaacaatatatccaagtttacaatgccaaaacatcatctctttagagattttagcaactatatacactatctcagataaaacaaagactttcaaaatcaattttagaaactctcccatagcaagaaattttctcccatagtgagaaataccgaacactgaatctccagacgaatcaaagtatttttcttcccgtttcttaaagtgaatctcatacttttcatcaacaactagcttataatgtcgcgtcttcgcgcgactctaaccgccctccgatttgccaaaactttcaatgtctctaaagagttaaaaattaaaccatgaacatagggtgtacttcaattctggaactgcacaccatcggtagtaaagagtaagaacttagcactcttgcataatcatttctatcaaaaggagacggaaaaaagcaacaaagatcaggttccacgtggttttgaattgtcatgcaagagtagtaactgatagcatctggatatcatgctgcttgaaataatctgatggtagctacagtcacagtttatttttggtaatttgaattgtacagcacccactgtaataactttatccttgtatgtacaacagttccatttatttttttaaaaaagattaaaagtgattacatcctaattccgtctgttgccttgaacatttcactaaaatcagcaatcccgtcctcggaaaaacacccggtttcaccttgaatcatacatgacagagcatagtcccaaggacgtcctggtattaacatataagtcagtcaacaaatcaaaaagtttgtggctcttcaataatttgagaaacaaactatgcatgaaggcaactaactttaaaaccaatttgagaatgtcacaacattttccttgtaagatcatt

SEQ ID NO: 68143 - DNA, 3595 bp, Oryza sativa
gagacttttacagtgcttgggaggtatctaggataccttttaaactattaaagatccaccgttgattactaaatattaatctaggaatagaaataacataaggatgggcaatttagtaattgttttcagttataacaacttctaacttctccctgattgttttcagttataattcaatcgccattgctgctcgcgtattacttccgttcactaattctcatctcttgctgctcctgctgcttacattatagtcacttattaatttcatagggtatcacatcctctagcctttggaaggcaattttcttctctgtcttttggatgacctgaggatgccggtgtggatcagtgtcttaattaaattcaccaatgaactactaaaactttatataatatgacaccacccgctttatggacatcaatatttataacaaaataaatctgtaatcgatcaaaatgtcatgtaatcgatgctatgaacttcatactacgtacagaacaaactcgagatcgaagaaaccgcatgaagaacttctgttactgtgatttgcctttcatagattgatttaaataccaatggagacaattacctatctaccctcccgccaaatctctgttagtacctggcccacttttgtgcacacacatgcatgtactgatcacacatgtacacacgtacatgtatcctgctacagtacctcgtgtactgtaacacatcttttcttcttccagttttctacctccaatttccttcgcgaacaccgacgcttgcacgcacacctcgtgaagcccgttgtgaagatctctcccacacgatgtccatccaccgtatgccatctcgtatccggtatctttaaccgtctggacctttcaactcctccctgagtctagtcccgatccccaccattgaccgaagttgccctccaagaatcctgactctagtcaccttctcacatggtatcccgaccgcactagacctctgctcctccctaagcatagtcccggtcctcaccattgaccaaggctgacctcaagtcacctgcacacaatcagacaaaacaaccgtttctgggcacagatatcacaacctgacccacattagtcacacgcactcacaccaacatccacacattttttcaaactaattcatcgattaaatcattttacaaagccaattgttcatcacaaatattaatcatgacaatgatttcacaacgactactttattagactcgaaaaccaacttaaatctgtctctagtcagacgggagccactaacaaaattcctgttgatagtagggacatgttgcacattcttcagctgtacgatctttcccgaagtaacttcagatctaccgtgccaacaccatgaatagaagcatgtgacccattccccattaggacggtggaatcccgtgcgacttgataagaagagaacaacgaaatatcagcacaaacatgtacattggcccctgtatcaatccaccaattagtagactgattaactgaaaaaatagtaggtaaattaccataagttgtttttttatttgtatttgccctttagttaaaattttcaatttcattaagaaaaactaaatagaaaaatggaaaatgaaaatggatagaattcctacttttttcttcaaatccaaaaactttctcatttttttatacataggtcatcgattcggcattggataaaaaagggcagggtgccccttctagtaaatagttcaaaccattttatcgatatgagtgttctatatcagataaattctacattagctatttcctgtttaaagcatttggtactaatactaatatagttgtacaaagagtacccccttttgcctagacttcaagcagtttagctttaaccgtgttaatggtctcatattattggtctatagagaatcaaagttgatttgatttaccaataggtcacgaaatgctatggatctttcatatgatttctacatttattcagaagtaattcgtcgagatctccttctctagtgttaccaatggtcacattagcagatttagaagtctaccctgcaggtgctttcatccccttgcgttgtggacacttcctggccaaatgaccaggcaagccacacacaaagcaagttctctcatcctggttcggattgttgttgttcttcttttgcttcttgaagttggtggtctgctgagctttgtatttccccttgctcttgttctgggccttgtgcacaacattggcactggactgcccaccatcgcccttaggtgcgaagtctttttcatgagctttctcctcaacatcaagagacgctatcaacccctcaacggtgtattcctgtctgttgtgtttgagtgcagtatacgagttctttagccatggtctgtctcatgagcctgcttaactacagaacggttgtcagccatcctgtagtcatgaaactgctccacgagttctttagccatggtctgtatctcatgagcctgctcaactacaaaacggttgtcagccatcctgtagtcatgaaactgctccacgagttctttagccatggtctgtatctcatgagcctactcaactacagaacggttgacactgtagtcatgagactgctacataacgtacagatcattgctagcatcagtagcaccgaatttagtattcagtgcatcccacatcccacaactccttagcgtcatatgcatatacacctcgaccagacaatcgccaagaacgctaagaatgtatcccataaagagagtagtagcctcatctacatccgcgcaagggtaaggaaccaatttttcggaccattcgaatgtacgtcgtgcacgtgcgccgcctgccctgcccagcaaagcgaggcgagcaagtacgcccgtgtgttccccctcttctctccacctcacatgcttcaagtggctaggagggcgtcctcccttttaaggaggtccccctctcctagaataatcaatatggtactaaactccccatgcatgccatcccatgaggtgggcttttgtgaattttcaaataattaatcttcgagtgggctaaaacccatctattaattccaacaattcctcctccccaagcagctacgtaaggaaccctagaccctcctcatcctccgtgctacgtgggttcaaggtccctcgctcccaaactgcctcctcgcaccacctcctctctctactacgctagtgaactccggtcactcctcttccatcgactggagcagcgccggaccacgccacgacttcccccggtgtcgcagccgcctcctattcccggccctaccttcgttactctcctggagaccgccggaaacccgtactcgcattttcctcctctgattgcccctcacgtctcacggagtgccgtctcgctgcacagtcgctaccgtcggcatcaccatgttgtcctcctcctcgtctgcatctccttgctactcggagaccccccggaacactaccgcgacaccgtcgccttgctccggccgtcgtcaaggccgcagcgccaagccagtcatcgtccacctcttcaccaaacctgaagatcgccagagccattccctcgtcgttggtccgt

SEQ ID NO: 68144 - DNA, 2493 bp, Oryza sativa
gtataaatgagattgaaggggccaacccagtgtttcctcaggattcgaagcgaaacagggagagtgaggagacacacattctgaaattctgatgatatatacatgcatggcatcacccaattaaccatatcgacatgtttgattcaaaccttctgtgattgatgcggttaccgttcatgtagttttggatcttgcagccaccactcaaagcactgctcgtaggtatgagtgggattgggaggcatacgagaatgcagcagaaccgtggctttgagatgttcttcaggactgtacggagctactaccagttctatagatggcagatggcatgtatatatgatgccagcacggaacaacgtcggagaatgttggactcatgactattcaccttgcggcctgcgagttacccgtgctatcctcattgtatgctcaactagattttggacctcaactagagcatagaccaactttatctgattatctgaagcgttcaccaaaatttactgtgcttgagttacgaacaaccttccagagcaggttttagtaaattattgaagtgttgtgttattgatgcattgtcgtgctaaggttaagctcgactccaagctcgaaattgcgtagccttaattaacaataattcttgtgaggcatgttattgcctgttagtgacttgtgatgtggtcgtatatatgaattgtcattttttttcccccggaagtatcacatggatgtagtagagaagtgatagagttaacttattgaactataaaaatatttcagaaataatatttttctatcatttgtaatctctctgttttgaaatgtatgacatttttattggcttttagacatgacgttagacaatttactataataaaattttgaataagacaattcatcttatttaaaatttagtgcaaatataaattaaaaaacatgtaagtcatgcctaaactacctttaatgataatattgtgataacaaaataagttatacttacatacagtgctactacatgatcccaaataagtgacacgcacatcctacgtctcaaaaatggcatcttcaaaaaggggcggctgatgggcgggtgaccgctctaggctatcaccccccatcaccctataagctactctctcccttcctcctcccctcttctattcctactacaccatacatttttaaaaaataaaaaaaataaagttggaaaaatttatgtatagaaatactatattaaaaaaatatttgaattcaaattcaaatttgaaatgggtatgtaaacttttgacttataaattttgggtctataaactaatatttgaattcaaattcaaatttgaatcgggtatgtaaacttttgacttataaactttgggtctataaactttaggtgtatagactttagatgcatagaaatactatatataaaaatatttgaattcaaattcaaatttgaaatcgggtatataaacttttgacttataaactttgggtctataaactttaggtgtataaactttagatgtatagaaatacaatatataaaaaatatttgaatttaaattcaaatttgaataggatatataaagttttgacttacaaactttgggtctctaaactttagatgcgtaaacttgagatgtacaaactttaggtgtataaatttactaaaataggaaaataatacggtgccgaaaaaggaaaccacatgaaaggggggaccgtgctaggggcgatcgatcgccccttagcctttccgtcttcaaaaggcactccggtggatatgcggcacttcatggcggcgctctgatgggagctcattgccatccagaaagatggtgactctattgtcaccctgtcagtcgatccactctgtctcgtgctactgaggtcgagctggtatttattacgaacatggaataatctacaaacacacagataccattgtagccttcatccaagagtatttcaggtgatcgtatccacaagaaacgtgtgtgaactagttttcttattcgattacccaagaacacaagataaatggtaggtgagcatagagaggaactcttatagattaggcaaaactctatcaattgcttcgggcacttgcttacccatgtctgccaaaaggttccggtctacagctctataatgtacccgaacgaggaggattacgaaggacggacagggatatcaccacctgccgcctaccactacaacccgtgtagcacacaacaaagaaatgtaatatctagcccatacactacatctctgctattaattactaccccaatctcggtaccaaccttatggaagatcaaggtactcttgtaaacagagcgataaacccgcaatgatgagaatatatcttacttaaataataagagtaaatatcataaataagtcacaaacacttacttatatgaagacaagcatccgtcgaggtacaaacttggaggagaatgtcgacagcccgacagggctgcaggaatt

SEQ ID NO: 68145 - DNA, 2962 bp, Oryza sativa
aagatcgtccggacatcgttttctcccaagttgactccagatccatcactagcaacattcgcctgaggcatcaagacaacctacatatgcattaaccaagaaaccatatccgagcacaagttcttactaatttgactaattgttagcaaacaacattactacatacgcatagtatccatctagaagtcataaacatgaattatccaaggatattcaaagaatcaaccctaaaccgaaaccgacacaatgtcggccggtcagaccgtgggctggccggtcttaccactcagtacacgccggtctgaccggatccaatccaatagcaatccttgttcaacacctgaaaagtccaatcatctccaagaaccattcgctaataatctccaaatatatatcaaaaccaataatctcatatgctaattgttcatcacaatataatattcaaacacactttgattttacaattttcatggtagatgtcgaattcatcataagaaaatttatgtgactaatttgtgacgaattcatgttcgtaaaaaacggagcatcacattagtttcctcacgacgaattggcaaatttcatcacagaacttgttccatccgtgacaaactaagttcgtcgtagaacctatctttttatgatgaaatttaatgtcatagaatttttattgttcatagttaagcctagataccatcatattaaactgctaaccggcgtgacatggctaaatccacatcgcattgtccatgttggcagatgatgaggctcctatagtaggatccggtgtgtcatgatcggtatccatgtgttgttttactattgagactcgcgtgtgtccgatgtgtgtcatgagattgggtttatccacgttgtcgatggagttataggcacccgtcatgtgtgcaaacatggtgttggttaaaaagaaaacaaatatggtattgaagaggtactaaaattaatttttagggaaaaattatggtatcagtgactggccggtgtggtgctcatagatatttctccttttccggatatgtatcatattcatagatggttctatagaaaagcgaccgggttaacttattctattataggacctcattttttggcttatatacttatgcttatcagctaaaatttaaattttcaatcttaaatttgaaactgatttgagattttttcatcgaagtttatttttcagcatttgcttttagatggataagttcacatatataaaagttttattcatagatcattttttgtttgcaaatatgccatttcgcttattccacgaatattttagaaagtcctttttatgtctgatgtactaattaacacatttgttggttcagctttcatataggattcgtttttgactgcaaataatatctgcatgtatgctatacaacattgtcgatatatatgtgccacatgtgctttctctccctcttaagtgttctatgcttactaaaatctgttgccttattcttgaccacaatttcctttgggcttctcatgaaatataaatccttgtaccaacacaataataaatacttcaaataattgggtgtatggctggtggtccagctatagatggccaaaaggctcgaggcccgacggctcagcccatggcacggcattttggcctggcccaagcacggcacggcccgacggaggtcgggcccgtgtcggcccggcccgaccaccgagccgtgcctgggcccctccaacggcacgttgggctggcccagcacgaccaggccggcccggcacgatgggccggcagccaaccccgatacacaaataaattgggtagtaaaaatagacatattatatgtcctggacgaaagaatagggatgtaaaatagacttattttatctatacatatgtcagccgaaagaggagcgacggaaaatagacttattttagctatacatatgtcagcccaaagaggagggatggaaaatagacttattttagctgtacatatgtaatagcccaataaggaggacgaaaaatagacttatttttaaaaaggcccgatgggccaccggcctttcgtgccggcacgacacggcccgacagctggtgggccgtgcctgggcatgaggtgcagcccatgggccggcacggcccgacacgaagtgccgatcgggccgtgccggcctgatggctggtggaccgtgcccagccgtgctgggcgggccttttggccatctataggtccagccaggcgaggtcaagcttacatgcaaaatatacattccatataaatggggagagacaggtaactcaggtggccatatacttgcatccaaaatcctaatgaaagccagctgccaaacctcgaggaaagcttgaagtggatttgtagtagcgtcgtgcaattgacagaacattcagcttgacatatcttatcttttattatccgcagttggagcaatgagatcgatcgatctcactaattccagcacagctagctagggttaggaggcatcagagaacacaacaatattgtgctgctcatgaatgtttgttctaccagacttcaaagacatgggaaagggcctcttcagacccacgtaagagcacatagatggttgccgatgaagcatatgcaaatattgccctggggctggtcttggctgagaccatcggctggctcgtggttggggcgatgcattaggaaagtggcagtaatatgggtgagatcgatcgaagacacatgtgggtataactccgatagaggaacgcgaggctctgattgcatgtgtcgccaccacgaccaacacggtaggcgcgcgtgtgcgatggtgcgcgtactctggtcttcaatctatgaaattaagctgcctcgactttgttattcacaaggaacccgacctcggcacagagctgatgagtcagtctgagtcaataactaatactacctccgttttttaatagatgacgccgttg

SEQ ID NO: 68146 - DNA, 1089 bp, Oryza sativa
agtgataaaacaactcataacaaaataaattataattacataaattttttaaataagacgaatggttaaacatgtgagaaaaagtcaacggcttcatctattaaaaaaatggagggagtatgttcattgggtattggtgcatgcaatttaggtaattgcatgttgtgttcgcccagtagtttgcagagaataatttcacatcaagagttcattgttaaggttaacaacaattgacaacctatacgtaaacagaatgttaagtcactactataaaacctcttataggtgtcagctcaaccggcactgaaccataacctttaaacagctataggtgctagttataaaggaaaaaaccgacattaatactagaggtgtcattttttttttatttttaataaaccagtacccaaccaacagagccagctgaaccggagatctttatagccagccccgctcacaccaatacatccttatccacatccttctcttctcccatcctcctctcctccaccttccacatccatctcccatcctcctcctccacatgcaccagcggcgtcggcgtcggcggcggcatctcgcaccttccccttctcctcgttgccgcggctgcagtacatctaatacgtcttggaccggcaccgtcagtgaactacgtactagtaccgtaggactgggaggcattacagcatcaccatctcatcgaatgatttctcaatcagtgcttgcacaagtttgttgcgcacgatgtgtctgaccctatgtgctaacatgcaaaaaattggagagtcgggaaggagattgcagtaaccgtgttaggggacatgggttaattactgcttttgtacaatatccatgcatggggccttgaagtagtttgatggcatcgtacagattattacaacctctacgaaattgcaggttggatttgattctcaaaaatcctatttcaccaactagtgcggatttcaccattgttagaatggccccagtggtttatattaattctacagttgatcattcctaggcttgatttgagctccaaacgattagctagctagagtttcgtaacgtttggataaatgcttt

SEQ ID NO: 68147 - DNA, 1433 bp, Oryza sativa
agggaatgggccgagccggcccaagagggaaagggggggggaaacagacttcttttagggttttctttttataaaacctttttaactttgtttatttcttttcaattattatttgtgctctgaaaattccactaaaatttatttaagcattttaggcttttaggaaatatacaaaaatcctccaagccccatttgacttttatctttgcacattttaattgttggaggctttcacattaattttaattattctttgcacaatttcgaggatgaattttagagtcgatttgggtcgcgacacttcttcattccagtactggctgcttccctccgcgattgcatcgtacaatatctgttcctcatcgcggtcagccatctgttcatacaagaaacatctgctaagtcacgagacatttatgttttaacaatctaagtcatgtatgctaagtgtaaatgtcgtacattacaaccatacacaaccttacgtgctaagtctaattacaaatcgtgatataagctaagtctaggtgacgtatattacacaaccctagctagtaaataattacatactaagtctaattacaaataaagtaatcttatattaaaactcaaataatattacatgctaagactaaaatagtcatctatgctaagtgtttcatgcgtatatgctaagtctaattaatactacaatagtcaattgctacttgtcgcactaattccgttgtcaataattatacatactaagtctaattacaaataaagtaatctcatattaaaactcaaataatattacatgctaagactaaaatagtcatctatgctaagtgtttcgtgcgtatatgctaagtctaattaatactacaatagtcaattgctacttgtcgcactaattccgttgtcaataattatacatactaagtctaattacaaataaagtaatcttatattaaaactcaaataatattacatgctaagactaaaatagtcatgtctgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgcgccaattccttctagggctagctcttccactcaggcttgacggacgactccgacaacacgtcttttctgcaagatacaaaaagatgtattaggataaatgcgaagtaacatatacatatacatatacatatatatatatatatatatatatatatatatatatatatatatatattgcatttcacg

SEQ ID NO: 68148 - DNA, 4089 bp, Oryza sativa
atatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcataattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggaccgagaatacggatctctttcacaaggtgacaaagcagatgcgtcattatattgaaaaatgaaggtggaaatatcaactcaaaactgacgagacattgcacacttcattctgaagggcatctaatctatccggatcgatgaccttctgcgaaattgcgttcatgaatgcacattgctttgttattgttgcccggacattgtctggaaggataccccttattacaactggtagcagttgtgtcatcaacacgtgacagtcatgagactttaggtttgtgaacttctattacttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccaaacactactttaagatctttaaccatagcaaacactgttttcccgctgcgatgtttaggctttgtacggtggtcggccttatgttcgaagtgcttgcctttcttccgtaccgggtggtttgctgcaaggaatcgacggtgacccatgtatacaaccttcctacagtgcttaagatacgtactttctgtttcctccatacagtgagtgcaagccttgtaccccttgttggactgtccggataggttgctaagtgcaggccaatcgttgatggttacgaacagcagcgctcgtaggttaaactcctcctgtttgtcctcgtcccacacggggataccttccttcttccacagctgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggtcttcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatctgcaacgtcgttaccatcagcagctatttcctcctcgcccgtttgatttccttcaaatccaacaaactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaatattaactttcactagagtttttcttctcaactattttataaaaacttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaagatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttgggaataccaaccggggctaaagatcaccgggatctttagccccggttggtattaccaaccgggactaaagtcccacccctatat

SEQ ID NO: 68149 - DNA, 12794 bp, Oryza sativa
ccaaccgggactaaagttacgatctttagtcccggttggtgttaacaaccgggactaaagatcccgggggggcctgacaggccctgacagcattcgaaccgggactaaagatgatctttagtcccggttggtaacacaaaccgggactaaagatcaaatacgcccgttacccttttgaaccgggactaaagatcatctttagccccggtttttattgcatccgggactattgtggaaatcggccgaccgacgaaagatggtttctccaccagtgtcacctctccagtctcaacaagaattttcaatcattcagaacattcatctctccatcgcctcatcctagacgtggagctattgtcttctgttggcctcaacttcgtaccatgatgcagggcagggcagtgaccgcctcctctcttccttgcataaccacaacaattccctgaggttgccctgaagtagacgccgtcacctgaccaccgcccccgccatccaagaggtctccgcagccgacgcctgccaccacggctgccgcctccactgtactagcatcgaggaggagggaggagatcgggtagtactcgagccagcgatagggattggaccacgaaccgcctgggaggccgccgcatctaccgcatcagtttcttgcttgatttgcagcggggacagcgcctagcacggtggatggaggtggcgtttcccctccaatttgatatgcgaaagtacagttataccctcccaccatcgaaaatctctcggtacctcctctccggagacgcggtaccgcgaggtaccgaggctttgcagtcatcagatccttaaaaaaaaaagacgatcctcctctgtaattttatagtatgcaatgaacgtgctaattgtaatttacatgggtctgttgccaataaatatttgagtgagaccttctaaatttctcgaaattcccatgaagttttgctattttttaaggctcaattccatattaatttcatatttctttgttcctattgagaaaatcgcagaaaactcaatatgtacagtagtacaaactttggcttgggtagtagtttcacatgtgagttaatcattttgcagaagttcatccttaattagtatatagaggtgctgatgtgtaaaaaaatattaatccttctaggttgcctttgcttttttatttttctttccccaaagtgtcattcaacaaactagctacgattgtttcccaaatatcctgccgcaacgcgcatggtattttctagttttattatatttgaacttcaataaatacttaccatagtttgttagttgatcaatgattgtcaatgtttaccaactgttctacttaagttgaaagcctctaaaccccatagtcaaaagtctagccccgtcacttttaagctctataatataataaatttaagatgatatgatatgattgtattatatttaaaatataatactccttcagttccaaaatttaatgctttctaccagcttttcaaaacatacatagatttccatgtagatattttggaaaacatgtaaaaaatgttatttttacgaaaagagtaattgagtttacatgttgagttttaagatgaaagatgatgttgtatgtttacatgttgagttttaagatatatagtgatttgtaaggtgtgaaaataaggtggatgtcgttgtacttagcatccagttgatagcatctacattgaagagttgtggatgctattcttgatagcatctacattgaagcactatgcgcgaccgcatccaccaaatgaacatgtgacagattggacaactgtcattctcgtctccttcctaaagtcttgactgttgtgaccttgcattattgattattgtgctgttatcctgatgtgctgataggtggggttaatggcggggatagatgggagatgtataacttttgatattgtaacttgagtgtaactatatactgggaatgtatatatacgatgtaaatgataccttaggtgaaaacatgagaactttttttgtacagaagttagcaaaaaatctgaaaaaactcacacttgttggtaatatgtaaataaataaccccataaaattgtataaacaaaatcaactttgttaataagatatagaattaacaaataacaatactcctatttttatttttttaatgtttctcaattttatgtctcacaaatgaacactataaaaaatgatttttccagacgagccccttgttagattgtagataaatcataactgaccgcgtctgcaaaaattgacttccattttcacatacgacttcttaagaggcccgcttgcaaaaatcgatttttgcacgcggacatgcagctcgttaagagatccgcatgcagaaatcaatttcgcaaacggacctcttaaggagccgcctagaagactaacttgtgtcctatttccctctcaacacttcaaaaattttcaaactcaaccttaccttctccccccctctctctctctctcacctcttctcctctccacctcctctcctctcttctcctcttcagccggcgggtggccgcaggggtgggcacgacggcgggcggcggttctccctcacccggccccgcacggatccggcggcagcggcgggaggagcccggccccatacgggcggctggcggtgggagtagacggcgtgattttttttctgattatatttttttattttggatttttatttttgcatgcggctcacataagcacccgtatatgaaaatagtgattttttcagaccttttctcgtacacgggcaggtcaaccacatgcgaaaactggatctagccgtctgcaaaaacccttttatagtgatggaagttaagtttattcgtagaactttgcatggttgtttaatattatctcatctatttctgagatttttaaaatgtttttgagaacttttatatcgttctaatactaccttcctatctgtgagattttattttaatttttctgaaaattttatattgttgtttaaaatataaaattgggaaacataaaagaaataacaatataaaagttctattttttttaaaaaaaatcataaacagtttaaaattgcaaatgacacggcttacatttacggctttgttttgctgcataatttgtgtgccatccagtacaccgctgatcgggagagtagttcttcggaaccttcgctagcttatgatgttccgcaccagaacaacgcgctaataaagttttcgggaagcgcttcgtgtgactgctaactgttcgtccatcatggctcatccctcctttacgttcggatgctgcgtgtcgtcgtcaacgtcgtggggcagtgcatcgtgctgtgcatcgtgctactccacgtacttccttagtagaaccaaaaccatcggtactagccaggctctggtaccaatttgtaggatcgtaaagggcctttcccatcccaaaagctagccaatgaggtgaggggctccccacttatatattaggtccattacccttctacaatcaatgtgggactattcaacaagagatatatcccccttcatacattggtgtcccttagctgctcaccgccccttcaccgtttcccgcagtcagccacggtccattaagccttcacacactatgttcctcaggccagagatgttggactagctagtctctgataccactttttataaaggttagtcgtgttggatagtacagggaggagagatatactgcataacgtggatagattgtattgagcctcaggggctggtatatataggagtatatgaggaggagataaggtaggattatagatatggaaggagtccacataaactaatcctatcctaatatgactctaactaccatatactctaacatcccccacagtccaagcgtgagcaacgcggtcagttgaactggagaaaaaactggtaagggtactcaacacgatgatagccctacgtgccatagtcgatgtagtggagatgaagttgtcgtagttgtagtagccactcgttgcagatctcgatgcagcacaagtcacataatagtgtgcggttgcggttcatggcagggatcgtggtgccaggtgcgagagtgcgcgggtgcatgcgaaaagccaacaaaacacgacgaccaaaagaaaaaaaataaagaaaaagaacttaaataaaaacactatggtgatcacggcgcgaagacgttggtgatgccggtagacagtgatgtcggacaatgtcgttgtagcaaaacagcaacatccttgatctcggtgaaaccgaacggcggcgtgggcgacgcaaaccgatctctcatcggaagagggaaaaaagaaaaaacggcagcagcactgtcccagctccttcgtgtctcctgacgcgctaattggatgaagccatgcatgcacgccatggaggcacacgaatcaaaaccatgcatcttcgttgcccatccgatcaggctgtaggccttggtcaggtcgcctcgcgatggtaccgtctggagagtcgacgcgatgccacacgcccacacggggtcgtgtggggtggcgcaggcagcggcaagggctgcaggtctcgtctccacgcggacggctggagcgcgaggtgacaccgaaggaggccgtggcgccgctgaagcaagaggccgacgatgagattggtctattctgctgcttgatgacgaaagacgacgacgacaatggagctgtcccacggccttcccagcctggctccacccatgcaaaaacacgagtagcctgcccggatccggcggagaccacgacggcgaaggtgacggcgaagacggagaccgcgacggcgatgacgacggagacagcaacggcgacgacgatggagaccgcgatgatgacgacgaccgcgacagcgacgacagagaccgtgacggcgacgacgacggcgactgcgagtaaggggtttttttggattttttttggttttttatttttgcatgcggcgacattggcctgtttctttcagcttaagattattataatctagattattgagttagattactataagctagattgttataatctgtagtagaataagcagttagttgtttctttcctagattattagagcctagattattgggtttgcaagtctaaagagagagtggggtggcatggtgggtaatttttcacccaataatctggaaaaagctcacctaaatgagcttatcagattataataagctgggctccagattataataagctacttcaataagttgtctgtttctttcaacttacttccaataatctggattataataatcccaagctgaaagaaacagggccataaccaccccgcacgtgaaaatcagatttttcgcgtaccacccgcacgcataaatagcgattttcttatgcggtcaaaatcgattttcgcatgcagatcttccaatcgtttataagtgtccccgtccagaaaaatcatttaagtactagctagtgaaagagcaactcagccaggctgagcggaaacgctcaaatcgagcttcacaactcagcctggccaggcgcgtgcaacaggctgcacccacacgtgcaacggacgggcgtcggggtcggttcgcccctcgtcattactttctcaaagagcaaaaacgagggtttggtgaggctcaaccatgccatcgtcttcctctactctctgacgctgccgccgccatcttcctcgcctgccactgccgccctccttcttgaactccaacgaactggatatgttggccacgaggtccgacgactgcagcaaataatagggcggcaggaagacgaggggcgatgagtgatggcctccactttccccggccaccgctgctcctctctttcttccacggctgcaagaggcgccaccgccaaatccggcggcagtgagctcgctggccccagatccagtggctccgagctctgctccaccagccacaaaggagcagatagagtgttggggcggcggcgtcaatttgggcagtgagcgacgtgggaggaggactagcgagcagcgagcgacattccttggtgagcagcgagggtgaaggagcgttgggtggtgggcgtcgagtttcctggcgcaacagccggcgagattactccgcctaagtggcgagttttcttccgcgaggagccgattgaggtggtgtttagatccggactaaaatttagtccctgtcatatcggatgtttggatattaattagaagtattaaatgtagattaataataaaaaataattacataaatgagagcttattcgtgagacaaattttttaagtctaattaatctataattagcatatgtttactgtagcatcacatggactaatcatggattaattaggctcaacacatttttctcgtgaattagtccagggttatgaaatatattttattattagtttatgtttaatacttttaattagtatccaaatattccatccgacgggggtaaaaattagtgcctgtatccaagcagggtctgaatgcatcgaggatttttttttctttctttctccatcgacagtaataagcaccacgaggaaccgacgaatgcattgaggaattatgtttattccttcgtccattggttacacagtaataagcactgtgatatttttattgtacttttgctccgtcataaatttctctaaaaattatcatatgaatttagcggtggaaatagtgagttctaggtaggaatctcaccctgaaagaaaaaaaaatcaattcatcattcatacaatcaatcaaacaagatctcttttgaaccgtccggtacagtaaaccaaaccaatatctcatgctaccctggttaaatcaatacaaataaacaaacacctatatatgtatcctctcagccagactaaactcagcctagatgaaagagatgagccaggataaagggatgcgaggatccaaacacaccctatgtttcctcgatcggatcccacgattcctgggaaactattaaatcctagctaactatctcgtatacatattaggttcagttcttttcctcgtactctcaatttcaagcacacttttcaaattgttaaataatttgtttttacctaaagtgtttctatatgggagttgtttaaaaattaaattttaaataattaatactttattaataataaattatatacgaatgagttttcacgttttgcgtatgctgaaaaaatactctcacctgagagatcgaatagggcttggcgttctttcctcaacattttccaactcattctcttcttatataagagcacgtttttcaaactattaaacgatgcgttttttttaaaaattttctatatgaaagttgcttaattttaaaaatcatgttaatctattttttttaaaaaataaatacttaattagttataagaaaatacatcggtccgttttacatgcacgggtggtgagttaagtattgggtccctattaattattttttctatgttcgcagtcgttgcaatgcgccacgcacgcagcgctagcggccacgtcttgcgccccgaccacgccaacgccgctcagccgaagctaatcccatccagcatttcaatgatggtgtcgacgtgttaggaagacaacatagttgtacgccggaacaaatttggtcagaaatctctgtggtatataacatagtgcatagtgcatctcgcactactacagaaagcgtttttgcatacgggcggaatcgatcttcacatgcggttggccggcccgcatgcgcgaaatggtctgcaaagatcaccatttgcgcatgcggccgtcgcagccgcatgcgaagattgatcttcgcatgcggtcacttaagacggccgcatgcgaaaatagatcttcgcatgcggtccatataagaagccgcatgcgaagatatattttcccatgcggtcgacctaagaagaccgcatgcgaagatctattttcgcatgcgggcgtcttaagtagaccgcatgcgaaattcaatttccgaatagctaaaataatatttattctagcattttggtgattcgtaattaatatgaaattattgagagatttattatcgtatttcggagtagtaagcatataagataagacaagtgccgcagtaacaaacatgtaatacataaccattaattcaatcgtaatttacatacaaatatataatacaagtggcacagttttttcatcatatgtataagtagtgtacatgttattgcatatgttctttctcccactctctgagaggtttaaatttgtcgtccattgcgagttcactctggttgtcgtagaagagacctcttgcgttgcagacatcgcgacggatgaatcggcagaggtcagcggccacgttcaagatagtagtgtggttgaatcgttgtgcaatatatgggatttcggggatctgcacacagaaaggaaaataaaacggtactcagtgagaagtgtgtgcgagatgggtttctttgtagagaagagttcgatgacctactcggttactggttgttttgtacctcccatttactctgagcatctcgcacacgtaataaccacacaagttggttcctggtggttgtttgtagcactgcgatataattatggggaccgatctcagtagatatatttagtatatatgtactattcgataattagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtccaatgatatgatcaattggtctttcggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagcttcgtggaattgcatactgtacaatgaataaagaagaaatgagatttggtttatttgtttcgaatgaaacgtgcaacatgtaataaagagtttagacttacagacagaaagccgcaacgagattaacgtccattttatctagcttgtagagggcgtaaaggtcttggaaagagataaaaaatatcccattaggaccactcatgaaagcgccttccgggacggcgacgcttatgaaaccgagacctttcctagatgccttcatataccattcgtgcattaccctcatttcccatggtagcttgttcataagataagttggcaagaatggcttgccatactcataagtttcaggcacatcggcagataaccaggattgcacttcatcttgggccgctagtactgacttctgggagtctgacaagacgtgagcaagttcttttctcttctcagaattcctgaaagctgaaaacatgaacttctccttgtccttgtcaatctcctttgggtcgtatgtcgatatcaactttggaattatacgacgaggttccaaagtattagactttggttcggatgtagtaccatctggtatgtgcacttcttctaccagagaagattggggtgtaggtggagaggtttgaactgagggcggagccgggggagcatgctgtttagttggggaggtgggagaggcttgaactggttgcggggtcgggagaggcggttgttgagaaggggagggtggtggtgtaggttggcgaggcggtgacctaagcggtggtggtgacggcggatgtcgaggtgacggtggttcaggaggcgacggtggtgcaggagcggcagcagtcattgcctgcgatgaggatggggttgaagatcctgctgcaagaacggccgcgctcaggattatgtctctgcggtgccacaagataaactgattcactgcatcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctctctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatttgttcttcttcgcgagctcggacatttttttcctcaaagccaatgcttcagctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcatcacttacggcctgttcgataggtatgtagtccggatcatcatcgcggggggcgacttgtgttatttccattggaaacgggtcacttggtgtgcgccacgtttcttcactagaagcgcctggatgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtccgaattatacataaatctcaatttaacataagtcccaattatacataaatctcaaattaacataggtcccaatttagcataagtcacaattaaacagaaatctccatttgacataggtgccaatttaacataagtcacaattatacataaatctcagtttaacaaaaatcacaattatacataaatcccaatataacataagtctcaacttaaacataagtcacattttaacatagctgccaatttaacaaaagtcccaattatacataaatctcaatttaacaaagtcccaattatacataaatcccaatttaacataagtcccaatttaaacataagtcccaatttaaacataaatctccatttaacaatccacaattaaacattctcaaaattaaacaatccacaattgcacatatcacaatccacgatgcacaattaaacaatccacaatccacaattgcacatttcacatttctttttttaaaagtaaatgttaccgagcgacggcggggacgacctggcggcggcgatgacctggcggcggcgatggcaacggcgaggggggagaggtccgtgcggcggcgacggcgacctggcggcggcgacggcgacggcgaggggggagaggtcctggcagtggcgtcagcgacggcgaggggcggggcgacttcggggaggagccggcggtagcggggacgacttggcggcggggacgacctggcggcggcgatggcaacggcgaggggggagagttccttgcggtg

SEQ ID NO: 68150 - DNA, 2127 bp, Oryza sativa
tagttcttaccactgtcatattgtcacaatgagcaaaatttgctactccgagttgctgtcaaattttgaacagtagtactgtcttggcagaacttctcaccaggttgggattcgtttgtaagacatgtttaacatcagtaggagtagataccaccggtatgattaagtgtattaactacatgcatgacagtcaattaatcgcgccgtctcttatgattctaagttgctggctcaagttaagtcctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagtttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaagccatttgatcatatgacaagatgtgtatctaccttaacttaatgattttgataaaaatcataggggattcatcagagttaagtctcgtcaacattcttttcacaaacgaaaacagactactgcctatactacttgttaattactccagctgcactgcgttcttgaccttctcaaatcagacgatcgaacaaattgccaatttgtcagcagttaattataaatagtcaagaattgcacaacaggctcatcagctaggccattcacttataatgcaatgcaagaaccgtacgtacaaaactaccactagtacagaaccagtgcctaattaatctgctgccagttaagaccaaaatctggagtggtttaaacggattgattaatcaaagtagatgatggatttttgcattagttggtcaatcaaagcccatcatttggggcttcttcatattcatatcattttaaaccatatcactgtttgctaaaactgatatatttagtttgttaccaaaatattggtcatgattggagaatttgacaacactatatttagccaatcttattaaaacttgttaatgttatcaattaatcaaaattttggtaatacaaaacgttgaaaatggctgtaagtgaac

SEQ ID NO: 68151 - DNA, 5606 bp, Oryza sativa
cagtcagactgcatgcaagacagtaagagtatctatttcatggttctagtacaccaactagtcaacaaagaacagtctgacttattaaataatatggcaatgccacatgctaagccaggtggcacacctaattgaagagttttgcttctgaatctggaatgtggacatcctaactggaaaacgttgtgcctatcttagcctcttaggagccttgattaattctagaatgaatcaagattgcaggagtgtgaagtgcatatatttaagtactacttgattagttctgcaactatatgcttaggcatgcttcaagtatactttgctcacatcatgcctttgtcttacattgacacactcgactgttcatgctcactgtaactgccaatttctgattaacatttttttaccattttgtactgtttctgactgttaatgtattgctttctctatacaggtaaagtagaactatagaagtttacttttgaatgacactgttttctttttttcttcacgaaattaatgaaggaataaccaagttgggtaaaagagtactgctagtgatttttttttcgaaaataaaaggataagagtgtacaattgttatacttgctcaataggctacatattgaaaaataggatccctttaaacgaatctaacttttatgtaacaaaatcaagaaatggttaagtttgaaaagatcggcgtcttaattctgtttgctataaaccaaagcgaaacttgattactaattactgtgcgctaacctattgcatcgtttaagcccatgctttgctttttaagattgtttaggaacacaaatgaactcagtgctggcatactacatgaagagcatccatagaacccttcaaaagcaaagaacatcccatagatactatgaaggagattaacatgaagagatcatggaacaagaagtcacggtgatgattttccttgcgaactgggcatgatacatatatgctcaagaagatcatggagcaacaagtaagaaacactgatgatttaccttgcaaactggccaaagtctgttagctgatacatagagagctcatcaccattcaggtgatttctgcaacactggagctctctacgtagttttgcatatgcagaaagtatgcatgcatggaaacagaaacaagcaagttctgcacaaaactcagagactacgagaagccattggttacctggccatctgttgcttcccttgcttcttcttccgtcgccattgctccagatcaggacgggaagaagatcaggatgggaagaagaaaagaaagtgaaaacaaaagaaagaacgaaagaaagaaagagaggcttcttccctagaaagtcttgtgggtgcttgaaaagatggcggtctttataccaccctttcttctgtcgatatattttctattgctgagcagcggttaggaaagcaatggcagactgacactgctcttgattggcggttagcgctttgcttaaccataatctagattaactggtagaatgtatcgctgaaatggttgatcagtgaacatggaaacttagcattaggtgccaaaatgccaactggtacatgaggcacatggtagtggtggctggaccagtgtgtctagcattcttgcattgctggacccacagaaccttttctgtgtgaaattattgcatcgataattgctctcaagtatcatccttggatccctatctttcattcttttttccttgagtgtacctcggaagaaaagtttaattttcagtgtaaaaatactattatctgccttttcttttgttgcttggctttacatataacataacatgattgttcaatattccctacaggtgcaggtcatctcataccagttaggctgccatggcatcttccggcacattcgacgatctatacaatggggaaggtgtcacaaaaggtactgtccatcttacctcataatgcacttgtaatgccaagtggataatagtatggatgcagtcaatgtttcttcaggacatcaaaaggtttgctgaatctaatcgagtgaaaggagcaacacgatgaaagtaacttctcctctgatataatggttttgtgttaagtccaggtaaacaagcaccacaatataatatgttggttcaggtgtcattttttcttcctggacctgtgctgctgaacgccaaattgaagtgtctgttgcgattttttgtcaggtataggatcaccaacagtttgtaaacctcatatacttcaccatgagctcactgtttaaacatccagaagtatggtagccttgacacctgctgacattgctcatagagggcctagtttctgaagactgcagagccacaggtacagataaaggaggtgcatgccccctgaatattcaatcagtcaagtggctgctgatgacagtgatctgcagcaaaagaattccacatgatcaactactttggagaaggaaaataccaagttggcaaatccaaagtgccatgctggatccagcactccagctactgatcaaacaatccaaagttaatcctgtcaaagttaagaaatccaccggccgtcacctgcagtgctgctttcagagactaaaccagatgattttctgaaaaccagaggcaggtggtgtttatgtcatgtattattccatcattatcactgcgccgaaagagagaaatcaatggagatagccatgcgaagatgatgtcatggatgcttggaaatacttatcatcagcctctatcagagatgagtcagcatcgtacgcagcccatatcattggctggaaatattgttcagaggttgatgttttgtttcctggcactgttttcttttgctccctggaatatatatagccgtcaccctgtggtcccactcccaccgtctatgtacatgtcaatgtgttgctgctaattaactagcacagcaccatctccataagcttttttgcatttgtgaaaacaaaaattctgatcatgcaaaacagaaaagaaaaatgaggaaatgttaggtccagaaagaaagaaaggagctagtgtttttcttgagagaaaaaaaaaaggaaaatattggatgaaaggaacaagagtatagaatatatctgaccttgtgattggaaacaaacatgcaacagcacttagggaggcaccggccgtgcaaaagccatcttgtcatgttgtgccgccaaaatcataaccacctaaagattttttgtttttccttttttccttctcaatccatccatccatccatcagctgagcaatttgagtttggctgggaatatttgataatgacacataagacaaggaaaatatacacactaaaggcagcatttacaaataattagcactaaaattgcactaatatatatgtggagggagatagaaagcatcttgttccatggatggccagtgtttgatcagctgatgcctctacctgtttctgccatgattagtttggccagatcgacaattaaggcagctgcagttgtacgagctgtgcttttgtttcgtagctagggagagatcaatttggctcgcaaatgtttgtaccgtatacgcatccaactacgtatttgtttgcactagagactgactgatccagctacgtacgtatagctattgctttgttggcttatgatagatatttttcctcgcattttgttactctatcggttttctttcataatatcataattttattgggtctccaaatatatttctttcagtcaaaattaacggttatattggagactgattatatggtcaagaaggttggtgttcatatatgtagtataactcgttggttgtgtgtatctcgtgcagaggttgggcgggttcagttcgattatattatcttggtgtaattgactgagttttaataaaacttgaattatctaaatatagtataactctcactgtgccttttgtttcacttctgcatttccaagtatgtgtgagcaattcaaagatcaaaattccacaacatgtgtccggattggatagttggatctatggcctttcagagtgtagggtaggttggttgattggattgcaatataggtccacttactgttgtgctttccagccttgtttgactcaggaatcagaatagaacatgctctgccgtggattatttgttacacgcttttaaaaacatgttattcttaaaatagtttgttttactatgtttcttagatgacttgttgtaaactactcccttcgtttcgttttttaatagatgacaccgtttacttttaaacacatgtttaactattcgtcttattaaaattatttatgcaaatgcatgaaatataaatcatgcttaaaataattttaggataaaacaactaacataactaatgataatttcataatttttttagtaagacgaatgatcgaacatgtacccgaaagtcaacggtgtaatctattaaaaaacggaggtagtatttgttgagtttatttcttaaaatatttaatttatcgttgtaatcaagtagacaaatccactgtaacaaatctcgtgaataatctgtttcaaacacctccctaaaaaaaggaattgtcttagctttcatcatcactgcatgtttcaaatgaatgtttggattgccacaaatttttagccatacttgttgaaattctagactacaaaagttagtactatcaatacttgccaatgttttagcactaccaaacattgaaagagaaaaaattggcttcaaaccaaccaagacctttcacctgcaacacaggtgtactgaactgaatatactgctcctaccaatctcagacagatactgaagattagctgcttactacattttacagatcagacaagctactacgaagaacttgctaccaaacacggcatctaggtaggatggagaaaggggagaaaagaaggctttttggaagcaaaagcttctgcattgcaggctggctagtgctcatgtgggcacatcaaagacagctttttttcccctctttttttttcttttctttttttttaccatgatcacagagcaaaagaaagaagaaaggttgcttcaagaggcaggtgaatccagcgaagtgaggacattttcctgggccccactcttgtgctgtgtcactgacatgtgggcccccagtatctgcactcctctatccattccagaccacactagtcacttgcaatcagactaacagagtaacagtagacaacaaatagctgaccagatacatctaaagaaagaatttttctcaccagatatgcagataaacagacaagattagttgagtactcatcatctctgtatgacttcaatctcatcataattctgtttcaagttgacaagattagcactaagcagtttggtagccatacatacattgcatgcaggaaggcaggcaggcagtatcgatcaaaccttgtactgaaaactctgaaacttctgaaaactctgaaagtgaggctcgcggtcgtgtctgcctgcctgtcagtcttctcatcgtctcctcgtggttgagctgtccctacgcatatggcgctgacgtcatgtgggccccaccaaccggccctactacaaataggtgcctaaatttttttctctctctctctat

SEQ ID NO: 68152 - DNA, 16044 bp, Oryza sativa
atcgagatcaaaacagccaactttctcaactcatggggtgatggtgtgctagttatggtatctggtcttgtacagaccaaggagtacagccaccaaaggaaattcatccagatgtttttccttgctccccaggaaaagggttactttgttctcaatgattatttccatttcgttgacgaagagcaagtgcaacctgcacctgttattgcccaggacaacttcgagaccaacatggcatccaactccgtcgtcgaacctggtataatatatctttgtagcttcataatttcctgcaattttctttttaactgttcagccatatttcttatttctttttcctatttgcgatccatatttcttattctctgtcaatgatctatctaaactgttgtgccatgttattcgtatgttctgaactatgttatatcttctagcatgccttctgtgttggctgtctatgagcaccaacaaaaagtatgttccgtatgcgttgattactgatggtttcaaattgtaatgttgccatggaaaataaaagtcaataccttgcacgtatgaataggcctattgctgctgcttttctaatttttgcaattatgtagttactaactatatattttctacctcaagttccagagtacattcacgaagaggaaaatcaaagtgctgtcccaataacatctgaagaaagtgatgctgttgagaactatacttactctgagccaccacagcaagtagtttctcagtcagacaattggggagatgagcctcttcctgaagaaccaatttcttcctttacaaatggaatggcgatggcaccggaggagccagtgcaatctccacctgttccacctcctcatgtagaggaacctgttggtgaaccagtaaagaagacctatgcctccattgtatgttgcaccttcacttggttgatcatgattatttttctttttgtgatgtcatctcatgcatatttaaaaccttgatggtataactcatgcgctaagaaccgcaaaagctccactggtgttccctgtagcccagccagccccgactagacctcaccaggcaaccgagacaaaccaggctgcacagcattcggttatgacttcgtctgtggcaaccgagaagccaaaaaccgatgtttatggtgaatttgctgtccaggatgatgaaggttgtcctttagtttgagctagcatcataatccctttcactgatttgagttgcacattacccactgacttttaatatttctgttcgtaaaaatagagagcaaatctgtctatgttgggaacgtgccatcttctgtatctgaggctgatcttgagaatgagttcaagaagtttgggcggctcattcctgatggtgttgctatcagaagccgcaaggtggttccttatatgtattttttattacgtgatatgatagaattttcttttgacttagtgtttgtatgacattggcaggagaccggaggctactatgcgttcgtggaattcgaagaacttagtggtgttcacaatgcattgaaggtggcaaactgttcaacaaaactcacttttttttacatgcattaaataccttctccaatttgtgtgtgcatactcctttaaaatcaaatttaatgcatattcacttcaccatttactaattactgtgatgtttaattggtggtctgctttccccttttttaatgcactatatggtcatccttcgcttgaattagtaatcatggtttgacaggtcatatgctaaatcttttgccaattttcaggcttcaccaattgaaataaatgggcggcagatatatgttgaggagcggaagcctaacagcggcataagaggtggaagtaagttgctcttttatttttccaacacctatgcaatatttgcttgcagactacacacagcttcatggtgtagttgatggtggcatatacttgcgtaagtatgatatgaacctggtgcgtgtttggcattggcaggaaggggaggcagaggtcgtttcggtggaggagggcgagggtatgctagagggggaggcgacaacgaatatgcgggcaaccgtggtagtggcaggccatcaaatggctaccagcgtgttcctcaccatgagaggggcattttggggagccacaacgcaagaaactaaatggttcaccaccccatggtggtggcctggtgggatatgcatatgctgcaagcatgaggttttgatccgtcaaaagggagggagagctgcataactaagaactactgggttgtttcctccgttccgttaggttgctttttttttttggttttgggttttgtcgcagcagcagtttgttgacgaagaatgtgtggtatccaactttggctagacgttttattatgatgcaaatgcccgtccttgatgtgccatgcctgcattaagagcaggagcagcagctcagcttctcttgcgtgattgtttgcaatgcttcccctcgaggtatgctgatcgatttgatgctccgagtttatcatatacccggacttatcgtttagatcagaaattgaggatttgcccccagtcgtgcccatgatatgtgggtcagtggatgaattctcaaattaattctaatttatcaaccgagaattagtcgctgcccagtttgttgctaatactggcataaaatctatcacaagccagcaatgtcattcttttgccagaaaatctatcataagccagcaatgacagtttggttagtgacgaatccaaatttataacgtaaaagttcttttggttagataagcatatatatacttcatccctctcaaaataagtgcactcttcaaattaaattaggagtgcaattttgagggagtacccaataaaaactagtgttctttgtatcaaaatgcaataaagtggtgctgtttgtatcaaaatgcttggttaccatcacacattgttgtttgccaaagtttcgggggcgtaacaaaccaacatatgctttgctcgagtcatactcttatgaataagaaatcttcataagttcccatttgtgatccaactttataaactggagtacaatgttctcctttttattacagagaccatactgtttttttacaaaaagaaaaccttaattattatagtaactgttgttcataaacctggagatgtcaatccataaaaaaaaaagtaaccctggtcgatgcaaatcgaaatctcatcacagcagcatatgacgagaaagaataaacggcacaaggcgcaggaatcgcacagaacgaaatatagttggcatgataagatgagcgtgaaaaatagtaacatcaggaaaggaaagcggcgacgacatctcatcagagcagcataatggtgaaattaatgaaaacaagaagtttgatttgtctgactagacaggcaagaacactattagtagaagttaaggatggatggatggatcatttgaggggcgcgggcccgaggagcgcctgctgctggagctcaaggtcgttgagctgctgctcgcgatccatctcgatgatgagcgggacgacgaggaccaggaaggtggtccccgcgatccacgccgccttccccgtgctccgcaccaccttcttcgccctgctcgccgcctcgcgcccatgcgccgccatccatgacgccaggatgccctccccttcgccgccgccgccgccgcgcttgctcagggacgccattgctttctctccgcttcgcttctagggttttctttccgatcgatttcttattttccgatactaggtgggccgtgtgggccatagcgcgcagaaaggaggcctacgaaggccccatatttgtcctccattaatttctcattagttaattaattaattaattaattaatgggtttcctcctaccaaaaaaaaaaaaaaaacctttccattcctcctccttgcggcaggtgcggggcaaggatttatgcagatgactttttctgaatatgattgtatagtccttagagaccaacttaacacatttatctctgatgtgagatctgatttggatttctcaagttgctctgaccttggtaaccttgctgttaagatggttcaaagtgatagagaatttttccattggtgtatcacttaattgaattaaccttaaatttgcctgttgaaaaagccttctcagctatgaacattatgaaaactgacatgcggaacaagatgaatgatgaatggatgaatcactgcatgatatgctatattgagcgggatgtttttactagcattgaagatcgtcagattatacaacattatcgtgctttgaggacgcgcaagcacaaattacctagaggtatgtcatgcattgctttgtctacaaataattaagttctcataatttgcatcacttacattatgtaatatcattttctatattcatcttcaggttctctaccttctgttgatgaagagtgaaaatcatgaatatacgtcgcattaggtattctaataaaattttagtctagtcttgtactttttctacacttttactgtacttggtgcatatttagaaattgtatttcagtcttgcattttttttcgtacttgtactgcacttccaagtacgaattgatatggatagttgttagccttcaatttgagccctaggcgtgtcgagctcctagctccgccacttgaccaggtgcctagaaactctaatcccttttatgtagctccgcctaaacatacgagataatcttagcctgtggcaaccggcaaatgacttctgaagcctatctcatgatcttaatgtaattcggttcggatcttcttcacctccggcgaaaaaaacctaccagtaatttagggatttgtgcacgcaatgaaggagcgtgggattaattaggagataagtatatgtttaacagtaaatatgtgtatgatccattagaaaatacaagattatttagaagtcgtatctttataacagttaaaacactctcaccattagctaaaaaaaattcttttattacttttttttttcatttttcacctttatatatgcaaccatgcttttatattatagaggttaagagtcgttacccataataacgatattttatctctcctctttctatccttcgtatcaataagtaagtattcttaattagtaaaggtgagatcgctgttaatgaccattttacatgttctaatggcaaccggtgagactaattaggaatctaggagataattaatttagggcaagccgcgaggtggcctgaatttgtccaaactgacaagcaaaagaaatcttaattttcagtaaattagggatttgtgcatgcgttgcaggagcttcagagacttaaatggagcaattttattttctttctgtcagaggatccaaactactacagtaccgaccatgatcgaatcaattatgaagttcatcagtttgactttaagcaacttgtctgcataatacacatgtggatttaacaaccctgctttccaacttgttctgagcaatttaaatgtcgaagtaaactcaaaaccattcaaactagctcgatggcctcatcttagccccacatttaatacgatgaatatttttggaccgacacacacacttggtcacttgggtcactaaactcgcccataaatagacacctaattaagcttccatcgatcaactcatcacttcatatccaactctatctcacttagcctgagctgagcaatggggctactccggcgaggtagtagcggcggcggcgccgtgctcgtggtggtggtgtgtgtaggctgcattgcggcgacggcgatggcggcggcggcgggcggcggcggaggaggaggggagtgtcccaagtacaaggactcgaagcagccgctgaacaagaggatcgacgacctactccggcggatgacgctggcggagaagatcggccagatgtcgcagatcgagcgcgagaacgccaccttcgacgtcatgcgcaactacttcattggtatacttgattgcttcttggttcttgcagcagagatacatattgattcttgcatctaaaaacaagatacacatataataagtagaatgcgaatgcaaacacctcaggaaattatatataatatctaattaatatcgatgaaagcttttgcgtgtttgaaaaaaaactataatatagtgcaggtcaaactaaaacagtttgaagtctgaagttctctaatatatatttttgacatgcaaagattttacgcgttcgtgaagaaaaagtttgaagtttgaacgaatgtctatattgtgattcggccaggagtttgtttaagctagctataacaaaataacatttcttaaagaattcgtactttgataatgggtaatgcagacaaatgtctaacgaaccagtttggtgagattgggagtcaaacactctgaatccgtatgatatggtcatggaaatatggatattataagatactaatgattttgtaaatacaaggtttgaatcttagctttcactgcaagcacaagtgagggcatgcatctccataaataaatgtaaatactaaaacagattcaaaatgaattaattaatcaaaattagctagctactcaaaccggccattaaattaagacgaatatatatctctcaaattgcagggagcgtgctgagcggcggcggcagcgtgccggcggcgcaggcgtcgccggcggcgtgggtgtcgatggtgaacgagatgcagcgcggcgccatggcgacgcgcctcgggatccccatgatctacggcatcgacgccgtccatggccacggcaacgtctacaaggccaccatcttcccccacaacgtcggcctcggctgcactaggtaataaaatgattaattatcccccttaattaaactcaattaatgatgcatgaattaagtagattcccatatgtagctagttgtgataagtttactgaagatgaccagattgcacgccattaattaatcatccaagtctttgtatataaactctcaaaatttgcagtgctcgatgatgatggagtgagatccaagatttgagattttaaattagcgcgatcgatcgctcacgtcccaacgttttggacaagggaaagagttactaattgcccaactcgccaactagtaatattttgacgttgtcactctaattaatggtttctcaaacgcgctgaatttgaaaaggaaaaaaaaagacagattcgacttgaaaaaaaacccctactatcataagagtaattttaccatctttgaaaaataaagtaccataatttttattgtaaaatttggtacatctaaatattagctagcttaagttaccaaattttattttctagtgtaaaaatctttggtatcttcagttacgttttaaaatgttcgtaaaatttctcatcatacaataatgtcgtaatcttattttaacacaagaccaatagtaatagttttctaaaagttttactggattttattcatcaccggagggagggaatatacaaagataagctagctagctagtgagagcatatgaacatggtgtgttcttctccgagagatttgatagtgtaacacttcttaaaataggtttcgattatttgacattctgacccactttcatttacttagatggctcacatatcatcatcacaagtatcaattaaaacaattgggcaacgaagaaagtgtcaaattatcaatttttttcgttcttctccagggacccggatctggcgaagaggatcggcgcggcggtggcggcggaggtgagggcgacggggatcccgtacgtgttcgcgccatgcgtggcggtgtgcagggacccgaggtggggccgctgctacgagagcttcagcgaggaccccagggtggtgcagcgcatgtcctccatcatctccggcttccagggcgagatccctcccggcggccgccgcggcgtccccttcgtctccggcgggaggccgagcgtggcggcgtgctcgaagcactacgtcggcgacggcggcacgacgcgcggcatgaacgagaacaacacggtggcgacgctccgggagctgatgacggtgcacatgccgccctactacagcgccgtggcgcagggggtgtccacggtgatggtgtccttctccagctggaatggcgtcaagatgcacgccaaccacttcctcatcaccgatttcctcaagtccaagctccgcttcagggtatgtgcactactactatatatatacttcctccgtcccaaaatatagtcattttttaggttggcacaggtattaagaaagtaaatgagaataattggagaaagtgtgtgattggttgaaaagagaaagtaggtgaagaataatggttgtgattggttgagaggaggtatgtggagaaatagctttattttaggacaagacactctgctagaaatagctacattttgggatggaggtagtatatgctatacctttgtctacaaatatatatattcccttcaccctaaaataaataaacttaatacactaaagttggatataagtcgtacgtactaggttatatcacatctccaactaaattggtttattttgaaatggagagtataaggcttaattttgatggttaaaaataaactttgaaagtaaattcctctttcgttattttatttatgaaaaataaactatggtcataacaaaaatagtctcagttttaaaatataattatttctagtatttatttttttctaaaatataagcaattcctaatagcctcttatttaaatttctttttattttagccccccaaccaccactcattcaatgagaggcacccaattattttcttggcaacttttctccactaaacaatatagaaatatttatattttaaaatagattatgtgcttttgaacatgaattcatccgtatcggtgcatgtaaaatattattattggtttaataattagtcaaagatttaaaattaattggtagtcaaactcgacttgtatttctattttctagacggtagtacatacgtgtgagatcttcatgcatatatgatgtgatctgtttaagtttgaaaattaattaatgtgttattcaatttcagggattcgttatctcggattggcaagggcttgacaggatcacgaccccagcacatgcagactacatgttgtccatcaagctgggtatcatggctggcatcgacatggtcagtacagtgcacacattaatacatgcaaaaactaatttcatcataaaattttcatttcattgataaataagagacaaatatcgatccaagaaatggtcctttacacccaaaacatttcataattaattgactgattaattttcgaatgtttgtgtgcaatcaggtgatgatcccgttcacgtacacggagttcatcgacgacctggcggcgctggtgaagaacggcacgatcccgatgagccggatcgacgacgccgttcgccggattctccgggtgaagttcaccatgggcctcttcgagcgcccctacgccgacctcagcctcgccggcgagctcgggaagcaggagcaccgcgaccttgctcgcgatgccgtgcgcaagtcgctcgtcctcctcaagaacggcaagcccggcgacgcgccgctgctgccgctgccgaagcgggcgcgctccatcctcgtcgccggcgcccacgccgacgacctcggcagccagtgcggcggctggaccatcacctggcagggcctcgccgggaacgacctcaccgccggcggcaccaccatcctcgacggcatccgccgcgccgtggatgccgccacggaggtcgtcttcgccgaggcgcccgacgccggcttcatgcggcggaacgcggggaggttcgacgccgccgtggtcgtcgtcggcgagccgccgtacgccgagacgctcggcgacaacctgaacctgaccatcccggcgccggggccgagcgtgatccagaacgtctgcggcggcggcgtgaggtgcgtggtggtggtggtctccgggcggccgctggtgatcgagccgtacatggacgccatcgacgcgctggtggcggcgtggctgccggggacggaggggcagggcgtcagcgacgtgctgttcggcgactacgagttcaccgggaagctggcgaggacgtggttccggtcggtggagcagctgccgatgaacgtcggcgacgagcactacgacccgctcttcccattcggattcggactcgagacccgcaaagctaattaattaaccccttaattaatcaggggttaggctaattaatctcgatcatcaacgataatcgcatgcattaattacgacttcggttaatttagttgcgtggttaattacgatccaactcgggaggagtactagcgtgcatgagtcatgtcaggtcaaggaataaaacaatttagttaatgtacttgtaatcaagtgtactcctccgaatttactattctgaaatttactttgactttaagtaaatttgtcagtgtaacacatgtggatttaaccattccgttttgccaaattgttttgaatattttgtatgccgaagtaaactcaaaagcacgcaaactaatgcaaatattatgggtattttatcagggaaattttacaatcctcaaggccgtgtttatattcaatcttttttaccaaaaacatcacatcgaatgttttgacacacacatgtagtattaaatgtggatgaaaataaatcaattgcacagtttgcatataaattacgagacgaatattttgaacctaattacgccatgatttgacaatgtgatgctacagtaaacatttgctaataacagattaattaggcttaataaatttgtctcgtattttatatgcggaatctgtaatttgttttgttattagactacgtttaatactttaaatgtgtgtccgtatacttaaaaaaatatttggccaagaaactaaacacaacctaaatacctaaattctacataaaaaaattgatatcttgagatactctgaagtaccaagtttttatgttagaaaatatgatatctttcggtattttcttaaagatgataaaattacttaggcaactttttctttaattttctaacttttccatcacattaaaactttcctacacacattaactttcaacttttctatcacatcattctaattttaaccaaactttcaattttgatgtgaactaaacacaccccctattttgttacaccgacacactaggttagtcctagagaagctagtgattcgagaaatgaccggatcgcgcacgccaagtctttgtatacgaactcaaaatttgcagcgatcgatgacgtcgtgagacaagatcactcacgcccaatgttttggatcaagggaaagggttgactcttagcccggctcactaataatatagactccgtacacattgtctgacactctatcgatgactatgagactgtttgactatgaccattaatttcttggacaatatctacattgccaataaaaaaacataactaaaaattcttaaaattatttcaaaatatgagtattaatttttttttgtatgaacatttcaaaatatgaataaaaatataaacagtactcatattttgaacatttcaaatactcgtttcatattttcagtgtacctgtgagtttgtgacaaaccagcctgatatgatatgaactgttgtgcgcggtgtgcctattaaaactggcgctgttttgttagactgcatgactcctgaactatgaacttctctagacatcttctcctgaactactgatcatctcgtcccatcttggctgatgaaaatgaagatggttgcacctaccttctgcagaatctaagtattttccagccaggatctaagattgagctggaccattgttggattggtctgggccgccgccattgtttgtcccatctgggccttcagatatgtttagactataactgggccttgccttcttggattagaactggcccattggttgattgatctggccctacaagtatgtttacattagatactgggccttatcgcaataaacttgacgaataagttcactttaggattctcaacttgtcagcaagtctgaattcatccctataccaatataacgggcccgacaatttacaatacaggatcacccaagatcctgggcagtactatgcccgatttggcaagctgagtcagcgtgagacccacacgggccccacaccacacagaccccacatgtcagtggctaacgctttcttcactatcttctcccatcctcccaatcccctcagatgttcaaggtcccatctgtcgtcctgggtttcacgccgactcggcttaccacgtgagctaaaagtttaaaacaggcataatactatctaggacgttggatgatctgattttgtaaattttataaattgagggacttgtattttggcttagagataaatttcagaacttatatctaatatttttgacaaattgagggacgtcaagtgaacttattcctgaacttgattacctgcccgaggccgtacttaccaattctcccaacgcataatatccactttaacgtaacattccagatcagtttaccgattggcaatgctattgctgcgcacagattaatcctcctactaacatttaaattcaccctgagaatttgtgtatcaagtcttaagaataatgcatccttcggttaattaggataatgattttagaggaaacaaagtattctaatcaaaatgtaatcgaaaacagtaaaccattgcctaagcctcaacctggtgtgtccatatcatcagagaaaccaacacaggtgcatcatcagggagacagtaagctgcttggcgttcacattgccaatacaaaaaacaaaattctccacgcaggaaggtaacaagcaatccaactcaaccgttgacttgtctttgtacttcggtgcagtttttattacaaaaagcaagaataacattcattggtatgcttacagcgccggctgtcactggaaaagaaaaccattatggagtgtccgagcatttcaaaatgccttgagagatttatggcctacaggaagtttctgatgtccaacttcttgacatcaggcatctcctcgtctttgaactcctccctgataacaaagcacgtcaacgtgttattaacctttttcaatagagacgcacacatgatatgatatgcactggatattagttagcttgcatgcagcaagctgcaactcttattacttctgataagtcccaactcaagcagataaccaattagtatataaagagagatgtacctctttagttgaacctccattgcttcaacacattccttcttaagctccgtcagctcacttttggcaatttccaattcaagctcttcctcaatcttgggaagatcctccttgcggattccaagcctatttgaaattttgaaatggaaagcaaaaaagcatgaaaaaggttagtccaactaataaaaaatatatataacacatctagcatgcacaggaggaagaaaaatcaatatatttccctgcaagccagcaataatggatctcgatcacctaagtacggagtaaaaaacaagctacagttggttacaccatcatctgagagtatatttggtcccttaacccttgttagcgaacaagaaaactcttgctagtgagcaaggtcagataaaataactatacatgccctgaatcgcctttgaaaccagaaaattatcatgcaagcagcttaaggaattgcacgtttgatctatcatgtggatttttattctcactgaaatattcagaaaaagtatatctctagagagtagacgagcagtgtaaatgatgatctgaactatctcaaacttaagttgataacaaaatgatgaagataaatactttttgtttatcttctcaaactctgccaagaggagacccatattcttcttgtcactcctcagaagtggcttcttaatctccttctcaactttctcaagggcttccatcatcatagcctcagcacccatatcatctataaggccactcctatgtaacattaagtgaacagaagaatattcagacaagcaaatagtgcaataaaattgttatgtaggcaaatatcacattgatttaattctttacaagggtattttggggctgagaaaaacataagatgaaaattgtgaaaatgataatagatgtactttatcctgatctcctgaagagtattcaagtaagtccgtgcatcagggatgccctttgtaaaggtgtcgatggtatatttaatcctctcagagtcggatagaagatctgccctgcatttacacaatggaaccataactgagtaaatagatcaataacatccagaataagtgttacaaaatgaaagcaataaagtggaagcctatctcgatagaagtatatatatatatatatatatatatatatatatatatatatatatatatatatatatatatatatatatatatatatatatatatatgccagagtatgttttgctgcataggatggatgcattaatgtacaagtaaaatatttttttattttcgatggggcatcctacatcaatggggaagatgaaaaattgtactagggcaaaccggcaaacagtagtaggtaataagtaatatcaaatgggagttatttctacatatatactgaaatatacaatagtgcttaatgaattcaaggtttcgtaaaccgcaaaaaatctgatttatttaataaaagaactttacgctagagaatagaaacaatcaccacaaatatgtgtaaaataaacacaaaaacaatgacaaatcaaaggaaagtaataaactaaggaccatgaatacatgtgacagattataagtgatcttacttttgtcttacagtcttcatgacttgggcataacgagaaactgctgcaggatcatctggatcaatagtgatcttttccttcttaagtacaccaagggcagtctcaaatttcttctttacctcaaaaaatatgcccttcaataggtcttcatacatacaaaaaaaaaatcagaccaccaaaattataatacaaagtaaattgtgcaacttaaatacagaagtaatcagaactacacagcagagtttaatcaaacaaactccaactcatgaacatatgtaatctcttcagttttgcattgaaaaacattttttgaatgacataaaaacacataacattacttgtgatactgcgatggacaaaggtaaagtacagaaagcatttttttctacagctcaacacaatggtcttatggaaaggagttttgcagttaggattaaaagcatttgaaattcctacagaatttgcacaaaataaattgttaaatgcacttaaaatttaagaggcttaccatcaccattgacgggagtacgatctgcctccttggcatacaagcggacttgagtggcacctccatttgccaaggcagcttgagcagagtatagctgccagaagccagagacattaaccaatgacaattaacataaacaaagttataaaaaaagtagagaagctagagatttctaaaacaaaacattccatatagctttgtactgacaactttaccaacatggacgtccttattacataacatatacttcctccgtttcacaatgtaagggcccctttgaatcgcagggtagaaaaaatggaggaataggaaaaacataggattctgacaggaattgaagtgtaaaacagaggattgcaaaacacaggaaaaacacaggaatggtcgtttgattggagcgcaggaaaaacgcaggaatcagatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctatgaaattcctacataaatcctttgattcaaaggggccctaagtcattctagcatttcccacattcatat

SEQ ID NO: 68153 - DNA, 8953 bp, Oryza sativa
gcactaaaaaaacgccacccacccccagccaccgcatccaacccccaccattgcaaatttgcaatcgatcccaacaaaaaaaacccctcaacgcaaccaaccacagatcccacgcaaaaccgaaccaatcgtcggcgccgccgccggatcagatctacctcaaaactagggtttccgcggcggggcgcgcgtgcgcgcgcggggggacggggacggggacggggaagggagatgcgaacctgccgggagcgggagacgaggcgagcggccaacgccatggctgcggctgcctccgcttcgctgctccgatctcacccaaacctccaagctccgcggcgagagcgagagcgagagagagagagagatggggatgggtggagaggagacgaagaaatggaggcggcgccgcgctttgtgagggctcctccccctctccccgccgtccgatcccccgatcaccccgcgcgtccccgcacgaatctccaagcaatcctgaccaatgggcccatccggttcgatcttgtattttttttacttttttgttctttttaaaacttattctctcgcattttcatttatgcttatatttactgaccaaaatttttattttaatattaaatttagagtgttttttttcgaggtttatttttcaacctttgtttatatatatatatatatatatatatatatatatatatatgacactcatatggggcaccatggtgcccgggcaccatggtatctaatgcacaaaatcactcaaaattttcaaattgtgagtatatatctagttataataattcgattcatacctatacctatcaacaaaacaactcaaatttaactttatttcacaatccatgattacatacctaactaattatatgtatagatgctatatacctagaatcaaaatctaacaaaaacaagttcaaattcagttcaaacttgctttgaactagttagtaaagtggttaatgttaatacctaagtaactgaaaaagattcatactcatttaaattgggtatatactcaatttcaacaatggtgcccggacaccatggagcacaaaacaaatttactatatatatatatatatatattatttataaattattttatttgcaatcataccgaataagccatagagcccttatttataaataagtttttcggaaaggactaaaatgtaaaaaaaatatagtcgtcgtgttcctccggctcggcggctgcattgaccttgggctccgccatgaactcgatgctgctcaggccgctcccgagcgcgggggcgagcggtggtcggggctcgccggggagggggcgggtggttggctcggcggtgagtttcggcgggcgcgggagatggcggcgcggggtggcggtggtggcggcgggggcgggggcggaggcgtcgtggatggaggaggcgggggtggcggtgctggaggagggggtgaggcggaacccggcggtgtcggactcgtaccggccgccggggatgccgcggccgaacgcgacggtgctggaggcgcaggcgcgggtgtgcacggggcccgagcagacgcgcccgctcggggaggagcaggccatgcgcgtcctcgacaccatcctccgctccggtgagtgagtcaagtcaccgccatccttgccggcgggtggcctcgcactctcgccgcttcagctttggtgatttctagcatcgatcggatcctgcgttgcagccaccgtctgtgcggcaggaaattgaaattctgctgctttcactgtcactactggaatttagaactcgagtcctatgacactaatatgtagactgcggttagttttgatccacattatgatgattgcagtaacatctcatctccttttatctaggaatgcaaaattttgcttgaaatggagctttctagagtttagcacttttttgtgaaacattagctcgcgatttatgctcaattgtactccggagtgtaatactaaactttcggtgggacatttattgactttggatactgatttttacaatttgcttgtaaggttgtatttgagtgacaagtttacagtaggtctgatttgtgattggtttattttcattgactctttgccttccataacaatcttatgatatatgttacttataatctcttgtgtaggaatgggagaactcaaagatgagccagtatccagtgcacaactgggtgcattcttcgctggcatgacaataagagctaattcctttccagaagccacccaatggagtgagggtgagcgtcgtgccatgagcttattttggccacggcttgtcaatgttcttccccccgaggtgaaatttatagcagatccggaaggaacaatcatgggagcaaatggtttaactggacctcggtatgttggtcaaagcactgcagagatgagacttgtcagtgctttgagagaagttcttgctggtggccatttgggttatgaggaagttcagggtgtactaaaggatgttctaccagttgaattagccagtgcaaattcaactatggttaatgaagcactgctggcagcatttcttattggacagcggatgaatagggagactgatcgcgagctcaaaggatattgtctagcctttgatgatgaattaggtaacatcaagtcagtttctctttctcaaattgaatataaaaaaattatagtgtcattaacaccacattatatcaggtccaactccagttgctgatgtcaaatcattgacacactatggtgagccctatgatggaaatacacgctttttcaggagtactctgtttgttgcagctgttagagcctgctatggtgaggcttgtctcctccatggtgttgagtggatgccacccaaggtcagtacaaaagcatacccatcaacaatcatcatacactagtgtttttctttaatgctatggaagttttggttaggagatggacttacctatcacttaattttgaaaaccctctgtattacttaatgatcaagattttcagggaggcataacagaaggtcagatgcttaaattcatgggtgcaaacacacatttgtccacattacaggccaaaacactactggaggtgtgcatgaacttctgcctaattttcctgcaaccctttttgtgcactctcctctgactgcatctaattatatcaactgttttggttgctttcaggatgagaataccggctttgcatatttgggtctccaagaagcttgcccaccattgtaagttttgacattttcttggtaattatgtgcttcagtgaccaagtcttgttgatatagtattcctgtagacattcagataatcaggaatggcacctcagcctgattttctgaagaaaactgatcataatatctgacttaagtccatacacagccatgaagtttagcagtaaaattttcaaaatggaatcactgcctttacttttttttggaactgcaggaaacttatgctttcagtttaaatgttgccgctttataatatttgtcttcatttaaaaaacaatttattgaaagttgtaatgtatgaaaatgtgttctttttactcactattcttccagatattcgattattgggcttagggagcatattaagaaacggccaccgctagctacctctgagaaagttcagcaatttgtgagagtgagtaactcttctcatccacctgtagtcctttattgtaaggaagacagtatcataagagcaccataatgggtacaactattataacttttgtagcatcctttatgtttatatatacattgtagatcatttgtgcatattataccactgtagaacataaaattggtcacatttcactgctggcagatctttgataaactactaatttaaatatttagtacaacctactgtcttcatttcttagtaaaatgtttggcagtttagtagcttacattttcagagtgtttcctcaacataatgtatgcataaaaaactctttgactacaagtcaagaagactggagatatttcttgtaattctacattcattgaatgtaaaaatataactgttctgtatcacctactatttgggaatccttgttaatttgttgtaaatttgagatgaatgcattattattatatgtccttccttgttcaattatgtttctgttgtaaatgtcacaagttctgctcacttaaataaatactactggttgattggcttatttgtcttcaaattttccaccaggcgcgaggaagagaatcaatggttgctggattttatcatgtgggctatgaagatccattgcttatgctcatgaggaggagaactgttcatgctggactagttgtaaaggtattatcttgtgttaatgtgttatatggcgggtttaagctttatgttactgtttagatgtcttgccccatataacccagcctatgggtttatttgtgcacttgttgctaagaccacatatgtagaaattggccgccttgcgctattaacattttgagttccgtttctgacagataggtcattctcctgaacttttgaacaaacagcttctttcccttctctattattctcggaatgcaaatccaataattaaacatggtcatttctcaaatttatggtgcgcgtgtagggtgaggagggtgcgctttctatgacaaccaaagaaagatctgctcatgcatcaaaaggacttccagtgaaccattgctcagggttccggataccaaacagcacagatttctccgagactgatggtaaagatatttcgctttttattgattataaatattcctcttcatagtgatcatatgtgtttgttggtgatgatggggtatgttcagtgttttcaaaaatttaagatttatacatcttggaagttgattcatattttttttaaaaaaaaagaggttttgtgaatgactaatctggattgcttgttttgaaatgcccaataacatggttatgaaataatttcagcctgagcttgtctcaatcatctttcaggcatttctagagagggcttcagtgtcattgtgaatgctcaggaacttggttttgaatccactgagactccacgaactgatagatcagtaagccattttgcccatgcctgcggttgttctaccttagtttcatatttctatatgccgtcaacttccaatagaggctggcagtcatccatacaagtctgttaatgctttgtaaaatgttccaaattacccttgtattaacgtgtatcaccctgacatgttagtaggatattatatttttagcatagttataatgtttacttactgtatctccggactgaatcaggtcctgaaaaacttggagttgggtttggcagcgctgagtggggagaaaggaccagcctatgacagaatagtcctaaatgctgccatggttgaccacctcttaggctgcactggagctgaggatatcaagtccgcacttgacagggcaagagaagccattgacagcggtaaagccctgagcaggctcatgaattacataaaaatctcgcacaaagtgtcctagctcgcaagtgtgctggctgtacaattttggtttctggtgtcgtggtggaatactctcatcgactcatacacgagcacgagtgctttcaagttgctcagctaacatggagaacatccctgacgtgaatagtcacttgcaaggccttgtcaataaattaactgaaagtctgaaaaactgaaaatgttagcgatggggaatacttgattaatcaatctttctttagccatgttctgagagaatctggctgcgtgtaccatatgcaaattctgttcatgagatgtgtgaccgaatacctgcatcaagacacaagggatgagttatcttgattttgttcgtgaaacaaaatctgcaattctcgttgtaatgggttactccgaagtctgaatatgggtgctcgtttggaattacttgtactgtttgtttgaagtttggttgtgcaagagctttcgagaggatgcacctgttgctaccgcattttcagttttgaacccctgctctccttacatctttttttctagaaaaatgtgcatgtacttgaagctaatgtacaagctcccttttcacatgtctttttattttcaaattcaaaatttaagtcgagttttggcctcaaatggatcacccgtgcttccattttcctctctactcccttcatcccataaaaaaccaacctagtactggatgtggcatatcttgtacaactaattgtaacatatccctgtccaaattcgttgtactaggatatgtctattcgttttttggtgacggagggagtaggtaccaattcaccaaggtcagtttctggcctagctaaaagaaaatcgaacaaatttcaaacgttagtgcatgcaaaatgcaagtatatattatgaaaaatgtgaggatttaacttttgttatgttggttttgtagttattataccctactaaggccttgtttagatcccctaacaaaatttttcaccacgtcacatcaaatgtttggatacatatatggagtattaaatataaacgaaaaaataactaatttacacatattgcatgtaaattgcgagacgaatcttttgagcctaattgctctatgatttaacaatgtggtgctacagtacatatttactaatgacggattaattagacttaataaatttgtctcgcagtttacaggcagattttataatttgttttattattagactatgtttaatatttcaaatgtctatccgtatatccgatatgacacggcaaaaaatttcaccctggatctaaacgcagcctaaatatcaattgtacaagaattattgaccaaatctaatttttgaacactccgcaaatcaaaatgcatcctataatatgaaaacgaaatttgaatttatgtgcaaaacactcttgtccgtagcggcatactacgcctgacggtgacggggccatacgccgcgtcgccgtaaatggcgaacaaggttaatggggaaattgcgattggttcgccttcccggctgttcccgctctcatggctgcgccgccgccgccgccttcgccaagctcgggagaggaggggacgagcgcaatgtgaaaccgggggctaccccggggtgaagaacgagtgacggcgggcggccgccagcactgccccgtgccaaaagcgccgttgcggtagcaggtccgtgtgtctcctccacggcatgcccgccacctgctcgacgatagttctccgccgcccgctctcacatttcatgccgctgggtgtgcgcccgcgacggggatggagagcattgtgcgtggaggaccgtggtccgtggatcctgcagaatccgcgatggatgggttttctgtatgcaatgcagatgcagtgccaatccaaagttgcttcctgcgtttgggattgtcatggtgggtgggtggaatgttgagctggcaatgggaaaaattaaggtttatcgcctcacatcaggttaggttctacaatatcttctttttttcctctcttcagcatttttctactactcgtagtagtagaatgctaactgtagaggccaagtactttttctgtagcgaaggtctgtccagcattcattttgcttatccaaatgaaggcgtaggtcagcaacatgagtagttgcttctttctctaaggagtctgaactgtgatttctttgtattcattcacatgtaaaacctcatcctactatgttttagcactagctagattcagagcaaaacaccacataacatcacatggtttcatgaagaagtgtagaatatgttgcatgattaccacaaaacaacacatgcatatcaatgaggaagtaacaaaaacaatatgccatgtacatgttgttcacctcacaccaagttggtgaaacaattacaaagtttatggaaacttgaactacacactgcctgcctatatttacaagcgtccttaagaacacaacctttgaatgaatcgttcatacaaaattacagatggttcactaaacccattgcaatatcctacacctcacataaattccttacaaaaatacatattgtacaagaattacatgctctaaggtgaatcaattttatgattttggtgattcagactttgtgtgcccaggtttacctatgatggctttcttcacttttgctagttgatgcttcacctttgatccaacaccagacaaaatgttatgttttttatgtgataccttctgttctgctcctcgttcttctattttcactgttgcttcatcagtgatattattagtttcctcttcagcctttgttttctcatcacaagtattctcgtctggcttatttgattcatccgcctttggactatgttcttcatctgtgctgaattctggctttgttatctccacaaatttttcgtcggcctcagaagttgctttgggtgaaaccacattgagaccacgttcctgaacctgtgaatcaaaaagttctttctcttcattagattttatcttcactgcttgagtgttaccttcaactgtttcatgtacattctcttctttgatcacaggctctgttattgccataaattcctggtttccttcagtttcttttggtaacttctgtgcagcagtttcctgctcctcctgccgattagaatcttcaagcttgtctaacacggtgttatggtccaccacagtttggttatcagctgtttcatctttcttatcttggttaacatgcaaatttggactatctgagtgtgtctcaagggctttttcaaagttgctgacttcattgtttgagatcatactctctttcttgtccatgcatgtcgaacttgcaggaatttccttttcataagcaaaatttcgatcagtgtggctaactggttcagttatttcaggtgcctgctcatcagatatttcttcagaacatgtttctttcgacttatcatcatgtaa

SEQ ID NO: 68154 - DNA, 739 bp, Oryza sativa
ctctccacttgaccctcagtagtacttctcacttcaacataggaagattcaatggactcttcttgttctgtgcaaggagggctttgaacactgtcagcctcgttaggcaatttttcagcgttgcctgtatcgggttctatcaaggagagtgtttgctcatcctttgcaccatgtctattttcatgtaaagactcatgcggaagttctgttcctacttcctccaaagcatcctcttgtgaagcctttgggcttgttatgtcatcttggtccctattcaagcttccgtcttcaatttctgttgctgcttccacgttttcctgacaaactgtatcaaatgactcttcatccaattcaaagtctctagcttccatttttttgatcggatcagctgccttggctgatatcagtttgctagaaatttcatcctgggcattatcttggtatactggtgcttccaaatcacaagtgttccttttgagctcttcatcagtttccaatgatttttggacgtccatctcgacatcataactctgttcttttactggttcttttgtttcttcagagccttctaccttttctttttcttgttcaaaggtgagtttttcatccaccgatttttctataggaaatgccaccaaattttcttcttgttgagaagcgatcaaacaacttccatccttcgttgtttcttcttgctccttttcaacctcggtttctgaatctttctttggatcatcat

SEQ ID NO: 68155 - DNA, 714 bp, Oryza sativa
attcctgcagcccggtggcagtaagtttgcccctaatttttttctgattccttccactattcagttgtcgtttgaaatctgtacagtcagttattgtttcacccatcttcttgatggaacttgattgttgtctctttttgttctccaggagctcaaccttgggagagatagggtgagttcatggctctctgatcattgtgaatcttgggaagagttttggacttttgattgttgatggcattttcaacacgcatctgattagccaccatctttcttcttttgaagctaaaaaagctgcaacatcaactcgcttgctcgagagctgttatcgcaacaaaaacatcagaattggaggtataggaactgatgctaatgtcgttcttgctccaccttcgtttcataaattccatggaaaatgttgatgcaatttgctgttcttatcctcttattattgcaggaggccaagaaggcgatgaagcgcaataggaacctgccactgccagagaaggctcctcctgcaagcgaaacggcgcagcagcagcagggttctgatagagcggcacagatcaaggatggagatgtcgtcaatccagagcccgccgcggcttcagacgcatcgcatgcggcaagcaccaagaaactcagcaacgccagcaggaaacggatgcaaagatctcgatgtaacaatggccgctaaccattttgcttgcaatg

SEQ ID NO: 68156 - DNA, 4377 bp, Oryza sativa
atattgcagaacagcgtctaactcattgtaatcaaaatcctacagagaaatgtagttacaggcattatttatagccaaacaaaatccaaattgttttataggcacaagcaagaacactaacctcaacaattgtatctgtaccgtactccttcctccatttaagcatgtcagtccacatttgctttgctttctcaatgtcaaatctccttgcttttagaaatctacacaaatcaattagtcaagtcatcagcatgtttgcagttgggttaaaaaaatgatggtaagtaatagggtatatatacctcagcatcatatgatagtcatcatgccttgcaggcaacaactcatccaaaatcagtgcttgtctaaatgcttcaactgcttgcagctcctctagatcacgcacatcttcaatagacacggagaggacccgactgccgctcctcctcttcttctttttcaaggaatgcctaattttggttgatgcatctatagcttttttcttcagagaacccattcttgttctcttgtcatcttcagaattttcaacgtctgacttgtgatctctcttgtcatcattacttgaagacccttcaaaacctggatcattggaaattttagaatgcagataaagggtgatatttctaaacattctaaacaaaagaactgctcatgccccaccacatccaaaaaagaaagaaaaggaaaaaaatctcggtaatcgtgcaaatttacaacaattagctacttgtacataaataaataaataaactttgacaaccgctcaacttatttaagatataaaattaagtttgtctaaactcttcatgctagcaagaagacaaggtgatgtcaatttttcagcaatctaagcattggaatagctttgttcacaacaatgaatccaccaaactagcttagttacacaactagataattcaatactaacaaccttatgtatccaaatggttacagctggaaattttgtcaacttttgtcaacaaatgttatgtaacttttgtcaacaactatacccaaacaatacaagtttctacctaaaaaggatttattcaattcttttttataagatgatgaacatcaaaatcctacccaacatgatatatgtgttcttaattgtgacttttagtgtacgctgcgttgaaatttctggccatctagtcaaccagattcagaattcatgaatttaagattgtgcggagcttgaggttattgaactggtcaatgcagtgttctatgcggaaatcgacatgaaaccttctccttgtatcaaaaacattttctcccttcaatcaagttgaagcctatatagtaagttagtttcctgtcacagaaaaatccagcaccaaaccgaaagtcccccgtgaattttatgcttcacaagtcaaagcatccaacctagcctggccactcacattctgggagctacgcgtccatcaaaaccagagaacatggaaccttcaacaagaccagaacagcacaatattgaaccggtcaaactcgaaccacacatagactggacgcaaaccgtcctacgactcgatggatactaagccctaacttattccaaaccagaacacacggaagcgagagaactcgcagcgagcttgattcgcctaaatcctaaatctaatctagtctctgtgattaatccgggttctaacgcggcgccagtgcaggccaatcctcacggcgagacatcccaatgcagccaatccaatccaatctcataaccccccagcaatcaaatctcccaggaaaaaaaaatcgagcaaaaaaaaccccaaaaaacagaacggagagaaaaatcaaaatccccaactcacatggccgcgcgaggcgatcgagatgccccgacatggacgtcgtcggacgaacaagcacagcctcctcctcctcctcctcctcctctcccaaacctccggatcctgcaacgcaacccgcattccccgtcagaaaccctagccccctccaccccacaaaaaaacaaaaaactcaccaccgcggctacctcgagcaccgcggagatctcgccccccgatgatgtacccacctcggtcggtcgtcgtcgtcggcgccggcgaagcggcggcgcgggaatcgaatccgaggcgaggcggtcggggaggggaattttttggggagaggcgtcgcggaggaggaagaagagagagagggagagggaggcgggtgggtggtgggggaaaggagtggggaggtaaagtagtggaggtaactttaaagtaatggaaaagatgggaggaaggaggcgacgtcgacgaggtggaagaaggaaggaggagcagccgatgccgattcctccgggaattcggtgcgcgcttcgcttcggcttgtgtggtttcggattcgcttccgtttcagcccctcgggtttctgggaatttgcgttcgcgtcctccctgggttggctgatatttgtggcgatggaggcgttgggtacggtgggggtttagctaaccgtcttggagtaaaaacccgttctatatctgtttacccaaaactaaaaaaaaaagcaaggattttcggtaacctttgccgttttgggagtaaaacccattctttgttggtttgttgaaagcctgataagaccatgaaaaatatgtatgaaaagattaccagtttgggagtaaaaatcgctctacctgagaaccaaacaaaaccgaacaaaaatattcaaggacttctgatgaactccgtataaaaatcagctaaaacatgttacaaaccagctgccgacggttttgtgaaacaaagtggtttttcgtgataactatcaacgttaaccatgtatacattgatgtttatgtggcaagttatgaatatcatataattgagttcatgcaatatcaatagagtcatgggttgtttgggttggaataaatttgggatagtagtggttattatattagtattatagcattagataaatattcttgctatatgctgcttatgtttgtgataaatgcattgaatgacgacaagcaaatatattagagcttaggacaaagaacatggcgtgtgaaaaagagcgtgaatctttgaagtttttggcataaagtgatactcttctactttgatattgcactaggatttgtcgagcaataaccaacatgagattctcattcttaggcctagttcttttcagaatataaccgctagattatcatgggcataaaccttgtaattttttaaaataaaactatgtagggatatttttcttaaaatttttgaatagatctactttttttcaagtttttaatctttaatacaatcatgtcttaattaagtgccttctccatgaagctaagtgactaatcgtccgaaaagctaaaacggtccttagtgacggccgggttgctttagggtgaaaaaagaggctttattagatgtagttgtataagtttctttttgtaaaaggatgtttttagataaaaatttaagtacatgattttgttgaaagcaaattgcagaatgcgtattgctttattggatgcaacactaatattcttctaatctactttactctctcccataattttattactcgtattttgttcaagaatgagattgagacagtgaggaatcgtagatgatcattggaaacaagatggataatacttaactgcaaagtgagagagatgaaagaggatagatgagcgaaaacctttttaattatgccgtgtgattttatacatctttacatgccagataaagtaagaaggcagtgtctttttcttttctatataatataacgcaatgcccttttctttctccagaaaacaatgtcttttttagacaaatgacgacgtaacaccactctattgcatgccattgttgtttaaaaaacaacacaggtacgcgtttagtatgtgattagcttttctcacatactactagctctttctcagatgtatccacccagccttcgaagaaagatgcatctatataaccatgaacataataagaaaaagggaaaatagataatttataaaaggaataagaccatcgttgcgttcaagtaatttcacactctcataagggtctagatgtaaacaaaatccacccagacttcgcagcgaaaaaaaaatatccccccatattggactccggagttttgacccggccaaattttaggtgggaattggagcggatacagagaaaaaagaaaaaccaaaaaattcagcaacggtgcggagaggtaggtaggccccacctggctgttgccgcacgtggcgcgcccgcggggagcgccaaccatgggacccactctccaggccccggcccgcccgcgcctaggactagttacattttttcatgtacccctcatagttatcattat

SEQ ID NO: 68157 - DNA, 12141 bp, Oryza sativa
ctcctccgtcaaaaaaagttataaaccttaacacatccggtaccgtgaatctgaactatcctaattccgtccaatacacagtctcatctttacgattatgtttatacttattagctaaaatttattttttcaaccttaaatttatagctgattttgaaggtttttatcaaaatttatttttcagcatttatttttatatcactaaaaacacacacacacatatatatatattatttataaattattttttgtttataaatagtataccgtatggcttattccacaaataaccgagtaaacaattgggctgacagaacagcaagtacggtttctaccatgatggcagccaccatggtagaaggagtaaaacgcaaaaggtaatactagcagcaacagcacgtccattctgtcggaggggtacagccagcggaagaaccctatctgcgtcactgacaggtgggccccggtggcacgtatgccccacctgtcagtggcgcgaccgcagacgctgctcgccctgtagccggccgttagttacagctagtagccgtgacctgcctgggattctctgcggctgctactgtgcaactgctggtgggcggggcacgcatctcgaggcactcgagaagaagcatgtgaagatgcgatgggaaatgaatgatgaagttggattggatggtcaatgaggggcaagaaatgcaggatacaggtagcagatggcagctgcagcacgaggctggcagcagtagtactaggagttaacacgcaaaaggcaaggaagcaagcaatgcctctgcggctcagaacgtggcgctccagtagcgccactgtttcgtgcattggcatgcccctaattgtcaccattttgttttaatcctaattggcttcgcatttaggggaatgtttggttggtcatcattaagtttagttagtttgagatatggcggcacatatgtggcttagaaatagttggccacggtccataaatatggcatgcttagctccaaatttaagagtatgatactctctcagttccgaaaaaacaaatttagaattggatgtgacatattctagtacaacgattatggacagaagtatgtccagattcgtagtactatgatggttttttatgggacggagggagtatgtgggttctaaggctaaaaaagtgtggtatgacacaattatgatagtgaaacaaacacatacttaagaaattgtggcataactaaagtgtgacaaggcaaagtatgacaaccaaataattaattttgaacataccagttccttcaatccttaacatagtagcaacctaaaatccgatagaatattttatagtacctataatgaatttgaagtctggatgacatttttttagattcgttgtactataatgacatattcggtttcatgttgatataaatattggacgaaagaagtcctagttcttaccactgtcatattgtcacaatgagcaaaatttgctactccgagttgctgtcaaattttgaacagtagtactgtcttggcagaacttctcaccaggttgggattcgtttgtaagacatgtttaacatcagtaggagtagataccaccggtatgattaagtgtattaactacatgcatgacagtcaattaatcgcgccgtctcttatgattctaagttgctggctcaagttaagtctcgtcaacattcttttcagaaacgaaaacagactactgcctatactacttgttaattactccagctgcactgcgttcttgaccttctcaaatcagacgatcgaacaaattgccaatttgtcagcagttaattataaatagtcaagaattgcacaacaggctcatcagctaggccattcacttataatgcaatgcaagaaccgtacgtacaaaactaccactagtacagaaccagtgcctaattaatctgctgccagttaagaccaaaatctggagtggtttaaacggattgattaatcaaagtagatgatggatttttgcattagttggtcaatcaaagcccatcatttggggcttcttcatattcatatcattttaaaccatatcactgtttgctaaaactgatatatttagtttgttaccaaaatattggtcatgattggagaatttgacaacactatatttagccaatcttattaaaacttgttaatgttatcaattaatcaaaattttggtaatacaaaacgttgaaaatggctgtaaagtgaacaagctcttggtgtttgattagctagcaacctcgtcattaatctgtgttgacttgctccgtgttcgtgtccggtgcgtgaggtgagctggaccggaccaaatccggcggccggccggtgagccgccgtacgacggatggaacgcagctaattaagctagcttagctcaatcatcgcttgattaaacttcaagacagctaaggtttgtggctacctagccgtgttgacattaataatactctgctggtatttttgtaagcaatctaatctggtactccaattgagatcgatctgcgacgctaatgatcttctcgctgttcacaccgttttgggcctggtcgatttgaatataatttgtagaaaaaataataataataacagttgggctaatgattatctgtagttagggcatggattatggatgcatggaaggtgaacctaacgtctggttagctttcagacaacaccgtttcctcttaacctcacagtacagttttgttcgtgtaccactattattgcccattgaggcagacaggcagagcttttgccctcctttcaaaaaagaaaaacaattattgctcatttttcattgcacgaaaaacattcagcataaaagaaaaatcatgtcatccctatctcttgtttccttcctgggtgttgcacaagtgcacaacaaagttgtcagtacaatgcaacaggatagaggcagctgtttttataaatgaaatgaagtaaaataaaaatattctactccatccagtaaaaaatattttaaaaatcgactgaatttttttcccctaaatgtcaaatactccactatctactatagggaattttatgtggaaaaattctctccccccaccccacacacacacaaaaaaaaaagaaaaagaaaaaaaacacaaagagcttcagaacatcctctcagcccaacccatctccaagcccaactcaacacaccctacacgcaccccataatatgggccttacaatctcaattcggcccataccaaaatatccgcaccacgccacgccacgacaccgaaaccgacttccacaccacgcgggccccacatgtcacccccacgccaaataacgcacgcgtcccacgagccaaaccccaacccaaaccaaaaaacagaacacaaccacacgccacgaaacgaacaacaaaaaaaagaaagaaaaagaaaaaaaaaggagaaaaaaaaaacacaaccgcgtcgccctcctccgcctcccaacccccctcctcgccgcggcggccaagtcgccgcccgccgccgccatcagagtccacgcccaagtcgtcgcctccatccacctccacctcctcgcggtttccatcccgcgaagccttggcaacgaaggattcgtgctccgatttggagaattgggggggggggggggagggatttgatcttgtggtggtttgggtgatcggtggcgatgggggagggcgcggcggggtcgtggtacgtcacgagggatgaggtcgagaggggttcgccgtcgaggagggacggcgtcggcgccgccaaggaggccgagctccgggcgacctactgctccttcatccgcgacgtcggcctcaggctgcagctgtaagatcgatcttctttcttcctttccatctggttgtcgaattcgatccattctcgcacgcggcgtgcgcgttaaatctgttgagagtgatttatatgttgttggttggttgctgttgatgggggcgcgttggatttgggtttttttcctgatgaaagatgctaatttaattttattttttgcaggcctcaggtgacaatcgcgacggcaaccttgctctgccatcgcttttatctccgacagtctcacgccaagaacgagtggcaggtaaaaaaaaaatgcagttcttcagatacggatgcgcacatttgtttgcccactagttgtggcactatccaatgttgaaaatcttcctctgaggttatagtgacactgataattaaagctaatctgccattgccaacagcgagtgaccaaacgcttttgcatcagcaaaaatcagtggtgccatttcatccgttaaccaactgtttcgtgttttctgcaatcgatgttctgtgcctgtagcacactgagatgcaatggccgatccaggatcaaaatcccaaccctgcggagaatgtatcaaaagattatatatttcagtttcaatgcaaatatgagaaattatggggttagttgaccccgcaggtcataacgtggctctgccactgctcctatccacaaaaatataactatgtataaaacaatctatatttgccaccataaaaactcttgggctagaaagctctacgcactccattgagggtaaaggtgttaacacttactttttttaaccatgtcgtataactaacttcatttcttacttgtgtagatgttttcggaagttaaaacttcctatttttatccgttggatcctaacattacctgactatgtaccatcctctggggttagtcgagggtagtgtagtcacgtgggttgttaagaaaattacaccggcatggatatatggatacatacaagctggtttgatgtaaatgtgtataatcatttggagcactgttgattggatcattccttatgtggtgtactggtcgttggagtgataaaaacttcccatgaggggtcttttatgaaatataagcgttgaaaattttcacttcgacttgaagttcgcccatttaagtaatgaatctggaagtgaggtatagctttaagcaattttactcggagcaccaaaaattgcaattttgggcaagacacgtgattcttgggagcgactttatcaaacttgaaggcaatgctttctattagtactatttaccagtaagtaataacaacttgtctttattgctatttgccttttccaatataggtgcttatttatttctagccatgggaaatttaatcctagatttgggcccatggtactaactaacacaaatgcgcaagtttatttaacaatttttactattgaacatgtaaatcatagttactatctgttattccagaccgttgcaactgtctgcgtatttcttgcttcgaagattgaagacacaccttgcccattacaacgtgtcatcattgtggcatatgaaaccatgtaccggaaagactgtaacgctgctcacagaatctaccagaaggtgcttaaaactttccattttttctattagtatactcttgctatataaccggcttctttgtcataacttttcttactaaaagcaggaagttcttgagaagcagaaagagctcattttggtaggggagacgctgttgctttcaacaattaggtttgatttcaacatacagcatccttacgagccactaaagctcgctctcaagaagctgggcattttccagatggaagtgaaacaagttgcggtgaatctaataaatgatgcgtaagttctttgcgtcaccttgttatttgtttattcttgaaattgcaactctgttgtttctgagttggtactgctgtcctgtttatgcaggattcggactactttggttgtgcagtttaaacctcactacatagcagcagggtccctctaccttgctgctaagtttaataattttagacttccttctgatggaaaagtatggtggcatgagtttgatgttgctccaaagcagttacaaggtacaatccttataatatggattcatgaagttttagccttttttccagggttaaatcggaccattgccatttgttttcaattagtgccatcgattttccatcgtgctgatgatttattccacctgcagctgttatccaacaaatgacagagctatttatgggaagaaacccatgctccatgggtcctgccatcaggccaccgccaactccaagtctgatggagagacagcaggtgatcaggccaccaccaactccaactctgatggagagacagccgataatcaggccactgccaactccaactctgatggagaatcagcacataacacactctttgggcgctgttatgaggcatacgcactcttcaataagaagtctaagcaataactttgatagagaggcttctaggtctttgcctttgaacattccagctaatcgcaaatcaactgtttgcccagcaaggaatgaaggcaatcagtcactgcgaatgcatatgggtcatagcaatggcagtgatgcaaggtttgagaaacaatattcccggggagctctgaaagcagatcatgtttaccatgttgtcagcggacagaaggatcttcatgtgacaggaatcagggacttggttaggcagaagagaacattccatgaagttggagagcatccagctcctattgataaatctgacactaagtcctggatcaggaagcgacatggaagaaatgtgatagtttttgacactaagtcatcatcttggaagaaacagaagctgtgattttagagaagttagtcatatctatttgtaaagacccattgtctcgatctatagtttcccaccaaaacaaaggtttcttagaatgatgagatgaagtatcatcatgaaagatgatatggatcgagtaacttaatctgctggcgtacagcaattgctcataatttgccttgggaagacaacaaagtgattcagattcatatttcaatgataatgtatgccatttttccctgtatatatatatgaatagagatcaaaagcgctaactgtgagtagaatcagccatgtggcgcaaagttttgtaatctgatttcatgtgtgatagcatttgtttttcttctaatgtagcctaggaaacattttcctttcttgtagtgggcctaggaaacaatcttgtataatcatatatacctttgttagcgtttatataatgaaattttgttttcattggtttctgattgtcggctcaagtttgaaagctgacctgcgtatattctgcaattctgcagttttgacgttgttaagagtaaatcgcggcggcggcaggaggtggagtcgcgcgctcgtagaggagaggaggtgaggattgattcgatgggttgtttttgacgtgattatgggtgacagtgtaaaatatgcggccgtatgcgtgtctcatgcatcaacccttgatgtcatggatgggtttagggctgacttgagattcagcccctttgaacatgctcatagaaatgctataagtacttttattttactagcaaatatgcttagcgttgcactgggtgaatatcacaaatatagatggttaagattgcttgtgtacttataacacgtgcacaaaaatattaaatttgtacataccttgcaaatatctccaaattttatacatatgaactgttgtgtaaatcatacgaattccatattatcgtgttgatctgtagcattattgatgagcccatctatggtaataattttgaaggttgtagctcaacgaatttgcattggctatgtatcttagtgttgatatgtcactactataaaaacacatacacagatcggtactataggtgccgatctgtatatatacatatactataagtgttggttttctaaaaatagtatcagagctgaccctcgcggttgctcatacggattagtatgcgggcacttggcatagcatatagcacgtcattggacgtacggacgtgtgctaagagggtggggcatatggcgcatggcgcatgtgggctctgtgtaaggcatatggcatgacactgggtgggcatatgaatgggccagttgcggcggtagcggcggcggtggccttcttcgtcatgtccagaactctcttccacatcggcggcggcgtgcgctggggcggcggtcggagcagccgccggcggtagcggggagcagtggtgtggtccgcgctgccgcggcgaaacgaaggagggggtgattgcggttcggtgtcgtgggctgggccgcacccgagaaacggcccgaaaaatagcgcgaggcgaagcactagcactagggacttgtttgtaaaaacaaaaaagtcaaaaataacttatataattactctataaaacacagaggactaggaagtactactaatcatagtatcactagctagcaacgacgtgtttgtactcaacagaattgtagatagggctcgccgtccggcgggaggtccggcgtgcaagattccaccctgacgaggctctcccggtaggcacgaaaccaacaattggtgtgccagaaatgtccacagtgtctcggaacaatagtgcgacccaccaccctcctgtccttgctggtgtcgtcgtacagcaacttccaagcccaggtcaccaccaccatctgcacgccgccgtcgccggactcgaacgtggccacggcgttcttcctgctgcccttgctccagtaggcgagtggcgcgggcggcggaggcatccccacccgcagccgccgcacccacctctcctcctcctccaaggcccagacgtcgaggtgcagctcggtcatcgtccacacggccggcgtgccgcgcatgtcgatcatggcgaccagttcgtccttggcgaggctcaccggaggcggcggcagcaggcggaacgcctccgacaccgtgtcgaacgacgatatctgtggcttgccgttgtgcaggtaacgggggcggcaccagtatacggtgtcgccgatggtctcgccgacgaccatggtgcagcggtggtagtcagggccgccgccgagccgccgtggctcggcggcgccggtggagaggatgtaggtggcatctacatctaggagtgggcggtggcacagcacgcggtactcgccggacggccggtggaagtagaagcccagtgcccgcagctcgttatcatttggccgcgacgacggctcagggctcaccggcggcagattgacgagctgccgcgtcgccgggttgcagatgagcatgctccccttctgcactcttctgaacagcaagaagccgtcgcaggtagcctccaggcccaagcagaatctgtcgcggtggagcaaacgccggcagccggcgatgtcgccgccgtcgtcgatgcgtggaacggccgtggctgggagggaggtcaaggtgttgaagggggtaaagtaataactggggtccgtgttgccgaggagctgaagcgggcggcggcgggagtaggcggtggtgatgcggcgccaggtccggcagacggcgcgggagcggaggacggccttcgccggtaaccgcaggaggatctcgctcaccacgtcgtcgttcatcgcggcgcgagctaggcgatcgatggccttaggtttgccaacttggcgtgcccggttgctacacacacacacacacacacacatatacatacatatatatatatatatatatatatatatatatatatacacacacacgtcatgtacgttaaaatacagattcatatcacctagtgctttatttcttagagtttgtctcaaaaatatgcacaaagaatgtagatcgagttataataggattagatgacaccgtacctcacatgttgctgtgagatactcatgtatacattgtagctgctagatttcaatattggactagaaaagatgtccgtgcgttgcgatgggaaaaactaatgttacgatgattatagttattttatagtttcatagaaattatatatattggatactcctggacataaataataaattaaatctatgtctaattctatatcatgacaaagaaataattacatttcgttgactccatctagctagaaataatttattataaagaatgaaaaactatatcaaatttcagcaatttttaatgcctcaaaaagtgcttaaactaagtttgttaattgaaaaatagtttaaatcagatgaaagaaataaaacacaattaggcccacaattagaaggacgttgtgtccaccttttaagtgcactgggcccatgtgacaggccacggacaaagtcggcataagtgcgctgagagtcattgaattcgatcgaatggctaggatcaccgtgatttagataaaacattgtttgttgaaaccctaaccctagattcattcctcttctctcccactgtgagcggtggcgccctcccttagcacgggtggtggcggcggcgtccttcccttccgcgaacgacggtggcggcgccctccctccgcatgggcagtaatggcggctccctcccccaccgtgagcgaaggcgtccttctgcggcttcaacgggcggatccggtggcaactgcgatgtcgacggcttgtcgcgggtggatccaacgacggcggtgtcggcaccgatccggcggtcacaactcaaagtctgttatgctctaccttagtggctgttttgccaatcttgctgagcatgctttgcagtacaagtgaacatctccagaagatagcttctttatatctgttcatccaagaaaatgaatcacaaattcataatcataatatgaacaggggagattacattaagataatgcagtactaacatattagcattttacttgcaaatcgacttaggttttcagtggtactagaatcctagaggcatgcgacgatttggagtgactagcggtgataaaattattggccaggaatcaaccagaaagctcataaaccctactacctaataatttcataggacagtaaaacacatgagtagctcaccatcgcagagggagagaggcgcgggcggctcctcgccggggcggcggcgacgacggggaggacgagcgcgatatacaagttgaaaaaaaaaacaaattaaactagaaatagttatggtacattcgcggctatatttgttattttgttataacttgtataagttgaatttaaacttgcatgtttatggagtgatatattttatattagtttatgttgcaaattttgtgataactatttagatgacatgcacgaaacgagatgatatccctcgagatcacattcttcaagtcaggccgagctttaataaatgaactccagcccacaaaaatgaaacgagcccaggcaataaaataaaagaagcccaacccactgtacataattaaagaagcccaggctacgtaatcaattgcgacacgtatacgtatacgtacgtggatgtgtgcagcatattgcgaccgcaacctaaatgttgttggacaatagtacaagttttgtatgtgtaggtctcaattaataaaattgaaacaatctttgtgaataagtagtatgcaattctatcttttgagacattgaatctgtaatcattcaagctgtaccctaaaacttccttgaacctgtttctagaactcgtagttgaaaattgttttgcctcttacaaatttgggttaattagataacatgacattataaatatgccgatttcgaaatatgccattagtattcgtgtatttggatccatactattataattttgcacatattcgagatatgccattgagatgcatttacaataattttttgaccaaattgcccttctttccttattcttcctctttcttccctctcctctattccaggagaccggcgatggcagtggcaatagatggccataaggcccgaggcccgaaggcccggctaatggcatggctttttggcccggcccaagcacggcccggccgtacctgggcctcccctccgacacgctgggctggcccggtcgggttggcccggcacggtcgggtcggcctagcacgatgggccggcagaccaggcccggcacacaaagtatagggactaaaaatagacatataaatgtcattgtccaaagaatagggatcttaaatagacttatttagctatttatatatcacagcccaaagaagagggaggtaaaatatacttttttagctaatatgtcacagcccaataggagggaggaaaattagacttattctg

SEQ ID NO: 68158 - DNA, 11074 bp, Oryza sativa
ttggcccgtgcctggcccgtgagtgcggcacgtgggctggcatggtacggcccggtgcgtcggtcgggccgtgccggcccgacaagcctcggcccaggcacggccgggcctgggccgtgccgtgccaggcggcccacatggccatctatagcagtggcaagtgcggccggtgatggacatcgcagtcgctgtctcctccctctccggcgctctttcacccacgacgtccttgtctccctccacctcacgccgtcggcggcctcctgcgaggtagcgacacgagctcgcgaggagataaggcggcggcgagaccagcgaaggcggctcgcggtggcggctggcacgagctttgcgcggagcagataagacggcgacgaggtcagcgaaggcggttcacggcggtggaaggcacgagcttcacccggcgagcaaatccggcggcggcaaggtggggacgatgacatcgggcgagccggcggcctccagattccggcggcggtggaggtagcagcaagcgacagagagggcaagccgacggcctccagattccggctgcggcggcggtggttgcaaccacgtggagcgggtcctcccggagcgacgacgggggccggagtagggaagcccgaagcctgcgaggcaatgaggtggcaacgatgatgaacgacgagaggttgaagacgggggcatttttgtccaatatgggtaaaatatgtatactagcggcatgtttcaaactatataaaagttgtaaaggcattgttataaatacataaattgtaatggtatatttcaaatccacacaaattgtaatggcatatttcaaatccgttaaatttataatggcatgtatctaattaaccctacaaatttataccacgtattgattcttgtcccttttccagaatcagttgtagtggatagcaatttaacttgacaaaaattctttagagcgtttgaataattaccaccagaagaaaattgttgagaagtagtaataggcaataacaactgattttgaagttcatgtcctaacctgctcaaaccatatactccgtaccaaaacatattctcattgcatctactagtattccagtcatcacgtgatacaggcaaccaaacgattccattttgcaccggctcatctaagcccaaggaaacgctttggatggatgacacgtggactccctggggatccgacggtatacgatgtccttccgagcggctcggctcacacagctataaaataagaccgagaaagcgactcgcacacgcaatccatcacgcccgccaccgccatggctgtcttcctcctcaagtccaaggcaatacccacctccgtcatagccttcgccggcgatgtcccgctcctcgccggcggcgtagttcaggacaacggcatctcgccgcgtacgccgatgagtatattccgtacaagcccaggcgagaagatgctggagatggtggcctcgttcccgtcgccggagggattctgcagcatcgactgagcgaagccatctgcgtccaacgacttctcgtgccaggctggtctcattgcgggcggcctcgagaacggcatggtcgccatgtggaacccggacctgaagctccggtgagtcccgcgccgccccaagcctctgttctccttctcgccgcgccgccgcgggcacgccgcgtcgcatctcagtttcgttctcgccgcgcacggcgcctcctcgtttcgtcttcgttctcgccgcgcgcgccttcgtctcgtttctgctctcgccgcgccgccgcgggcacgccgcgtcgcatctcagcttcgttctcgccgctcacgcgcctcctcgtttcgtcttcgttctcgcgcggcgcgcgcgcatgcctttggcgcgttctcgccgcgcatgcgccaaggtttcgttctctcccgctctcgccgcgcgcacgctgttctgttctcgcggccgcggcgggcacgcgtccagctcgttctcgccgccgccgccgcgcgctcgcttttcggctcgttctcgctgcgaacacacctcctcgtttcgttctcgttctcgtcgcgcgcgcgcgcgcgcgcttgccttaatttgctcgttctcgccgcgcacgcgcctaagtttccttctcgttctcgccggcgcccgcttcggcttgtttatcgccgtgcgccgcgtcgttttgcttctgttctacctcccgtttgcactaattttggttcgattttcgcaggaaactaccttcttatctacctgacgaggagatcctcaagccccacccagatggcgttcaaacttggattcgcaaggacttcgaggtcatcgaggactacctcgaccaagttcaagttgatggaaactccagggctctacatctccaagtgtcccccacttatcaggaaatgtctggaaatttgatggtggaataccaagacgacattatgtgtcgcaccagcagctctggcgttgttgctttgtttgccaaacatactggaaaggtacgagttccactcctattcgaattggtttgtgttacattcttcctgtgcctttcatgtctgaagcgcagatcgatcgatttggggatttaatttccccagctagctcgtggtttcgggttgatcgaaatgagcgtagtgatgtttgtctgatcggctggctagtggttaattttgctgtggggggtttgggaggggatcgatcgatctggtgtgctttgggttctagtacagaaagtggagatatggaactggttctcggatggtgcattcatcgtttctcggcggcatgcacgtttcaggcgtaggcttttttactctgctactgctctgcgtttttcctgtttgattcaactttcaaccatgcttgaactgaactgaactgaactaagaggttggggatttggctgaacttgtcacacaagaaatcccttgcaaaagaggggcaagaagatgttggctgttatcgtcagtttcctgcattattttgtgtttgatccagtagttcaagacaagttggtttgtagtagtgtctgtccgagtgatgtcatgttttttttcctaccttttgctgctctagctcatttcagtaatgagatgggagagctcttgctctctttctcaaaaaaataaaaaaaaatgcttgaactgaacaaacagcaaattgtgtgatcacagatttcagatgtgcctgccttttttttcctttttgattgaaatttcaaccatgcctgaactgaacaaactgcaaatagtgtgatcaaagatttcagatgtgctctgctttttcctttttgattgaaaatttaaccatgcctgaaccgaacaaactgcaaactgtgtgatcaaatatttgagcagtgttgttttgttttgtacaggttagaggcctgtcgttcaaccccaatgcaccgaatctgctggcttcgggtgctgctgatgggcggattatgctgtatgaccttgcccatcctttggctgagacaatccctgttcaggtaaatgtcattgaccctccgatatacagttgtgtgttgtttctttttttctaattaagatgtagaatatacctcaattttcattagcacgcttttcaaactgctatatgatatttcctctatcccataaaaaaaaccaacatccagccacgtccagattcatagccacaagttagttagggagtacgtttcgtgcgaaaacgttctacataaaagttccttaatatcaaatacatctatttttaagttcgagtaaattgcatcaacgataaaaaaaaacttggtaggtgggtacaacatactacatgtaaacatccgagtataacaatttgacaagtgagtgtgttttagtacaaaaaattgatagtttagtactttggtgcaacaatttagctaagtatgtgttgttttggttaacgagtgctaagtgacctttttttttcacgatatcaatatgccatcagatatcaatacttggtttgcttgctctaacttcatcttcactagaaaaaaaacacacctatttacaatatatagcctatttaggaggagtagatggtaacatgtttattgtttgctcttttttttttgtcagttatgtgattctcctgatgaagaaatatcttgcctctgctggaactcctataaagttcatgtcatagcatctacaaccacttgtggaagaatatgtaagttcttcttacatgactaaattttctttttgtatttttttagaaatttaatcattattttattttttatattaaaatgcaggtttccatgataccagagcaaaaaccatcattggatggtaactacctttttttttaatatttcacctttctctaattgtgttgctcactaatgaatgtattgagatttttacagtaccactcttgattgcaaaactaagagcggatcaactgtgatcttttgtcctgatcctgattcagaaaagttgctggttgcacgggaagattcaccgtctgtaaaggtaattttctgtttttttccgttgcatatgaatatgcttggaaagacaggaacatcaacttgttaactaaacttgagcaagtataattaatttaactggataatttaatctgtttcagattttgaacatgggaaacacggatcataatcctgctggtgaaatccccttcagtaactcagaaggtagtccgtgttactcggttttatttatgctgtaccatcatgttacaatctttgctggtagtctcttaatttgactcgctagtgtatgtagtagtggattgtaacatcatgttactatatgtgctaggtatcgttgctatgtcttggtgcccacacaatcccaacttactgcttgcgtgtaccaagaacaacaagattttggtctggaacaagaaaactaacaaggttctcccgaatccattatctttaggagtacctacttagtgttgcaaacacaactgttggattgcacgattaatagtcagtccgtttacaggtaattagcgaggcaaccgctgcaagatgtctttatgctcaatggagtagaacaacgccaggccaattagcagtcatccaagaaggcaagctgaggctttgtaaggtgacccccttacttatatttgtcactaaacatggcacactttatatggaagaatgcatgttatatgttataaaaataatatatgtatatatttagataatataaaaatgatgtgtagatggtgatttgacattgcttgcatgttaacttctaaaaatacaacaaaattacaaatgatatgtcatatttgcatgagatgtaaaatattcgagataataattgctagtggatgatgatgtggcacacttacatgttgaactttacgagttagtgggtacaaatatatagaaaaaatatatagatttgtcatcacaatggtagtcattaacacttctccttttcttcgatgcagttggatggagctgatgtagctgagtgaaggctaataggagtgttactgctagttctagatggcgactagattggatatatagttggatggagctggtgtattttcttcgatgcagttggatgaagctgatgtagctgagtgaaggctgagaggactgttgctagttctagatggcgactagattggatagttggatggagctggtgcagctgactagctgagtgaaggtgtttctccagttttaaatgacgactagattggatagagaagttagtgtagctgagtgaaggccacgtgtagctttagataaccacacttgaatcaactatagatggccatctgggccgcctggcacggcacggcccaagcccggccgtgcctgggccgaggcttgtcgggccggcacggctcgaccgacgcaccgggccgtgccgtgccagcccacgggcggcatacacggcccaggcacggcccaataccactcgggccgtgccgggccggccagaaggtatgatgggctattgtgctgcctcacagaaaaagtctatatttggtccctcaactctgtggctgtgtttaaatggctggaaataagtctatttttggttcctcaactttgtgggctgtgtttaaatggctggatagtaagtctattttgtatacctattgtcttgggccatgccttatacgattatataagtctatttttcgtccctgtatttttttatttgatcgggccgtgccgggccggcccaccgtgccgagggtgcagcccaggcacggcccggctgtcgggccgggccggcacgggcacgaccctagtcgggccgggctgtgcttgggccgggccaaaattgcgggcttcgtgccgggccgtgggcctcgggccatatggccatctatagaatcaactattctttgatccgctaaaaatagaaggaataggttcactttgtaaccctcaaaagtgatcgaaatttaatccgtgaccctaaaccacaaaaccggatatctcgatcccaaactcttaaaaccggtgcaatttaactcccttgacggttttggaggacggtttcgctgacatggcgtctacgtggcatcatagtcatcaaataaattaaaaaaataaagtggggcccacctgttagtgattcccctcctatattctctctttcttcgttggcagcggcggcggccggtggcatcggggtgcagcggaacaagtcgcggcggccggggttgcggcctctctctccgacgacctagagcccgccaccgcccgcacccgcacccgcatccgatccatcctcgcgatgaggcgctgatgagtagctgttgaagaggagctcggccggtgccctgcaaccaatccaatccacgagtatcagcaacaacatgggagatccatcaccaagaggaacaaatacaagagcaagaagctatagacagcgtacgtgcgtgaatgggtcgacgggcatggcgatcgtgtctattgcttttcgcattgcccacccgcatcgcacttgcgcagcagcagttggagctgagcaagatgagcaggagtagagaggcgacagagaagcggaggcgagtgtccatggatgatcgcagcgactactccaacgttgcgctcgtggatccggcctctccggctcagcaacgacggggacacgcaaacgaggttgagcttgaggagaatcgtcggtcatcatccgactccctattcccgcctctgcgttggtccctccatcctcattgcgcgccgccgctacgaatcagtggagcagaggaggatgagagcgggggcgagatggcgtcggcaccggtctcgtcgaccccgtctccgccgcttccttcgccgcccagcgcaggtgcagctccagccctcgcctgccctcccacctgtcgcctcagctccggcctcgtcgcttgccatcgctcgctctcgccgcctgctcgctctcgtcgaccccgtctaccttgttgtcaactacgagtcagcacttcagaccgccaagtcgaccacagttaaataggctacctcaaatattgtactggtgtgattatggtgaataagagtaacgaccggctttggccaacagaaataggattattacttgacaattcaggggctcggacctgtataaaaatcctcgtccccatctcttttattacaatctcacatatatcctagtactaatgatccctattctatgcaaataccggaatcacgacatcaaacgtcgacaagcggtcaatcttattatttttgtttcaaattatataaatcaaattttaactcgcatgtttgaaaaagaaatatcatatattgatctatcttgataatgttttttataactttttgaatgacatgtataaaataaggggatgtcccatcgactcgagggacaaaattccacttcccaaactctaacatatatagtaaatacaggacagtttgaaatcccatcgaaattaaagaagcccctaattcgaagcggattattcgctcacaccatgtcaaactcgacatacaaatttgatcggcactaggtgacatatgaatcagtattttaacgtacaccatgtatatatgtagcaaccggggcaaacctaagccgaacgatcgcctagctcgcgccgcgatgaacgacgacgtggtgagcgagatcctcctgcggttgccggcgaagccgtcctccgctcccgcgccgtctgccggacctggcgccgcatcaccaccgcccactacttcatcaccgcctactcccgccgccgcccgcttcagctcctcggccacacggaccccagcgatcactttacctccgtctacaccttgacctccctcccagccacggctgttccacgcatcgacgacggcggcgacatcgccggctgccggcgtttgcttcaacgcggcagattctgcttgagcctggtgactacctgcgacggcctcctgatgttcagaagagtgcagaaggggggcatgctcatctgcaacccggcgacgcggcagctcgtcaatccggtgagccctgagccgtcgtcgcggccaaaggataacgagctgcggacactgggcttctacttccaccggccgtccggcgagtaccgcgtgctgtgccaccgcccactcctagataataccacctacatcctctccaccggcgccgccgagccacggcagctcggcggcggccctgactaccaccgctgcaccatgttcgtcggcgagaccatcggcgacaccgtgtactggtgccgcccccgttacctgcagaacggcaagccacagatatcgtcgttcgacacggtgtcggaggcgttccgcctgctgccgccgcctccggtgagcctcgccgaggacgaactggtcgacatgatcgacatgcacggcacgccggccgtgtggacgatgaccgagctgcacctcgacgtctgggccttggacgaggatgagaggtgggtgcggcggctgcgggtggagatgcctccgccgcccgcgccactcgcctactggagcaagggcagctggaagaacgccgtcgcgacgttcgagtccggcggcggcggcgtgcagatggtggtggtgacctgggcttggaagttgctgtacgacgacaccaacaaggacaggagggtggtgggtcgcaccgtcgcactattgttccgagacactgtggacatttcgggcacaccaattgttggtttcatgcctaccgggagagcctcgtcagggtggaatcttgcacgccggacctcccgccggacggcgagccctatctacagttctgttgagtacaaacacgtcgttactagctactgatactatgatcagtacttcctagtctaactattcctctgttttatatagagaggtattaagttatttttgactttttttcctagttattaaaactttttaaatttgactaagtttatagaaaaataccacaatatctcaaacataaaattaacaaacatattatcaaaatatattcaatattatatttatcatcaattcattatactacttaaaaaaattgtagtgatggtggtgggtcctaaacgatcgaaggtttgaagtccatccatggatccttccacacaattaatggtttagagtcctttggatagcgctccatcgcattattccgcgtgtgttcgttgttgttcctccgcccacttctcttgttctctccaaaacaacttctctcacttacttcctactcaacacccccagcgctccaagctgccgcaagtctatcgctcccttctcgttcctcgtccacgctgccacccccgccgccaagccccctaacgaaggttgtcgccgccatcgatccgattctgccccttccaacccacgtcatgcaagtagttgtactaacaaatgctagtatcaaactagggaacctacaccgccgagcgattttaaggtttttctcccgtcggcacagagccacggaagaggtcggtcgctgccacgaggtgctacatcggattcaagtcacgccgccactcactttgagtactaacaacaggtgtgacccccaatcgcccgtccttataaggatccatcgacgttcgagtcccaagttctgacggtagttatggtcgtgtcatctttgatttgtgagaaatccaccgcacctattgattcatcccaaaggaggaaaaaaaaattccaagctagtaagaatgagagctggatgattttgtaaaattaacactatgtgtgaaaggggacatagctgatgtggcattttcttctaggttggtcaatggtgtggcaaaaaattcttttgaaccacagttgcattcacctagtcaagatattggaatgttacgttcaatttttgagcttttacttttacatctaattgtacgcacctattaagttttttcccttatcacttttaagtttgcaatttaccttgccactagttatgcttaattataattataagagaaataataaatttaacaatttttctatatatttgtcaataaattttatcctaaaaatttaacagatgtaattacagtataatcgtagtgtaattacattgtaacttacatgtaattacactgtaactataatgtaacttgtatgtaatttttaaaaatctctccgtaacatgttatttcggtaaaatggaggtcgtgggaacaaatcatttcacatgtgtgtgctgtgatttttttcctcaccagaacaaatattgtaatagatctaacgattcaaaattatgtgaaacttacatacaagttacattgtagttacatgcaagttaccgtataattacactacgattgtactataattacatctgtcaaatttttaggagaaaaattgtcgataaatgtataggtggtccctaaatttaatgcatcgacaattttattgttactgttcacgtaatttcttttgcgccccttcgtttttttgtttttacaaacaagttcctggtgcttcgcctcgcgctattttcgggccgtttctcgggtgcggcccagcccacgacaccgaaccgcaatcccctccttcgtttcgccgcggcggctcggaccacaccactgctccccgccgccgccggctgctgttacgaccgacgaccccgctcgcgccg

SEQ ID NO: 68159 - DNA, 10215 bp, Oryza sativa
  unsure (1)..(10215): unsure at all n locations
taatggtgtaatcgtgatatacttgttcaatgtttaggacctgatgatgcagaagaattgaggggggcgcaagcgccaccggaggagtctgaagatgccgaagagtctgtcgtgaacaggatactggacacggagtggtttgcggcgccaccacctagcaacccactggcggcctggcggaaggaggtggcaagggagaagaagaaacggtacatattcaagaacacagagagccgccgcttcaccaggttgatgcagaagtgtgccgataagcttggagcagagcccgcgcttgaattctttgggaagctggggagggatactggggctaaggagtttaatgctttgatcaggatttgtttgggcaaggcaaaggaatgcatggatattgactcagcagtggagcatatttatagggcatatcgcctctttgagctgatgagagaaaggggttatcagattgtggaagattgttatggaccattccttctgtatctggtggatgtagggatgtcagaggagtttgatatgttcagtgtgttctttaaggatgcaaatccacggtccagctcgagaatagcttattacgagatgttgttatggattagagctcaagatgaagaaaagattcaagaactttgccgctctgttgaagacttcaatgaagaaggtgactatgatatggcaggtaactaaccaaaatcacaaccaatcttcctttgtcactcattcacaaatgggaaaagcgctgtttaatgttgcacaatttattcgacacacagaacattcttccaactgtaccttattcaagatactgctttacagaaagttatatgctggcctttgctgaaagcgacaggaggctggatttcatcagcttgcttgagtcacttgatccaacaagaattttacgctcaaagtacttattgaccatattccagtctttgggtaggttagaattgaagaactatgctgagaagcttcttcagcagatgaggtcgaaaggtaataactctgtcgttttgccaaaaaatttaaatatccatttgctggaaataagatggacatatgatgaatattggccacaaatatttctattctaatgttattcagttaccccatcagatttccctctgttacgtttcttacctgctaatgtttctgtttcagaatctggtgttggaaaattttcatcgataatatttgagtatgcttcaaatataccaaacatagcggtgaggaatcttttacgatgactactggtaatattcgtagccgctaattatagtatgaacttggagtggactttacgtgtagcgttcttcaatcctgtgcaaaaatggtcttatagcaagatgttaaaaaaaaaaggaatatgtaatacagtactttagagagcacacccaattttgctattatatttttattctgtgcgaaagaagtattctgcatttccataatgcacattgtgtggctaaaaaacatggtgctttgggctaaactagcatagaaaatttataaatttatttctgtgtgattcaaaagaatagacaatccatttttttttattcgtacatcgaaagataaatcatgtttcatcaaattgctaatatgaccacattttatttgatcccaagtggatggaaaggtttatttgctgatatactactccctccatccaaaagtctaagacctattccattctttggcttttccaaaagtctaagtcatatttgtagtcactatgtgctatattaaatttttgagcggagcccaagaagccattttagtacttattggttgcatgttcattgattttgtcacatgatgaatgaattaattactcattggtcttggtgcaaaaagaaataggtcttagacttttggatggagggggtatcttagttttcgtgacttgcttacaaaaactgtggtgttcaatctaagaatgacattatttaaaaaatataactatctgaaccagtgcagttagttatcatgttaacagcgcccttttagctaaacagaatgataagaacactggaaatggattttcttgaaggttgaagatgttatagtatcattcaatagatggcatgagcagtttgaggtagcaccctctatttctgcatctgagaagatcatctctgtttgttgcaaatcgtcaaaggtaagtcaaatccaccggtactttttttttaaaaaaaatggttaagtaattcaatacatgtttttagaaatttggtccccaaacaatatatgatcttttttatgtatgccatgtccatacataccttttgctttgtgttgtttggtttctgctggcctgggtacttaaccggctttacgtttaaagagtccatgtcatgcctaacagcctaacatacctatctggtctattatttcaagtagctatcagtccaccggtagttttttttatttaaaattcttctaccaccacctaggtgttgggaagaaatgcttatttaaatttggatgcagtggaaatgtgtggtcacttggaatggtttattaatggatattggctgatgtgtgctgaacttgtggccaccatttgggtagccaccactgaagtgtagcaaagagcttggagtttagtttgaagcctaacctagtaaccttgctatgaaaccttaggcgtggtacagtttgttaggcaaatatcttgctcatttctgtgattgaactttgccatatgcatgccatagactcagattgtcacttaactttttctacagccatggctgtgaattttgttgcccaaaattagttatagcaaagttttttacaaaccaaataggcctcaatattgtatgtgatacacatattttggtacaacaatcttagtttcaatgtgaagtgtttggatttatcaatctgggccactcaaatcaatattataaccgcgctgtgttccctaatgttttatgcagatcagcttagctcttgatgtagctgagtgcttatgtaaatccaaccccgatatgccagttgaattgtttcatccaataatacaggcctgtgaacaaggctctgaatttcacttggtaagcagttctatatgactatatttagttgtggcttgcagtgcagatgtgtgttcattttatattaattattagggggtattataggttataagaatttgcaacatttaagtgctttgtatggttttgtgcatgactgcatatgtttttagtaacaacataagcatcttgtagaacatgaccttttctagtatgaacacatcccaacctattaaagcactagtacaatcgttaacattgttgtaatgtaataactaactagtgatcttaataagctgttatttacatttgtttgagttgttaaagcataaaattgattgtgaggaagtctctgccacgcatcataagtcataagatatatgaactactgttgctggtctcacaggtagcatctattttaaaaattaactatacatgttctcatgtgatatgtcttattgggaacaatgctaagcatctgtattcactctaaccttttcaggttcatccaatatatgatttgatgcgtcgccacaagatgaaattgaaaaccgaaacattcagaaacatgataaatttatgtgtaaagatgaaagatgtaagtcattatgcaggtcacctgctatgtttaggcatcatatgaaatttactgatcctttttctccccagtttgaaggtgcttaccgtatactcacagatgcagaagagtctggggatatatccactgtaagcctgtataatgctatcatgcttggatatttcagagaggtaaactctcgggttatctgttgttcttttgatttgttttcctcagttaccatacaatccatatgtccattttaattattcaaaaaatgatggatctcctattaactattgtcagcatacttgctcaactttagctgactcgattttacatcatgcctggtcagtagaaatgcataaacacataagagatgacacatgcttgtttttttttgttgagattttccaaacctcttccctcaagtacaaatgcgcaacagtttcgaataagcaaccactgtaacnnnnnnnnnnnnnnnnnnnnnnnnatttcaaaattttttttgaggggaaacactgctggacttacccagtagttatgatttttttattattagcaaaagaccatatttacatactgtagtaagatttaaagactattattccagattgtttgtgccttagtgcctttctccctttaaattcgctatgtttctatatagaaaaaccacaatggagcacagatggtcatggcgcaaatgcagattgccggagtaaaaccagattctgaaacatactgttatttgatatttaactgtgagttcgaagagaaaatctctgaggtttgtcacatacctgattgtttattattaccatttttgtgtgtgtttcaaatagagaggcaactgtatatgttcttgaaagaacacctagtgaaattatatccccaagtaattaattctatttgcattgttaaattctgttggatatatcatcatgcagcatgtcgcatcttccattacatactaacatgcctactctgttcggaaatgctccctccttttctgtttaattgtctcattgttgactatggtacacatatcaatgcaatcaacttttatctcctaaaataaccaaagctcctaggtgagtggaatatgttttcgttatgtataatcgaaactttgaaagaacactctagatatttctgattacttgtatcaatgtcatattgttaaatttatgattggtcctcaaaggacaaaatagggaatgccactgtgacaaatgtatagtgccaagtattctcagacacaaaattatggtcaactgtgacaagtaaaggaaaatggaggaattatctgacattttaaaagacgcgtagtcaaacttctttatctttgaccatcattgtgtaaaaaaatatttagattggtcatgtggaatttcagaaatggtgcaattagagttgtcatataaatcttaatttttttttactaatacacttatttaaagtaatttttgaagttgcatattggagggtttgccaatgtctaaaacgccatatactattgaacaattggcatgattctttaccatagtttacactgacattagaatttcatgttttaaacccctttcaatttatagtttctgttgggataagcactggctgttgaattgtttacagtatcttgatcaattacggcaagatggaatacacatgtccaagcatatatatatgtcactagttagtgcatatgcaagacttgggaattttgacatggctaaacaggtaatgtgcttgccgatcataattctctttgaattttgctgcaccttcaggtgccagatctcacacatgtactcgtgttttctgaattagattacataagttaatggctattattattactacgaagatgctaatgttgtacttgttctattttgctactgaaaacctttgctgctttcttaggttctcgaaaacaaggaaataccacctaagtacctcaatgaaattaagagtgcgcttataggagctcttgcatcaaatgggaaggtattagatggacttatcatgtatgatgaaatcaagcaatctggatgccaccttgagccaaaatcagcaatagccctgattgtaagtaaaactgttacgtatgtttacttctaatgaagaaatgggttgtgcctacacgtttgagaaccacttgttctagtctccatccttaatagtatttttttttctgcaggagaatacccaaacaaaaggtgagctggatagactgtatcaacttctggaagagcttggtgactcaaacatgtggtttgacgggtgcagtagagtacttctgtactgtgttcagcacaatcaccctaagtatgctaatcgatatttaagcacttgtatttatacttctgtttactttttatttttcattcactctttattttcatcatcttttccagtgctgccattggtttgcttaagcagcttaaggagaaagatgaattgagtacatatatggttattgatcaggtattgattgttattcttggataggatagcacatgaacatttgatttcctttttttttttttttggggggggggggggcactgattttgactaaaatctataccttttggctggcaaattccttttgattaagggtacattggatatcctgtttgttctaatgttatccacgttttttttactacttggttatggtcttatctttaggaaatatgctatatgatctcgcttattattctgttaactagttcataaattcatttcagtttaattagggtgacatgatgagaaaccaaacttgattttgattacaaatatctaattgcttttattaattttttactgttcaaactccttcgaattgttcctcataaaggtgtatatgaattgttcctcaagacatttcgccatgaactataccttttccatgctttctttgttttggtacctcttgtttactttcatgaatggttttcaaggtcttcagtcaaatatgggatatggatcctgtaaatttggattttggaatgaagattctccatgctgtgaaagagcttgggcttaatgtttctcggacaagccttgactttcttcttagtgcttgtgtaaaggcaaaggattcaaatcgtgcccagctgatatggacagaatatgaatctgcaggccttccacataatgtactgacttccttgaggttagattcttcctattggcacataagctgattatccagtacattttacaatgttggcttgcttttgttgggcaattcgataccttgaccagtgtgcttgctttgcaaccttgtcaaattccttttattgtggcatttagtagatatactgcatttgtgcctgcaggatgtatcaggctcttttgttgtcccagaagaagaaggcgactaagaagttgctgcggaagataccaaaggaagatgttcatgtgcgttacataatagattcttgtcaaatggcatactgcagccagaatcttaagctaccttctgccagtaggtccagttcaataaagagagctgcttccaaggtataagaaactcattaaatttgccacttctgttataataaaatatactgaaaccaatttgttacctctaggaaaactcatcctgttagatgtcttcattaaggaataatgatcagatgagtccaacattaatagaaactgcatgatggaaattttcgtgaaatatcctgtatgtcacattttgttatactgttgggatagtttcaggcactcccgtcctatgaaagaacatgcaaacagtcatgattttattttggtaaaactttaaaaatttagtgtgagaatcatccatcatctcataaatttcaactgaaaacatgacttatatacaaggacaaagaggaaaaagataaatttcactgttatttttagatttcctcatcagaagaataatttttgtcaatgtgtagatcgagtttagtcttttgaagttctgtgggacgatggataacatcaatatctatattatgatttcccttttcttttctggaatttctcattactgttcaaatgctcttttataggctgggagcacctgtaagcctgctgcttcaggaaccgaggtgtttcgaaatgaagctgaagaggcacatactggcccttgataatagacagacttttcctgaacattgcctctagtttggtgcctggaattacctgcacccgcttcaaggagctacatgtgtttctgtttctggcttgaaacaagcaatcatacatgggagccgtcaccgaaagacggcgagaccactggccacatttgaggcctttggtgtgaccactggccaccactccctgcattgcaattgcattgcagcccccacttggcttaatggccaagacctagctagccagcctctctgctcatagtgcttcccatgtgaccacaaggctagggtttggtcacagtgaaacaatcactgccccacagcctcaccaaccaggaaaaagatctgccctgtttgattttgggagtggagtgaggggagagattgagattggtagggcagaatagttgtactcctcagcctgcaaccaagatatcacaggataatatcttaaccagataggtaacagccacacatttttgcacctgttacagctcaagtcattactaaaaccagcattgttgtagaagttatgatttgtgttctagtttttctttattggggtatgcctttgattacaggtacaatggttatggtgaagattgtcttttgatcttgtcatctaattcatggtatgcaattgcaaaacgggttgcatagctgaatatatgatggcttatgatcagttcctttcactaacagatattgggcactgccattttattaccttaaaacgtgctaatatgtttggatagctcagaaccaaagaggaagaaaacaaccctgtattttttttccttttctccatactttttctttcctataccatgtaaggttctgacaggaacctaacaatggaaatggttcatgaaaattgtacgctggccctagagaaagcaagcaagaaaggagcgcacaccccacacactaactagataagatgaatggtccatgcaaataagagacgaggctgtaatgatccaatttttgctttatggatagtacattatattgtctagttgaagatatgcaaagccatggaaagcctaagatatgcagaaaacgagcggctcatttgtgtccccaattaaaaaagaatatggaaccaacaggcttaacttacaagacggtttggcatatacccaagtcatgctcttggtctccatcacaggtgctttaattaattttattatttgtagtcaagctattattattattattatttggttgcgcacctttttcctttacagaaaaaaataaagaaacattggaactttgagaggttatcaaaatagttaagccgtcctatcagccctggcacgtactatatattccagtctcaagcgagcttttaacctcgtaaaggaagcccagcatttctgtggtgtttgctataaagaactttatgtttttatggacgtactggggcacgatatctagtcaatttgtgttttatatttttgacatgttagagttttgtacatacggccgggtgacacaatctcttcaagttggttagctggtgtaccattacttgcaaattaatttggtgtacttaattagactagtgtattgaatacagataagaacaccttttgtaccaatgtgacaacgttgtcctgccacagaaacagggtagctaaaaagttcatatgtaaacattttcttttagataatggaaatggattacatcttttggcttttgtcataagacacacaaccataagtttaatagtaataaaaagtaagataaaagtaaatcaaaatgagaaataaggtgaatatgtaaacataagtttccaaaagagggtttattcttatagtcatattaagaaaagtttaaacatatagaaaacccttttctcgaaatagagtataaacgcacaagctaatatatacgtgtgaacacttagccctataataaaatcatacaatacacatatcttacttctgtaagcatctctaagagagtgggcttgttttttacgtttatgataatggatatatatatatatatatatatatatatatatatatatatccctaccactgaaaagaataattagccaaaataagaaaaattcttgatgcaatatatgttcagctccaagccgcaaggctattagtgtaaggaatacatgttaggtgcaaaaccagaaaccaggatagaagcatatgcatgcacaaacattggatgcacagagcacacaggactaaggatcagcaggccactaactagcaagcatgcatgcatgcatatgcaacccaatatgccatgccacttagcttcactcccccaaaggtgcacaaccacacacacacacacacaacttcctttttacccctcaagccttgaatctttggtaggagaagggggaggagattctccttttgccatgtggttcataccctacaacaaccccaagcacatatgcataatgtagcttag

SEQ ID NO: 68160 - DNA, 3161 bp, Oryza sativa
caaaaggaattcagctagcacattctcatccatgatcagctgtattttaattatacccgattcagagatttcatttttctttcttttaaaaaattatcccgtcatagttatttgatgtttatgacaagattcgattaaacttttaaaattatgatcaaaacttataatatttatagttgtagtattattctgcatattgataacccgtcgatttattcaatgcctttaaaatcctgcacatggggacaagaagtccatgtaacaagctatgcaccacaaatgtataatccctgcatggtaagcaacttgcaatggttcatttgggtgtggtaggtccatgcatgcatgcagttgtcatgtcctttaggagcttgcactgcaccacaaaactcctactacagccacaactaagccaataagctagggttccttcctagctaccagcttgtggtgcaattatgccttgggtactaagaaagaagcagccatgcacacatcaacattgatgcttgggtagcttatctaacctagtggtgtcacctcattgctccagtggtcacacacacatattaacaggatagcaacagggcaaagctagctagcttgagtgatcaaatcatctccaggatctcaaggtgatggtgcttcatatgagcaagcctagacacctctgggcagcttcatgcaccggcctctctccacatatttcatcaccaaaagtatagctagagctactatatgtctagctatatgcattgtgtgccattcatttggacaccttgatgaaccattgagatctgattggaaataacaagtatcaaaatatagaggtgcatgtagccaacaatatataggataaagatttacctttccttatgtcatttctattttatccgatttggtctctctatatatagattaacagcttatttggaatactccttctgtttcatattataagtcgtttgtcttttttcctagtcaatctttgttaagtttgatcaagtttataaaaaagtttagcaccatatgaaatatcaaattagttccattaaatctaccattgaatagagtatgataatacatacatacatacatacatacatacatacatacatacatacatacatacatacatacatacatacatacatacatacatacatacatacatacatatatatatacatatatatatatatatatacatatgtatatatatatatatacacacacacacacacacacaacacacacacaacacacacacacacacacacacacacacacacacatatatatatacatatatatatatatacacatatatatatatatatgaaaatgcagatttgcactcgggttcatatgtaactacaatctacaccgttgatgtgttccaagattcgtgctgcaaaatgtacctaaccttaaccaaatgaatgcttactatagggagaaaagataattaggattaggttggttcacaatatgtataacatgtatgttgcattttttaccaaataaatttttcaataataatcatatatgacatttatatatctagtgcattgtatttctctaatccttattttgtttataacatgatatttagtcaaaatgagaaaacaatatatctactatatcaccaaattgtcattttgcaaaaataatatttccaaaatgatatatatcctaccatcaaaaactacataaacaagataatttatataaacaaggtaaactacataaacaagttttgcatacaagaaatacaaaaattatataaacaaggtattttacacttgtaaaaaatatagtataacgtaaatatcatgcatgttacattttgttagaacctaatatacttgccctaagattcgtgcaagatacatataggatgtagattgtgggtacatgtgaactcgcatgcaaaaaaatcccactcatatatatatatatatatatatatatatatatatatatatatatatatatatatatatatatatatataaaagtttgattgtatactaccgtatttttctataaacttaattaaactttaagaagtttgattaggaaaaaagtcaaacgacttaatatagtgtaacggagagattacatgaattctgatggacggctcacattttgtagtcattgaaaacttttgtctcaaacagggtctaatgttgtgctagaaaagataccaatgcgcacaatatcgatgctaacaacaacaaccaaattctccttttccgtgaggaatcaaaatatctatgtctgttctgtatgtgaaaattttctcatatggttattggccaccacaagagatatatccaacttggatttaatttcatccatctgatccagttgaaaaaaacatataaacagaaaaaagtgaacccatatgcatccagaaagagagaaaaatgtggcgctgatgcatccgggtcagccacgcttgtcagggatcgcacaccactgaaccggccggaagctagcttagctaggcctgacaaatatactggcaggttcaatgaaccgacttgtctttgtcataggccttatttgagccgtggaacattccagaacattagcattcaaggcttcaagtctagcacgccatcatttactgaagttacacatacttcctccgtttcacaatgtaagtcattttaatatttctcatattcatattgatattaatgaatctagatagatatatatgtctacattcattgacattactatgaatgtgagaaatgctagaatgacttatattgtgaaacagaggaagtactgtgcaatccctctaaaaagaattattgtgcaataatatctcttaaggtgtagaaatagattacaccctctagctaaaaaaaaactaatcctagttttaaacttgaaaatatgggtgtctaaattcttagctagaatttgattttctttttataggacggagagagtattgcataaggattggtggagaggtattagtatttgctagattaatattcaagacatctgaaattttgtatttttagtcacctaaaattgcatattgctaactctaaaattacaatgtatgtaatgtacaatttttactttgtatgaactgtgtatatatgttattgcttatatatgggtttactttagtt

SEQ ID NO: 68161 - DNA, 7606 bp, Oryza sativa
attcctgcaccccttacttgagttttatcggttgaatacttttacatataactttgtaatttttatgaattgaaaatttatttcatgtttaggttagaataattgttgtttgaccttttatctaaggaataaatgactttgtttgaatgattaattaataggggaaatgatgaaaacaattggatatatgttgttcaaccttttatctatataataagaaagacatgactacctttggatgagtaatagggggaatgatgaaaagttgaaaaccactggatatcatccaagggatgagacatatatgaaatctagacactccctataaacttttaatattcccacttaaacagggccatgcattgatagtattccacaaccccaataatttcttttcaaggaccactatacatcatgtacctcttcacacactgatcatgagctacaatgccaaacaaaaaccctatcatatatctagcttacattagatataatgatgcatcaaaccctaaactaaatcgtccctaccactcactattcctgatgatcgagctatagtggcatgcagtagccggatcttttgaacggtgcacactgtttgtatgcaccttaaccaccgcatatatacgcagctatgtacatgcatgtatgtatcaaaatagctagcttgcttagcctgacgatatgatgatttataagtctcaatctgtcaccataaagtgattctctgatcgagctctctaggatcacgagagccatgaattatgtatggccactactatactgtactatgtatactttgggccatatctgcaagaaggacagtttaactgacaattagtgtatgaatctatgatgatattctggatctttaatttatccactagctagataggtatatatctcaattctcaaatcctcttatgaagaaggtggagctgaaccaaacgtgaagtgatttagaaacaaatatgtagtggagcagggcctagagcggagctgaaaacacacctgccttttggccctgcttcacaacctcctccacttgatccacaaaaatattttagagttgaaatctagaaaaacactctctccatgcataagtgtagatccaaatacgtggtgaagacatatccgaattactccatccgttacaaaatacaagaacttttagcaatcaaaagttgtcttaaaagttaagacatagcaactaagcctacccccaacctttatataaaatgcacacaaccaataaaaggacgaaactaaacccccatcacgaaacatagaaattagtggctattaatccgtatactagatcatcacccatgttcttagtaaaaaaaatcccatgccacctggtccaaacatcgtgataccaccgcagtagtaccccaaaataccggtttgtggaggatagcccaggtgcgtaaccactgggtaactaaagtgataaactacaaaggagaatacaccaacttattataaaaaataactccgtttctgcttagccaaatggaccaacaaagagctagctgctgcacccatcaaaaacatatttcttatttccttaggaacacatgaaagccaacgcccaaacatatgagtaacatttcgaataagttataagttagaggccatatgaacataccataccaaacaagataaatgataatggaagaacaaatgttgaatggttttgtccttatgacaaaagcaatatttttttactatatttccattttctcttagctaggttatccttagttaaaataattactttccaacataagtaccaaaggaaaacctttacttttagcggtgctttaacctgccaaaaatattaactactgtcgatctattgccattggccaatttaacctatggtatgaaggaaaggacactttgtgaatttgtgaaagatcgacagctctcccgtgggaacaagagcaaagctggatctgaatacgcactacacaacacaagactaggcaacactcgcatgtgcaaggaagtcggcgcgaaagaagccatctcccccaatgcacccaatgccatgcctgcctgatctcttcatgcacgcacctccattacctctacatttttcttttctttttttttcccctctctcctccatatcttgtcgtactaccaaagtaaccagacaatctactactatagtatctgccatgaaagtagagataaataatgtaataccctgtctacatttttttaccttaattactgatcatctcacttggtatggatatatgggtcatgagataaaaacagtggcggaggcaggatttaaacatgagagaggaggtctaagagtcttagggatacataatacactactatttaagttaattacctaattagttaggtgattatgtgtgaaaaaatgttggaggagacatgccactggccgtcccctgtccctgccattggataaaagaaaaggttatattattcacttacagttttacggtcttcttaggtgtagtaagggacttgagtatgggtggacgctgtcacactgaggtggttatgctttttattgagatttattcaaaattaatttattatatttttttctctatcgtctgaggtgtgtgttttttttggttaacaggccaatgaactgaggtagagtgataccaactttattttaaagttgaataattttaaatttataagaaaaaaacagatcaatcgagcaattttgaacagagacaccgagctagcgaaacgagctcattttccacctagctcctataggaaggttgcataacttttagtgttaattcgtggtatacaaagtaaaagagcacgtaaagatatgtgctctgcaaagctaaggcacaagcaaccaaccttttttcagttccagagaaatcggccggcaatggcctgatgaattctaaggtatgggcagggtaaggctagctacactacactgcagcaaaataatgtacactttttcatcacaaaaataattttaaaaaaatgatgcacacttttggctccaacatggcagcatggagaccgaacgctgtgctgtgatgtgcatcactgaatctctgaatgtctctgaatctatctcattatgatgatgaagtgatgaaccgcacacaacacaagagctagcaaaatgcatatatattgcttagcaaaagcgatagcatcactgcatgggatgcctcaagccctcaaatcctttttttaatagattttaattctaaaagttgcagcctttcaggaggaaatgaattaattgaaacccaaaagaaaacaaggatcgtgttctttttgagagaaagaaacaagctaaggcgatcatgttcatatcaaattatcaatcaagtcgagatggatcgataaatatgtgtgtctgtccaacagcatgcatgctagcttagctgcttcaagtagcagctgctttcatgtccccatgacccacactgtgatctgtgatagcttttgtgcatctctctatctctctctctctctctctctcccttgattctatttttcttttttgagagctatctggatctctgatctatatccaataggaatcttctctgactagttaattcactgcacaataattatctgaatttcgtttttgacttcatttttcactccctgtttgatttgttcaggtctaaaatgcaaatcattattcagtgaattccagggctcttggactaatttttacttaagaaataggaaaaacagatgatcatatagaattttgagtagcataaaattttttcattgtactaaacttatgtctaaaaaaaaatctgaacctcaagatcaactattagaaagttatgtagagaatatactgtctcattcaaggagagggtcatgattgtgaaatatgttgtcctggagttgcatcttgcatgcatgttgatttgtagggccattgggtcaatacaatggagcacagagctccagccaataagaagtaagagcggcttgtgtttttctgaacttttcactgaagaaaaaaaaaaggacatttatttactctgaatttctgtgaggagcaaagaacataaaagctacatctactgcctgatccactcgatgatgttattatctggacgggaattatccatccattcttagttcagtccatgaatatgtatatatgtatatatataaatgtctgctcagttgattctagctctgaaagttactgcaagactgaacttgaaagctgcatatgcaaatggctagaaaaactgatatgaaaaaacataaatcaattttctattatgaagaaaaatcagaggtggaacgtgcaaataagtgtgtatgtgtattcaggtacggctatatcaacttggtgtaattgggttaattcaataaagcttttatcataaaaaaaatgtattcgtgttttgtaatatgtgagtacgtacatttgaatctgaatcgaaataaacatgacctgtcaaatattttcttagtcccaaaataacttaatctagaatagaatgtaacatattatagtacaatgaatcttgtccagattcgtgttgaattattttggggaagtagatatcatttcaggatgggagctaagctagctgcagtgttaagctggcatttgcaactatgcatgcaagccacctggaggcatcagagcagctcagcagcatgacagcatctccttggatcggccaggcccgcacgtgcgcccctgcacgcacgcacgagcatcaatggtgaaacactagaagctaacctctctttacttaattaattaattaattaataattaatttgtactggacctacagtggtactacttttttcatgctaagtaatttaccctgtatatatctttttttttttcagacaactttgaatcttcttcttttgtgtgtgtcttgttgttttctgaaatccgatgaagattcgatttgattccaaagcaagtagtgagtgagtgagagagtaggagtggaagtgaagcactactgttctactttgttgttggcaaggagctttgatatgtgatgaatggcgaacgctcatttcataagcagccaacacctcctagttccctattaaaaaaacacaacctagtttcaggatttaagttatcaactcataaatttagactttcaaataaatgtttcttgtttcaacctaaaacttactttgaaaaaccggtgagggaattattcactcctatatatatccattccaaattatccagatgtattgccgaaaatagctataatttttttaacgaagatagtagttactacctccgtcccaaaatataacaacttttggctatgaatctagacacacggttgtccagattcatagttaaaaatacttatatttggggatggatggtgtagttcaatagcatgcgcctattatttagcaaatcatattggtaaaaaaaatcagttcaacatattaccatataatgttggatggcgtacatattaattagcgactcacatcgtcaaaggaagctcatcaattagcaagagaccccttaagcttggatggtacgtactccatccacacatacaaataagcatagccacataggtaacctctattgaccgtaatttttcgtgcagtagtcgttattgaatgccacctcccgttcttgaaggcaagtgacgattagataatgacaccattctaaatatcacgtactatttcacactaatgctacggttctagacactcgtgagaactcgtttaaaggaaaaaataaaaactatgcaaatatatcagtaccattctgaatatttcataatccatggtgcatttatattttcgttcccttatcattgctataaactaaggtgtaagatatacaataagttgccgttaacacacaagcctcaataactctctaagactctctcatgtttttagtgaagtttgtgtatagattatccctgtacgaagaatggctcatttcctcctctttcatctctttcacattattaaaacaattggagtatatgaatatgatcatagtatccgtttgttatactagataggattatatttcatctatatctctagacttacttaagaaccaaatcttgtactcatatatatatatcggctctcaagactcaatacaatatgtcaatatttgcagtaatttcttccccatttactatttagcaaatgtctatatgacatctaaaatcaagtgtttaagattgcttactctataaacaccatatattccacgctaattttaattttctagacactcgtacgtaaagtgaccttaggtaaagagaaaaacctaaacaaatataccgttttgaatagtactctttccgtcctataaaaaaccaacctagtattaaatgcagaaaacctagacaacggtatttcgttggaacgggatactcttctatgagacagtacctgatatctgatacctattgtgataccagctgcatgatacttgatacctgtgatacctgttacccggtatctgtgatatctaggacctgatacctgtgatactcgtgcaagagaatagttaatatgtctatcccattgcaacgggatcccgttttgtagcagctctctgttgaatgtgatacgttctagtactacgaatctacatatcgtaggtttttttttatcgggatggagggagtattttacattcccattcccgggttggcgcgattcccatcctcccctgctctactgccctggaaagagagagagagatgggtgcgtcctctctataaatccacctcgtgttgctgctcccacaccccccctcctcgatcatctcctcctccctaccaacaaccaccaccatcctcttcttggcacttggcatcaagagacacatccagacgcctcgagttgtagctagcaccagtggctcagcttgcccagtgctgctgcatcgatcagtggcagtagctagctcagctctagccttttgccaccgaccgctccgatcgaatccggtgctaggctagccagcctcctcgctctttataaccccagccgccattggagagggagggagggagctagagctttgttcttgttcttgcatgctgttcttgttgatcgagtgagagagggggaaggaagaaaggagggaggcacatgcttataccgttcgtgctggagttcctgatcgatgtcgcctgtgatcagtgagatcctcctctcggggtttatgatcaactccacactccggcgccgcacccatctcgtccagtctttctccgtcgtcttcctctactggttctatgtcttctcataagctactcgccatccatttccctctcctcctctctctctagcttccttctacaataatcgatctcgtgttcgtcgtcgtcgttcttgtcgatctctgtgtgtgttcttcgtcgtcgtcgtgttcgttttggattttggtttcagtttagtatatgcacttcttgttcttcactgctgctgctgctgctaagcttgtagcaatctagtggtgcttgttgttcttcttctcccgaaatctttgcgatcgattgattgatggcatcgtcaagcgggagcggggggagcgcggtgtcggcgg

SEQ ID NO: 68162 - DNA, 27607 bp, Oryza sativa
  unsure (1)..(27607): unsure at all n locations
cgagaacgccgtcctccgcacccaggccgccgagctcgccgcgcgcctcgcctccctcaaagacatcctctcctgcatcaacaccaacggcgccgccgccgccgccgccgccgccctcaccgtcgccgccgccaccgacccgctcctcgccttcgactccgccgccttcgacgacctcttcagatcctcccccgagctgttccagctttgctagctcaaacactgaagctgaagctgccatggcagagaccaagaagaagatgaagaaaattacagtacttgccactgggggtaagcaactaagcactgcacctaacgaagctaagctagctgctagggctaattaatggcctaattatcttgtgtaattggtaaatcaagtgatggttaagttaagccttctgcatgcatcatcatcatcatgtactccaactatgtaaggattaatgaggcagtaagctttctgtttctctgtcaaaacaaatcaaggaagtgcaatatataattactactactattactctctctctctctctctctgctgtctcatggactcatggtatgtatgtttgcttttgaattaatcagtttagtaattcttatattttttaagaattactaaactgtgttgagatgcaatgttatattggtgctttactactagcctcagattgttgcaactagtactacatttttgtgatgctcatggacatgttggggtagtaaattaaatcaatcaatctgcaggaaattcttgttaatattccacaggtagtgggaataataagagtgacaacagccagtctttttatggcaggaataaatgtattaactggcttagtattcttttctttcttgcttgctcttctttttttttttctcagaatttgttcagtacagtactgatggttattgtgcagagagaaagagattctccaaattaccctctttgttttctcccccctattctctaccactactacatcttttttctgttggtttcttgggaatttgagtgtactagaagactactttctagttgtcatgtaccaaccagcactgttgcacatctctgaaaactaatggcagcagcaccaacagtagcagcagcctagcagtgacagacaactcttgtagctcagctcctctcattcattcacaggcagcagtagcagcacacagatttttttcatcagttcagctcaattcattcgggcctgtctgctttctagagacttattccaagtcctgtcacatcggatgtttggacactaatttagagtattaaacatacactaattacaaaactcattccataaccttggactgattcgcgagacgaatcttttgagtctaattacgccatgattttaacaatgtgatgctacagtaaacttttgataattatggattaattaggcttaaatacttcaaattcgtctcgcggattagctctcatttatgaaattagtttttttactagtctaggtttaatactccaaattagcgtccaaacatccgatgtgacatgggctaaaaagttttagccccatctaaacaccccctcattcattcattttttttcatctggctccagctcacatgatgtatcttggtacccaccaaaccacatgcttcctggtgattctgctgccacacatgaatctgatcttccagtgggtataactggagtaacagatcaccaaccactcccaacttgtgattgacaattgtaaaatatatatacacataatgcaccatgctaactagctcatgtaagggtgcgagcgtgagttttgaccgtgtgcatcctagttatgtagagaccagaccgtgcttagctcagtacaattgtatttcctcgatgtaattggctaagttaaataaaaacttactttgtctaaagaaaaaaaactggttcatgtacacacagtctcactatacatacttagggtacactacatcatactgaatgcagtgaaatggaatggaatggaccactgcagctgcagtgcagtggagtgcagtatctgcagatgcaattggtgcaatggacctggctagctgcaatgcttgactcattgcctgggaggttgctacattgatggagtagagccagctctcaccccagtggagattgcagaggacatgctgcaaaagggagggaatcaagggccaagaaggtggtctcacctcacctcagccaccacctttcctctccaccacccacatattgcattgcatacataagagggaaacaaatatcaccaagaaccaaccaagaatattctccttctccgtctccggccgccattgctccggtcggccatcgccggcgatccagatgagagttgagcttgatggttttgattgtttcagagcctgcagaaatgtagctttgggcctcatcgtttgccctatggcttataagctaaagccaaaatttgaattttaaaacttgattttgaatttgaatttgatcctttttcaacatagtttttttttaactttggcttttcaatcactaagaatatatatacaaaagttttactcacatatcatttttttaatcgctaataaaccgttatggcttataataagactagaccaaccgatggggaccttagctgatgttctctgaatgtgagtacaaggactaacaagtctagtgacatcctgaaatatatgagtattattggtttgaattgattgggatttcacttgtattaaatgacatatgttgccaagatttgttctctttggtcaagtgaatattacacaactacatttctgttttgatccggctacatgatatgtacatatgtatatatttatatatatatacatatatatatatatatatatatatatatatatatatatatatatatatatatatataaagtaagtaggtgttgattgcagaaggaaaactctggttcttgtagatatagtagtatagtaaaaaatgcttcctacagaaaagaactatagaccttggttctcctgttggtatcttgaaagttcttcaggtactcaattgcactagagtcactgcattacttaatagtactttagcatgacttggtgtgtcaaaaaagttctttatgttttgtgtttgtttgtgtgtgcttgtggagaagagagaaataatttagtcagatatttatccattatatattaaccctttgaagtgattctgatttgcatttagcaattattgttaacttttaaagatgtagatgtcacagaggatggaaaatagaagagcacaaaaaaaaaacagaatcttttggatcatagtgtcacttgggtccaaaggttggttcatgcattatacatgagactagtgaagttgagtagtatgccgtggtggttgagataagaactatctctcttcagaaacttgacaaggctaggatgctagggaatttaagtttttcttagctgagctgactgattttcagcttgtaaatcagccaacagtttttttaatacaaaatgattattgtacatagacatgacacagaaatatcttatctggagatgcaaaggttacaccagaataaacacttttaaatatacaatttgattaattggccgaacaagaaatggaataaaggtctcccttaacaataattctccagggaataaagagaagaatgatattattcaaagcacactaaatgtggctaaaactattacttatcgaagataagaatatcttaatagtggatgaaatttcagatcttaccaaagcatagtgggcactgcaaacatgatctatcacgctgagatatggcttactggaattaaataacaatctttttgattccttcttgcagaaaccaaggctctgcccactttttaatcacctcagcagaattgtacttgtgcacaattgaatactgattatgacctgctgcaaatggggtttatgcatgcactaacctgcttgtgtgtttcttaatcccatgtggccggtgatgccttatgcttagcactcatatggaggtgttggagacaaaggctgctgtgttcatgttcagtcacattgctccatcagtacttgaacagtgcaagccccagattagattcagtcattgttaattagaggattcaatattttggtgaagtttgcatgatgaaatgtaaatcctttattttgaaacagaaataaaaactgttaaaagtttattgttaataagggtcagcattgggttgattcaagctgattcaaagtagcattttgataggcatttgaaacagaaacaggtcaggaacatgttcttgagcccgatatgaatcgcgcaacatcatcgatcctcatgagtacttgcaccggattctgaaattcgacgcgtttcaaagacttccctgaagagcataaagcgcaaggattaaaaattcgaaaccaggaccatcttattctaccaaagaattgcatagacaattggcagaatctgaataaatttgtctgcttcccttgcatttccatgttgcaggtagccatcggccacagggaaatatgcgtggtcggcctgctttatttttatttttggagcaccttttctgcaaatggaaaaggataaaaataaaaccaaaacaatactctcacacatgcacactgcctctttgcttttgtttgctacatgtaactgaacttgcatacatactgctctgtaaagtagccatactactctcttcttatacacatcgttagctgttactcttttactttcacattagtatatgtttttgacacgctatgtgagcaaaatggaaggcaaaaaggcggtattattggcgggatgcacgacgaaagaacccgtcatgatcaccgtgtgaggcgaaggataggggtctgtggagttcaagggagaaccaaggcctcaaaagcaggctgttgcaatgccataagaagttcttgcagatttgcaatgtgcattcatggaaggtgaaggttgtagtagcaacttactctgaagagcaggcagggagagtgactgctcttcacatccatttggaggccagccaatgagattgtggccactgattgggtgcaggaattgcagaaattgtacaaagataaaaatcctggatagaggggaaatcccactgcatggttgcgtataattcagttcaatttagcacaattgtactaactttctgagagtctgaagcttccaggcacctatggatgttgactggccagttcatacagaccaactagcttagaggcaccagctatgcaccaattagggctcaatttgacattgcagttagtgcagtgttgtgtggtaaagctgcatttgccttgctctgaaaggattaaaaccatcagactgcatgatcgagtgcacttttttaaactttacttgacagactttctgctcctgaccttttagcaatcccttttgcagttttagaaatattacaagaaggaagcaaaggattccttgtctagctcatctaagttaagaatcacaaaattatctagatggtaaagttcttctctaccatgatattagtggagttctccattaatctgttctctcttttttagggtgaggagagcttaactgaatcactgcttcaaatggctggttgatccatccaagcgtatgaagtatgaacactagctctgcagatggacctctcctctgattccattggacatctctgtctttttttttcatattattaagcaaattggaattgcatgtcattgtcagagaaattgaatcccactgttaaacaatagtgcttgaaagcaattttcttgatctcaagttgagagaaaccttgagcaactcgatgctgtggctgaagaggcacattggtcaaaagggtgctactagattatatgatatgatataacatgatatcataattatctctccagaaattctttgacatgaggttttccattccaaattcaggagtgcagagctactgtcatcctgtggaggcacagagagatatcaaggtttgatgtagcatcacattccttcttggcttggtgcaaaaatcttgatccgatccataaaccaatcaggtttctgtttcttgccgcataaacaagatatatatttcaagaacatacggtatggtacagatttcatgccatatccatggatatatttgttaaatgattacattatttgcaataatgctctgcaattttatctgttgtccatattggattggaatttttactatgcattgttttcttatggtacagatttcatggcatatccatggatatatttgttaaatgattacattatttgcaataatgctctgcaattctatctgttgtccatattggactggaagtttttttactatgcattgttttctcagggggagagagagagagagagaaagagcttgtcatcgatttcttttttttagggaaaatgttgtcattgttttctcgttacaagtatctgacaggatgaattactgtagcgatcaatcttgaccttcagtttatgatcgcacgactagaaaagagacagcttcaccacactgtgaacctaggatcctactcccagttgagcaaagactgaagcaccctatgtagccatcaatcttgaccttcattttattggtttagttgcttgtcatttaataatactatcatatatatgtaattgcaaggtggttaagtcttaattatgcaacagaaaccccggatgatgagcatttattaactaatacccaaatcaagtctcagttcctccacctaattaatcaaggagatacagttccaatgggacactttggcatagagaagctgaagtctccatctgtaactgtcacccagcataatcatgatacatcaccatcagagtagcattcagcaactagttggtcatcaatgcattgccatggagaacaaattgcagtgattcttgccagattaagtacatatggttgcttgcttctgggctcttgctgctgcagtttaactttagactcccaccattagtgagtgggtcttcaacttccaacaaaagcttgaatcttgtatagttgcatacttgcattaattagcttaattactcaggatcaaagctgagaaagttgcttaaggtggtgtgcaaaacgagaaggcgatatttttaattgctgtgcacgtgttcatgttagagaaaacatcatctctgtcaatatcaaagaggaacaaagttaagcaactgtatgtcaaagttgtgttcagcagttgtagctgcaagtgtgtagttgacctaacattagaaactaataatggatgggtggattggtgccatctgtttagtcaaatttatgttgcttgtgagcttgtctgatcacccaaggaaaatgaagagctttctgggcaaaataatgtgcaatgctcaagctaaaagttagggttgctgccaagaactttcagaatccagttcatgtgtccatcagaatcatgtccacttttgcacatgagatggttccactggatccttaatgatcggctgtccacttagaggtgtttgctacattatgaatttgtgaaaatgcaggcagcaaggcaggagtactgccctacatgcttgcccttcatttcagcagcatatcccaagtcccaaggtactagcaaaccatagaaaatcagaaacgggagaaacaattaaaaaggtcatccagtacatgcccagcatgtgcattgcaaattatgaaggcagaaaagcaaagcttgcatacgtctctatttacctcattttcttataactattcatgtttattgtgaacatgaagagacaagtaatatctaataaaatgtccattcgaaatggcatcctaacatttctatcataatcctcatcatcgattcagagtctgaggggactcaccttattctcctttttgtgtgagagcaatttatcctacatggggaaaaaagggaaatagctctaaactctattggatgccttcagacaaacatgtcttccaaaacgcagataagcccgtttgtcatgccttgtgctgaagttctggatgatgtccgtgcagcatcagccttatggatttgtatctaaacagagcttttcccatatgaccattttagcatcgacatttagctgaaaaacatatagaaaagtaaaattcaccatataacttaacaaaatgtgctaagaatattgctattgacagtcatttttccaaaagcaaaattccttttgattacatgttgtgatacagttttctagtgtaacacacatgaaataaacacagcggttaggcattgcaattgatgttaatgattcagcaagaatttaaatggtaagaacatttagggctactagagatgaatctgatggaaacatacatggcatgaactgattctcaaagtaccacttctatcacccaacacattttcagtaacttcaccaactacacccaaccttgcacaattgtctgggtgatagcatattgagttgcataacagagaaacagtatgtcatcatgaattgttggttcagatgcatcaacacggtgtctcaagagcaataaatggccttctctacacaatcattgcaccgaccatgacagagcacagctgaaaatagttacgagtgataagggactcaggtgcatgtcccttttttatgtgttatattgttcttatgttctaattgttttttgaactcccaaatcgatcccactggccatatgatgacaattcaagctatcgagctcttttttatccccaagagaagggaagagtctttgtcttgaaccctggtccccagaggaggtaattcacccaaggcgtatttcctccataaatcaatgaaggcatgatcctgatatgatgttgtgaacttatgatacctagatcttgaatcatccaaaagtttgcggtcattgttaagcacttccgttagtaatcactagtggctaatcaaacatttgtctggttgataaatggcactaacattctttttcttcaatcaatagtgttcttgttatatttgtcgtgtttctgaaaaacaaagaaacaagctaaaggtgacctggagaagatacggcaaaaacatgctcacaattggcaaatcatctccactccacaacccatgtagtctaggctggtagtgacaaagccaggatataaaattgaaaagtggggaaatgggaagcagattcaagccattgtcaagagacactaacatgcatagagaacttggcaacccacattgacaaaatttacagacaagtgcagccttgacttgcccaaatttaatgtacactagtcataggtgatgcaagtgttgccacatataaatgcaaattcaatcttttgaagcaagtactacagcagaatgatggttcgtttattgacagttttgctcactgaagtaaacaaaagcagaggagaacagataagaaaactaaaatgtatagcatgaaaaagggggaaaaatgaaggatggtattactgtatcaggcaaaactgacaaaggaaagcaagtaaaacgaatttacagaagatcaagaacacgcaatcaagattaaaaaaaaatgccaagagaatgtttgctaagagagaaatgctttattagtggatgtcaatataacaaaaaacagtactctctagtctctacccatatattctgctactttcagaaagatgcctgcaagactaccaaatttatatgcataggagaatatattcttcgcttaagtagcgggcaatgggaacagaatgtttggttctgggaagataactgatgagaacaggcttgcaaattcatcctgaaactccttctatttatttattttatcctaagctatccaatcagaaattatagctgctccaatagaaactgatcagtgatcgattcctctactgtttcagctttacaaattagagcacaagaactcaatggaaacaaaatattttattttaaaatgtgctgctgaaatagctcaaggacaagctcttgatttgtgagttcaaagaaagtctttatgtgctggagtagttttgtaattccaagagattgtctctgacattgctcccaacggtaggtaagaaaaggacatttattttccaagaaatctgtttttcgtgtattgtaacatgcaatgtatatctacagcacaccagctaaccaatggtgcttatgttcttcatccaaaaggttaacgcaagttggtatggttttgctctattgagcatagctagaacattctagcaccactgcagcggatatgctgggctagtccaacaaggcaagcaaattatcaggtgttgctgggccaagttgggtgcccgcatgttactggaacagtgacaaggtatgaatattgaagatttatccgtctttggaattttcagcagaaacttgatagaataaaatcaaggcagtaacaaaataatactaaggacatggataaggttcggctaaaggaacaaaagtataaacctacctttggatgttatggctatggccatagtttacagggcttttgctttcctatcatcagttcaccaacttccttgacatcctgaaactgggcccgcaagcagcctagcagggcagggcagcaggtctttcatgaacagaggagccgacccttatgggagcttaaaaacttgttcccgaggcaatctcataatagagggcataaccttagataaggcactagggactactccaaagataatagctgatccacagaccttccatgtaattgttcctccattcagcaaacatttctgcttgacaaaaatgtttcacacactcttgttctccttccagttttttttttcttccgactacattgtttttcttctcctataattttttcccgttttctcatcatctcatcaggtcttttaatcacattttttatttgctctttcttaagccaagtaatagcattgcaaatagtacaaaagattaatcagaaattagcctgatttatgccagcacaacaacaattgatggatttggttattgcaatgcagttactttagttttggatctcaataggaaggtgaagctatgaatatatatatctacagcttctccatcaaaatgtatgcactcttcatggctcatggcatattcaaatcaagttggtacgtcccttgtggtgggaaatctttgtattgtaacttgaattagccaagtgttgttcccatgaaacaaaaaaaaactaagattttgaggtgtgtctgaatctgttcatcagaagccacatcaagcatggtttatcaactctcaaggactgaatccaactgttttcagaaaatgtggaagatctaactgagttacaatgattcatcttggatcactagtatataagtcagctataagcactcctaggttaaaaaaaaaagattaaaaaacggggctcttctgtacaagtttcttcatcttatcacagtgaaagaactatttgtggcattcaactgaccatacgcagtagcaaaacctcagtgatcataaaatattatccagaaatactttggcatcacatgcattgcacattagtacaaaacaaaactgtagaaaatgaccaaaaacatatgtctggggcaaaatatggatgtgtgagatgcttgatgccacattttatcattttaagtggctattgttaatcaagagctctgctacatttgtaggatgcaaagagagatctctgaggaagtagcaaccacataaaaagatctaaacagacattttatagcacaagtgctaaatttcctacctgatgaattgatgatatctccagtactcaatatagccccagaatcctcagctctgtaacatgattaggatcaaggtcaggaactccatcagttccttcaagatcctctacaatatactcctgccatcagaggaatatcaaatactgtgaggtgtgaatagaactttaaatacaagctttatgtggtatacaagaagataatatgccataggcaggaagggaaccatgtgtggggcaactagagctcaggtcccacatggcaaaaaaagctataacaaaggcaatgctctagtcctaggcttggaagaatctcggctacacccctggccataaggaaaagggaagaatgtaaatagaacacttttcgcatcataaaaaaactgtcagctaagaaagaatctacattatgtcataagaaacctcattttgtgttccctgctggggccatcatggtctaccattaaatcattgattaggcagtcttttcacccttattactaatacacccacaacttatttatttaatttcactaaaacaaaccaaccttgttttcgcaaatagagatgagagagtctgttcacaaccttataaggtcatgtaatggttggaataagtaaaaaaaaaaaagatgaagaaatctgcatgtttttgtgcatatacagattgaacagttgatggcactactattaatatttcaatgacacagtgtagttcttgaaaatgaaaagatcagtcaatgaaaattgtgtttccatctttatgttctttaaccaaccttggttaactcttgctttgcaagaacatggtaatgccgttctgtgatcctctgcccacatattatagctatgaagaatccatacagcaaaccaaccaaaacaatagccaatactgcaatttaagtaacatttaaaacgttaattattttgtcaacaagtttttaacgtagaagtagaggatatagttcttattcctgtacacagacaacattcacagggcaaaaatatgtacatcaagacctgtgcaatcacatgcattgagttaaatgccaacaaaggagatatgtgctatcggcgttctcatctaatctgccagttgcttttagttccctctgaccacatagacttttgttttgactatgttacaattcgtgcagtcttctaaaagaaccatggaaacaaatccctctgaaaagcatcttccgtgattccatttacatagagagcacttagataatcatggacgcccaacattaagtgtagtatatgttatctttcatctcaaaggcccaaagctatagctgccattataaactgcgcgatgatcttcacaatacataaaagcaattctacataaattgcactgtactttggttccacaccatatttttaaatggtagctataagtatgaaatgaaagatgtaatagaatggagtgactttctttagagacataaatgccaggccatgttgacagtacatgtcatgaactggatcaacatgaacagatgctacacaagaaaacgataagtttttcagttctctatgagctttctagataagatgcagttcatgacatttccagatatcactatgaaaaagtaacttacttgccattgcataaaaagcatatggatgctcttcataaccaaacatttctcgtagttcatctccataaaatctgtatactagcatacccaataaagcaacaacctatcaggcaggaaaacggataagattgtaagacaaaaacaaagatgcatcttacagcagcacatcgtgaccattttcaggcctctttcttgtgcatttattcaaaaacgtttatcttttggatctcacgccagaaatcatggcaatgtattagtaagaagtcagtgaactaactaccacatctcttcaaagaaatggtgatatcaatataaatccataaaatcattactgctttatacattaacagaataaggtgcaaccatgtcatgcttgagttcagtattgtagcatgttcattttttagggtaaacagttggagaaatcctactgagatgtattcagtattggttcagtaaagaaaaaacagtttgttgaattagattacagaaggtgtggaactcgtaccagttgtacaataaaaaaaatcaacgtgtgatctctaacaaccagaagttgaaacttcaatctcaaccaccatcgatctggaggaacatttgcacgaagtaagaaggcagcccgacactcagtgcaatgtgaaaaggcaaaaccttcctggtggaaatgtaacatagaaactaggtcagagctggattaggttaatgattaactggattctgcgatggcagtaaatataggtacatgaagcataaagagcaaatgttcatgaatccacctttgttgatctccagttatcaagacaggatcgatgcacgtatttctgtgtgcccttgcaatgacaaggtgcaatcaagtcatcacctgcttgtagtggatatggaaaaaatatcagatcaaatgtagactcaacataaaaatatgaatattatcaaaaaaaaaatcgaaagcctttatggcactccataagaaagatacttcaagtcacagaatggaccttcattatcaaggcaaatccggcattgtggacagtcttgaatgacaaggtgggtttcttcgttagcatcaatagtttcaatgtcttcatcaacacccagtggcttgatttcacatgaaactagatgctctgtggagcttcctgctgtacttgattcagaaactatctgctgtgaagctggcacttctgcacaatcacagctggaagcaagctctgttgcttcatctgcttgagtggcatgagatgccaactgcattatgaacaatactgaaatcatgtccggacatcatcaagcaaacatttcaccagtcatgtgttgaaattaaatcctgcaggggcaaaaggaccaacaaacctaacaataactaacaatttatagctgaaagggtatagcagtttatactctgtataaaatacaagccacttgtattaacaatagtagctgaatgtactccttttgggtattgattaatgattaatgaaagttctctttctgcgcaaaagaaaggtacaagccacattactaagttgcgcagaattggtttcgtcctgatggtttgaagtatggatattagtaccctcctcttcagttagcaatcaggggaaggaaggtgataagttatactccaaaagctatggtaataggatcatgtgctgtcactagggctgctttctgctagtgctttggcgaacttttaagcaaaattgatgtgattcgtagaaaaatacgttaataaatgagtatgtgttacttctgcaccacttgcatgtcctacaacattcctctgatttacgggctctgttaacagcattgggttgagtagaatctagaaattagcaattggatgcatcaaaaaactttgaaatgttcaagaattcaacaacgagcatcaacgggcaataactgataccgctgcagtgaatactacacggggaccaatgattaacgctactctccctcaacccagcagcaaccaaacccaataggtgggaatccaattccaacagcacatgtgctcgagctagtatatcctggtaccaaatcatcaaatcacctcatccaatccaaggggattccacatcccaattccgattcccctcccaaggctatactctcctctccaaccaaatcacacaccaccacccccccccccnnnnttnnnnaaactgatcggtgcgtgcgacgcgggctctcgaaccaaatcacctgcaacaccccccgcgtcacaccacccaccacctatctatcacgcaggttgggttgaaccgttgaaggcagctgctgcttacccacgcgctggaacggatctccctccaatggggggagcgcggctgcgagatccggcggaggtgtagatgggccgggggcggtcgtggccggcgagcggcggcggcggcggcggtggcggtggcgatgttctggaagagtggagaggcggggaggagggacgaggaggagaccgggacaggggcgcggccgtcgtcggtcagcagcagcgcggaaagcagagagaatcgagggggcgtggaccgcatggtggaatggaatgggaacataaaactaacacgtcaaagttcaaacgcgattaaacaagtgctcaaaacagttttgtgccttattaaaacgaataaaaacatttatcttgtcaaaatcctaatattaacagtaagtagaaaattataaaatacaattgatattcagtactgttcatgtcataattattttgtcgcgatgcgttttgtgtcgggttgggtttaataacatgtgttggggggcgctgatacaatgatacacgataagccacgcgcccccatgcgcgcggggtcagtcgcctcccctctagtctcttctctgtatctactactatacttgtgtatatactacatatacatatgtatatacatatgtatatacgtgtgtgtatatatttatgaatattttttaacgcataaaaaatatatacacatatacaaagtttatatacaatgtatacaaagtttatataggatatatataaactttgtatacgatgtatacaaactttatatacatacgtattaaaaaataaaaacaagaaattgcatcacgtatacaaagtttgcatacgtgtatataaactttgcatatgtacgaatacaaaacttggtattcatacattaaaaaaccgaaaaaaaacagaagggaaaccgaaagaacaaggaaaaaccaaacggaacagaaacggaaaaaaaaaagccaaacaaacagaaacggaaaacacggaaaaaaaaaaggaaaagtcggactctcgcgcggcgcgtccgccgctccctccccacgcgcgacacgtgtccagtcgcacggggagggatgcgcgcgactgatcgcccaatagccttctcaacatgtgtttgcgtgaactgaagttgcgcgagtcaactatatatgtgtctatggtcctttttcgtgtcagataaacttagaatgaagatgagatagaaataggcattccttcctcgttttggatatattcatttgaaatcaggcccccacgttttgaaaagtatgttgatctagaaagtttacgagccccattgattgtcctaataagccaaagctaaagccaaaatttatattttcaaatttaattttgaatttgattttaagatattttcaacgtagtttttttaacattagctttaagtcgcaaagaatacatatataaaaaattttacctataaattaatttttattttctaataagtcgttttgacttattagagaatatgtgtaaccaattaggacctacacatagaaacttttagcatagaaatattctacatagaactattgcatggaaatttatacatatgtatttgaaaacagaaaagcaagtttgagaataaagagaaaaaacacaacacctatttgggccatgaggcccatgtatctcataaaaatgttggatggaatggcgcggaagagtgatgcgtaatgcgaactgaaaaaccaaatgtgctctaactgttgccagaactaggttggaacatgttcacgtgatagccttttttccttgtgatctagctatgcgatggattatctttgtaaaatattaggcttgttcggattgtagcaaagattgtcacatcaaatcttagaattgccgcagtttgttagccaaagtgattactataactattatatgccatacattttgtttggtaccaaatatcgccgcacttgtgacgaaaaaattattcataacttacaatctgatcgacacatggcactttgtgttacctcaagtgtgcattggcaccgtaaaaccctgcatacaagtcgatgaatgcttaagttcagtcatgataacgtaagatggagaccttcatccaacaacgaccgtctagatgagtcggagctagtggagatacaacgagccatagttataatacaacaaaatagtcagttggtttattttcttgttccttcacttatttcctatcccgatctcacctcttataacccatttgctaaataaatcctcagtgaagggttggtatcaaatgagacggaaagaatcatattttaggatgtaaaattttacttttggtagtggtctctatcctatttgcctgagttataatgttttaatatggggtgtatatgagagtatggactaataccttgtcaatccgcaaaggaaaagtctatacatattaaggccctctttgtttaggcttataaaccaacttataagtcgaaaagtctaagcctaaacaaacaagcagcttttctgtttggcctttttaaagccataagccactctaacactattaagccaaaagctaggttggagaagcttttttggcttatgtgaggtagatgtatgactcaactactaaacttaggacattaaatccaccggcttataaatcatataagccaataagctgacttaaaagtctaggccaataagcctaagcctaaacaaagagggcctaaattgtgtcataccaaactcttacaaacactacatcttacgtcgtgactcgtgagtacatctagattgtctatagcttttatctacttaaatcaaacagctaaggttattgtttataagagttttgtagagagagagaatctattatatatatgccattgagtttgtcgtaagtccccgcaaaaaaaaattgagtttgtcgtaagtctacgatttaccactgactttgttacattctacaatatgccatcgacttttgcttaacttctacgatttaccatcgttgtccggttagcctccgttatacaattttgtctaaatgaccaaaataccacaaggacaaaaacttccaaaatttggatttttttccaaaatatcatattgtaaacatccaaaatttggcaaaaacttaaaatatgatatttcaaaaattttgttcaaattttgaaagtttttatcctaggggtattttggtcatttggataagattgtataatactaacagaggctaaccagatagcgatggtaaatcgtaaaagttaagcaaaagtcgatagcataatgtacaacgtgacaagtcagtggtaaattgtagacatgtgataaacctagggccatataatgaattctctcgtgttgaggcttgcatatgtagcaatgctcataagcaaaattataaaaatatacttcttccatcccacaaatgatcttgttagacggtatgcactcttgtgcaactttttgcgtttatgttagacatacaaccatatatgtggcatgtgactttggaggtgcacactaaagaacatgtacacacaaaatacgtctcaagtgccctgttagaacattctcaagcaatgtttatcatcttgtctagtactagtttctatagcctatagcatggcttgtgttccttttgtccttttgatgttcctcccctcgttactccatcaagagaattgaagcgtgttcaccatatgtcacacaaggtcagtagcccaccattcaaaattcaaacccacagctgtgtatacaaccaaaattcaaaccaatcaccttcaaaccaccaaggtgggaaaaaaagaagaagaaaataaatccgcgggctcccctcctatcatccgcaaccgcaaggccgctcctgcgattaaaggctagcgatccatccacccatccgtccgtccatctgtctcattatccatccatccatccccatccaaaccgcgcccacctccgctcgaattcaaaaaaaacccgcacaccataaaaaccccaccccaccccacacagcacgcctccgcacccgtctccatttcaaatccacgcaaagcttccctccgccccgctcccccccccccaaaccctagctccaagatccctcccccttcgcgggcgcgccgccgcggcctcccggatggaccccgcggggctgcgtgtggcctcggatcccgccggatcgggcgcgtcgtccccgccgccgccgccgacgacgaccacgaaggtggggtggggggggggtggtcttggatgttggtgtcgttggttcttggttttggatttggggagcctggatttgacgttgtggtgtgtgttcttgcaggaattgggtcgggcggtggctgcggaggcgtcgtgcgggtcgcgggcggcggtcggattgggaggtggggggttctcggcgcttcttgattttcttttcttgccgtcttggttcctgatctgtgctggttggatgattcttggcgcgggggtgatctggaaatgctagttttttactttcttgggtggtagttgttcttgaactctttgtatgcagtagtacttcattcgctggcagcacagaatttcgacatgtgacggtagattatggtgcttctctacagatctaagcgtatgagtagatcgaattttcgattagcctttcttgtagctgtaattaagaattcttgtttgcttctgttgaggagcgaattgacataacaaactcagcatatttctgtaccgctaccaacataagattactcctggatgtgtagaatgtgcaaatgataaattcaggatgaaactgctgttgacaattgatttctgtgccatgcaaagttaataattcgtgagtgttactcttttctattgccataaaccaatgttttgaaaagcggtatgtggtttcgtgcggtcaccccaccttgtagaacttatgcggcttaagcggtacaaggttgggtcactcgttccttgtatgcatccttgtacagggccttgtacacttttttttaaaaacacggctataaacccatgcattcctgattcctattatgtactgtacacatccttagcctcaattcacaccactgaattcctattatgtactgtacactgtccaaggcatgatttatcctaattgaccgtgttactggttacttcccttaatctttgcactgctaatgcttactaattattctatatcatgtagatatgagagtggggatttcagattcgtcagatcgagcaaaatcttgtctacatccatgtgacaagaaagatacacctcaagttactgctgaagttgcaacaagaagtgaagatggagagccctcattgcttgagactggttcatttcttcagccagaggctgcctgcctcaccttgggccgttcttctgatgcagcagaggtgaacaatttgtgtgataaagaaaacatcaggacagacttgcaacctaagcctgatgtaagacatgtagagaacagaatgaatggtgcacctcttggattggatcttaatatagtagattcttccaatgctgcagaacttaatcccttctttccttacaagaagttggggcagacgaaagttagtgatccgtcagagtgtggtagcacaactggggctgtaggagagagtgagtcacacaggaagtggagagaaatgaagcagaatgggttcctttcttcatctcaaggaactgcagtgggtcctaggccgcgcggtcgacccatcaaaaggaaaagagacgatgaatccaaaaggaacacttttgctcagaaggaacagacaaacaagttcatgaaggttgctgctccgagtggcctattatctgggctaaaccctggaatcattaaccatgtgagaaacagcaagcaagtttactccataataaaggctatggtgcactctgagaatcttgagaaagagaaccaggcagttcatgctagtcaaacaggcgaaagagggagagaatttagtgagaaggctcaggaccagagatatgggggtaatatgatgaattgccacttcttgatgaaaggtagcaacatgccgtttcaccaagggttgcctactgcttcacaattccttccagaggacggtgatgatctgaaactgcaactctcatcagcagtcactatggcttcagacaggacctgcagtacatcagccgatgattttgcatctaatcatgattacatgactgtgttatcagtaaaaggtatacttgatctcttatttcgtcaatcatacactctcaccagaactgcattgttcactgtttgtagaattatctatacctgacagttgccttgcctttttgatgatcagcggccaatgttgcttctcagtggttggagctactacagcaggacatcagagggcgccttgctggtactaattcttgagtttgaaacataattcaaagctgtaacccatacattctgcttaatatgctttctttattcttgaagctttgaagcgcagcaagaagagagtcaggaatgcccttcagactgaactgccctacctaatatcaacagaattttcatataaccaagagaacgaaccatccgttgtacattcttctgatggtggatctactggaaaaacagttccagaagcgcatgtggcacgatggcggtctctttttcttcagatggacagaacacttcaggaggaggggatgcatctggtgagtttttttcataatagtgttcattataggtgcacaaaactagcatattctcgcaatatcgccttttatgacaaaagcatatgtgcatgcgcaattgcacatccattctggtaagcagtgttccactactgacaccgtgctaaattactgttgcaggagaatcggttgaaggaagtgcaagaaatgcaaatgaattgtgagaaagggctcagatacatggcttgcgaggctccattagtaggaccaatggctgaattatggttagctcatcatcacctctcaacgtattcgattcgatccacccttttctgttagatgagacttagttgaacaaagtactcaaatatatagcaactaaatgtcttactccctccgtcccaaaatataagtatttttagctatgaatctgtccagattcatagctaaaaatgcttatattttaggacggagggagtagtttccaagtcatttcactttatgcgtgatatatcttactgaaatactactactacgatgtctttcaggaaactgaagaactcggagactcctgagagcgagtgggcagtgcaagctgctgccgcttccatctactcgacttgcaacctggtcatgagaaccgagaatgtttcttgcttctgatctcttctcacaactggaattagtttcttgcttcttcttttttcttttctttttcattttactgatctttacctcagtcagcgttgtgtgttaggttatgtttttttttctctctttatctatagcctggcaatgatctcatgttgagtaaatctgcagtggtttgtgctgcactgcttcatgtaacgtgaaatactctgtaacgtctgctgtttccaacttacaatttcacagccgcgtgaaataacaaatttattcctgtatattcaccctgtttcaaaatgtttggagtggagtaagcttgaactaaaatagtctgtgattaattaagtattagctatttttttttaaaaaatatattaatttgattattttaagcaactttttatagatttgtttaaaaaagcacaccgtttaatagtttaaaaacgtgtgttcggaaaacgaggcagggttaggaacccagaacaccgaactaattaagcgcaaatttcagaaaaaaaaaggtacggagtataccaagagcaagtttaatagtatagccaactactagctataaatcatctatagtcaacttaatagccaattcatacaatagttacgtactacactattaacatctagtcccacttatcatacacacattgtgtcttggagtccgtgctatagctggctacaaatctgtagtatctgctctaagcagcaagtggaaatacggacacaaaaaatgtaacataaaaaatgtaacatggccgggcccaccagtcagtgtcagtggactgggccgttgaccagacgtgtaccccaccggccagtcggcccgggccggtttaaaccctctccgccgccgtcgccccgcggccgccaccttcccatgtccacctcccccaccgccgccaaccacctcctcgccctcctccgccgcaacgccgcctcccccgccgtcgcgctccgcctcttcctccacctcacctccgccgcgtccccgccgtcgccgcactccacctcattcctcgcccgcatcctcgccgccgccgccgcccacgacgccgccctcctcccgagcctcctccgccacctcctctccctcccggaccccgcgccgcacctcctcgcgctcctctcctcctcatcgtcgccgctgcgcctcccgctcgggttctccctctccgcgttccgctccctctgcgcgctcccctccgcgccgccgccgcccacccccgtctacaaccgcctgctcctcgccgcgctccaggaggcccgattcgacctcgtcgagtcgctctacaaggatctcctcttgtccggcgccgccccggacgtcttcacgcgcaacatcctgctccaggcgctctgtgccgctggccggatggagctcgcccgcagggtgttcgacgcaatgccggaaaggaacgagttcagcttcgggatcctggcgcgtgggtactgccgtgcggggaggagtatggacgcgcttggggtgctcgattcaatgccaacgatgaatttggtggtatgcaacacagtagtcgcggggttctgccgcgagggccaggtggatgaggctgagaggctagttgagcgcatgagagatgagggtcttgctccaaatgtggtcacattcaatgcgaggatctctgcactctgcaaagctgggcgggtgctagatgcatacaggatattcaacgacatgcaggaaaaatgggagagaggtctgccgaggcctgaccaggtgacgtttgacgtgatgctgagtgggttctgtgaggctggtatggtggatgaagcaagagtcctggtggatattatgaggtgcggtggtttcttgaggcgggttgagagttacaaccgttggttgtcagggctggtgaggaatggaatggttggggaagcacaggagctgctgagggagatggcgcatgagggtgttcaacctaatagctacacctacaatattattgtggatgggttgtgcaaggagggcaaagcgtttgatgtgaggaaagtggaggattttgtgaagagtggtgtcatgacaccagatgttgtgacctatactagtttgctccacgcttattgctcagagggaaatgctgctgcagccaataggattcttgatgagatggcacagaaggggtgtgccccgaattcatttacttacaatgttctgctgcaaagtttgtggaaagctggtaggattacagaggcagaacgattgttagagaggatgagtgagaaaggatacagcttggatacagcaagctgcaatatcattattgatggactatgtagaaacaacaaattggatatggccatggacattgtcgatggcatgtggaacgaaggtagtttggctcttggcagattaggttattcattcctaagtttacttactgattcttccagcagcaaaagatgtcttcctgaccgaatcacttattctacactggtgagtgcattgtgcaaagagggcaggtttgatgaagcaaagaagaaattgcttgagatgataggcaaagatatctctcctgattcggttctatatgatacctttattcatgggtattgcaagcatgggaagacttctctggctgttaaggtcctgagggacatggaaaagaaaggttgcaagccaagcacaaggacatacaacttgttgatatggggatttcgggaaaaacacaattcagatgaaatccttaaattgattagtgaaatgaaggggaaggggatttgtcccaatgtcatgacctataatagcctgataaagtcattttgtgaacggggaatggtgaacaaggccatgcctcttttagatgaaatgttacagaatgaaattgttcctaatataacttcttttgagttgttgattaaggctttctgcaaaacttcagatttctctgcagctcagagagtatttgatgcttctctgagtacatgtggtcagaaggaagtgctctatagtttaatgtgcacccagttatctacttatggtagatggttggaagccatgaatattctagaaacagtgcttgaattaaggatctctatccatagattcccatataagcagattattgagggactctgcaaagttgatgaggtggatcatggacataggttactcaagctgttaatggttaaaggatattcatttgatccagcagcattcatgccagtgattgatgcattgagtgaaaggggaaagaagcaacatgttgatatgctctcacaaaaaatgatggaaatggcagagcgtgataatggtcttgcagctccttctggcgaatttaagcctagaagtcagaagcatggacaggacaagcatgctgaaagtgattggcatgctcttttgcacaggtattgtgatgacaaatttagttctgatgtgtttgtgacattttctttagtctattttcttgtgcaagtttttgcattggttagactagcaacaaagcattataactgatttagtatataaagcatatgtactcagaacctagaaatgaaatttatcctgtctagaaaaataggtctgcactttctacctttgtgtgtcgaacttgagctgcaacggattgattttgttgctgattcaacagagatgacagtgctcgcacagtcatgaaaatcaccaagagagtgaagacaggatggggtcaaagaggcaacgtttatgagaataagcagcagcagaatgatgacatttatgtactagaaaacactggctgagtaagtttctctttaccctagattacatgcagacagtagaagcttatgaatgataataagttttagaacttgcttgtaactagctaatacaacttgaaagcacatatgttgtaagcttcaatatggatggttaacatataagtagatcgcaacatatgaaaggtgagtataataaggcaacaaatttcatttcatcttcattgataactcataaccactctttggttgaatgttgtactctctattcatcgaaagatccactgatatgttaacacatgcgctagattacctgtctgaggttcatactgtccaagcacttcttttgttctacaacccactaaatatcatgtatgttggcactttaagatcatcgttacatgacagcactactatatagtagatttttgcatataataggttttttttttgttttgctgtgcagtgttgctattttaggctacctttcagaaagagttatgattaaagcaattatgtcaagaaagacatgtcaaaggatctaaccctatatctggtaagttttgcaattaagtacatgagcagcatgtgtttgccacactattgttgcgctcaacatctcacatgttcagtgcattgtgctgttatatttactcttctttggagtttggactaacagtataatagttatgattggcaaatgaatgataattctttatataaattatgtcgaattcatacaatccagcataagaaaaaacaaatctacctttaaactgggcattcagatgtcggtgtactacaatgaattgcagcttttgaaactagagcaatccctgttttcttttgccattaaaacaacaacgttcagttatattgtggggtttttaatactctattctaaactttcagattccctgtgaatgggtgttaagctatacataggtaagttttactggtttgggccca

SEQ ID NO: 68163 - DNA, 2074 bp, Oryza sativa
ggggatggcagggagagcgacaccccaatcgcagtcggcaaggcagcatcggtggcgcggcggtggagctggccatggtcgccggcgagctcttcacgcacgggatggaggaaaaagaagagccaggggcatttccgtccaggatggcattttggcgaagacactctgattgaggatggtattctagcgaagcccattttcataatggtattctagcgaagccattcttatggaatggtagatgtgcaattttctcgcttgtgcctctgttcaagagatataactctagttgggttactgttgctggtccacgtgaacccagctactaattcgtgggccctatgccacacggctagctttgccatagacttggtccaccggaattgtttcactgccggtggacccggggacccagctgtattttttttagaactggacccagctgtacatacacgtaaccatcttcttctttagcccccaaaaccccacggtaaaaaaaaaaagaacaaaaaaggaaaaaaaacaaaaacaaaaccctcatgagtcacgacacgagcaaggtggtatccgccatggagacgttggcatctcaccggagaggcccctgcgtactctcctcccccgacgccgacttcctcaccggcggctccgtcaccgatgtgtcgacagtatgctcgtggacagtaatttttgttagtagggtttttttatctagcctttacatccaactatatatgcagcctttttaaattaggaacttagctcttaaataatccaatctgaaattcgctcctataaaaatttgaacttgagatattggggcgctactcatatcactgcaaccactagtagaaatttaaccatggctcagagtttagcgggagcgggggtgtgcaaggtttcaccgtgatgaggctctcccggtaagctgcattccacggattgcttctgctacgatgagagcagctgagcatcctcttctccttggtgtcgtacaccaagccccatctgcaggacaaggtgacaagcagtagacccgcgtcgtccaagatagctctaccaagcccccgaggcttcaactccttggaataatatcccgccggcagctccacccggaggcgccgcacccacctctcgccgccgccgccgtctctggcccacacgtccaggtacggctccgccggcatcgccgccacggcgagcgtgccgtccatgcatgtccagcagcgggccttcgtcggcatgctccaccggcggcggcgcgaccgcccggaacctctccgacaccgtgtcgaacgccattatccggctccgatcgtcgacctcacggcggtcccagtacacgctctcgccgaccgtcttgccgacggtcacggcggagaaggagcaagtcctgcgttgctggtcggggacggggccgagccgccgcgcctcgccggagccggtggagaggatgtagttggtgcccttccggtagcacagcacgcggtactcgccggacggccggtggaagtagaaggcggaaagtggagccggaggtcgttccggtcgacgacgacgccgccagtgctcaccggcggcagattgacgagctgccgtgtcgccgggttgcagatgagcatggtctcggcgttcacctgctcgaacagcaggagcccgtcgcaggatccacggaggcacaggcgcacgttgcgccgcagaaatcgccggcactccgtgtcgtcccgtcgtagacggctgggacggcggtgaccggggcggaggtgaccaagaattcgtcgtcgcgcagcgactcgtcgttgggccccgtgtagccgaggagctgcagcggccggcggcgggagtgggcggcgacgaagtagtcggcggtggtgatgcggcgccagctccggcagacggcgcggcaccggaggacgctcttcgccggcaaccgcaagaggatctcagccaccacgtcgtcgttcatcgcggccgcgcctaattgggttgcggtcggggtcgcaatgtgctgcacctgcacacatatgtgtagtactccacgagtccgcgtacgtaaccaacacgtatgacgctt

SEQ ID NO: 68164 - DNA, 7244 bp, Oryza sativa
agtgggctaggcttcttttattttattggctgggctcgcttcattatgtagagtgggctgggcttcttttattttattggctgggctcgtttcattatgtagtgggctgagcttcttttattttattggctgggctcgtttcattaggtagtgggctgggcttcttttattatgtagagtgggctgggcttctcttattaaagctcggcctgacttcaaactcctccgcctggaccttcgcgaccgaaatggccgccgttgccggcgacgacgcctctacctcttccgcccagagctctccgccgccgacctccgcctcgacgactcgctcctcctcctctccttctcgctcgccggggaacccgtcccccacagggtccccgtcccgagggtgctcgtcgaccccgcggcccctcccgagcgccgcgccgcgggggaccatgtcgaggtccgcctcgcgctcgtcgtccccgtcgtcgccgcagccccccggcgaggagccgcccgcgcctctctccctcggcgatggtgagctactcgtgtgttttactgtcctgtgaaattattaggtagtaggggtttatgagctttctggttgattcgtggccaataatttgatcactgctagtcactccaaatcgtcctgtgcctctgggattttagtactactgaaaacctaagtcgatttgcaatttaaattttaaaatgcaattcccaattttaatttaaaattttaatagcattttaaattccccgttcccaagtctagttcccacttcccgtcattgttcttctgtccactgccataaatccacagttcttgacttccacattcgaccaaatgaagccatggccgacaatataaattttcgcacgcctgcgtatcaactcgttagcaagctaaccattcggtgcatggaggggcacctcatcctccatgaggtggtggtcacatcacactcttctctgctagttccaatttggtgagtagaatatggattccaatggagagtaggtttgaggttttttaagtacaatctgactgtacgcttattgtcctttcatctgttgcttattttttaagtcttatcatctgaatagctacaatagaatacagagatgtggactgcaccaggtctgagctgcttaaggttgccttcaccgaaaaatggctgcccgaaaggctccaaaataatcggaaagcaacagccaagcaaaggtacatcggcggcattaatgttcttaacaatttatcaaatgtattttattgtatcttaggtagagacgttggtgtttcctaagcctaggtgtttagctgtaaaggaacatatcaaactttgtataagggccaaaaaatatctaggagcgaagacccatacgacccatgtggctgtgtatgggagataaggaaatcccttctaatttaaaaaatcctattgggtagatcctcaggtttgacggatgacaacatcgatggtcatgctgaatttacgtctaggtgtttgggtaatgcagctttgaattcttatgcgtggtagtcagcttgtaattgtgattgtgttatgctgcagttagccttgggcccctcatgccactgggcatttgtttgcccaagtttaccagaatttgtgatgacttatttgtccgatgaaaaatatttgcatctcatttagttgtagcagtggactaaacaacttatagtgcggcgggggctgttgaaatgtgactaaaagtgctatttttcagcagcttaaacattctagattgaggtggttaatactgaaaataaagtgattagaatttccattttaatattgcagactcagttgttactgcaatcaacaagagtagcagatctgaaaggcatctaataagcgaggaatcaacaggaaccatcatgatagctagtcactctgctcttgtactgtacttgaagttttggtttctgtatgggacagtcgtcaactggtctctgggtctataaaatacaaaggatgtatgtggctcttaactagagcaagacatactttttcatatcttccagacaaggtgcattagcaacatagaatatggaagggactggtgagatgagagaggttggacgagaaactctccatggaggtgtggtgcagagtgttagtgagactgatgagtacaaagaaaagactattgacagtgaaaaagatgggcagtttcgggtgcaggtaagcgactacattttgcgcattcatggagttctaatgccacaataagctagtgcttgtttcaatcctatgcttactttttgctgggtggaacagccaagatggaggaaattcttggctcatgttgggcctggagctctggtggccattggcttcctagatcctagcaactgtaagctcctatcttttgcctagagcttcatattgttttgatacgctcattaagaaaaaaagaaaaagaagaggttgaggtggtatagcttttttctgaaacatgatttgacagtggaaactgacatgcaagctggagctgacttcaagtatgaggtacactgcatagttcttgcctcttcgtcttggatctgaactacttttacgaactaattaaccatgtgtcatagatttttgcctgcgcatggaaagggtgaatgtaaccaaggttaatcaaataaagacctggtgaaaggctcccaatcttggaataaatgattgaaagactatcttggaaccatttattagttggaaaattgcctggtttggcctttgaaaattgttaactattacaaagaacctacttagtataagcgtcaggaaaacacttatttgggcatcaaatctgaacaaaacagactcttaaacattttagaggtattcctggatgttttgacttgaaatatctttaaaattccaaatataaataatattttgagattttcttgcactgatttcatagctgaacaagaagaattctaaaccttccactgagggtgtggcctttacagaatattgaaatatgtttccttaaaggcctaaataatcaaagtttaaacttaagtctatcctaaggactgtaccaaaaggactccccgttaactagcataagcaacaatgtcttatttgaagaaagaaaattggattattttggggagtacacatataagaacgttggaatatcaatcattgacttgagatgactctatcatgacatgaaccttatatatatgatataatagtagcagtagtacacgaaatcaaacaaagtctcccatgcctagtaaatggtggtcaataatttgtttctttcctaatatttaaagaagacaaattcaatcaagaaacagaaaagtaggagaaaaacaaaattaactatttcgtttttcctgcctcctctttatataaaatgcttcttctggtaacatcaatttacattttacaatgaacagcttctgtgggtcatcttagttgggatggtctttgcacttctgatccaaacattagctgccaaccttggagtgaaaacaggtatatttcacttaaccattaaccttgctctttgcatgctaatcatgcatcatcaccttatcatcttatgttgtccatgcttttgttgagttctgtacaggaaggcaccttgctgaactgtgcagggaagagtacccgcactatgtcaacattttcttatggatcattgcggagttggcggtgatttctgatgacattcctgaaggttgatcgatgttttatttatttatttatttatttatttatttatttatttatttctgtgctagatttagcatgagtaacacgttcttttgttagtgcagtgttgggcacagcttttgcgttcaacatattgcttaagattccagtgtgggctggagttattctcacagtgttcagcaccctcttgcttcttggagtacagagatttggggtgcgcaaagaatttctcagacttatatgattgtcagatgaattacactgagaatgggctactgacgaattgaccttaccatatgacatgtccaccaggctcggaagctggagttcatcatagcagcattcatgttcactatggcagcttgcttcttcggagagctaagctatttgaggccgtctgcaggagaggtggtcaagggcatgtttgtcccttctctccaagggaaaggcgctgctgccaatgcgatcgcactctttggcgctatcatcacaccgtaagaaacccaatcagttatcagggctttggtgatcgtagctactttttacttgatccatggtacaagttcatgagatgaggagttttcataacatgcatgcagatacaacttgttcttgcactctgctctggtcctgtcaaggaagaccccacgatcagacaaaagcatcagagtaggttgcattgataatagatgatgtaatgatcagctatggtttgttgttgagtggctaatggtttgaccctatcttgtttccgataggctgcttgcagatacttccttattgagtgtagtcttgcattcatcgtggctttcctcataaatgtttcagtcgttgttgttgctggatccatttgcaatgcgaataatctttctccagctgatgccaacacgtgtggtgacctaactctgcaatccacacctcttttactcagggtaagaactgttcgaatgttcatttcctggataaaagatagtactttcagaagcatcttatagacatcttgttctgtaatatggaagaaattacagaccagagctcactgaggatcatgtcagacattctgaattcaagccttattttgattatctcttactttcagaatgttttggggagatcaagctcggtggtgtatgctgttgcgctgctagcttctgggcaaagcaccactatcagttgcacgttcgctgggcaggtcatcatgcaggtaattcagttccgtagtgctcacccttgatagtaaacctggagcagggtttgtcaagtttacactattgatcgaggtgttatcaagtttgtacaaactatttgataccttgcatatcatttgtccactcttgagtattatctatttcagtaaatatagccaacttttgttatgataattatccaggggtttctggacatgaagatgaagaattgggtaaggaacctcatcacccgagtcatcgccatagctcctagcctcatcgtctccattgtcagtggtccctcaggcgccggcaagctaatcatcctgtcatcagtaagactcatcaacctgttttcagctttatttttccaattgaacattctgtaggaattcgctttgctcctccaaaagcaacaatatcctgaattcttgatttggatacagatgatcctgtcatttgagctgccgttcgctctcatccctctactcaagttctgcaacagcagcaagaaagttggacccctcaaggaatccatctatgtaagcttgcttaaaccatttctccaaccaaaaaacattcacattcacccacccacacaaacacaaacacgaaaaccgattaattcgccatgctagatacataaattggcaaatgatccaataatttttgcagacggtggtgatcgcgtggatcctgagcttcgcgctcatcgtcgtcaacacctacttcctagtgtggacatacgtggactggctcgtccacaacaacctccccaagtatgccaatggcctcatctccgtggtggtgttcgcgctcatggccgcctacctggtcgccgtcgtctacctgacgttcaggaaggacacggtggcgacgtacgtgccggtgccggagcgggcgcaggcgcaggtggaggccggcgggacgccggtggtggacgcctccgccgccgacgaggaccagccggctccgtacaggaaggaccttgccgatgcttccatgtagccttgataaattattgcttgctgagtagtgcattagttattcctcgtcgtcagtgtataactagatgtgttctctggatgatataatgtgattcgtcattgattttttgttcttcttcttgttgttgtttctaagcagcttagctgtaaattaagtttgagaaaaaaaagtgtgcactactacttcttccgtcccaaattattttgatcagtaattctttaatgttatgttttcctaacgaatatgaaattagcgtcacatgaaagtactttaaaatataaatctaataatataacatgcatactacttagcatatgtatttcaaattgggaggacgaagattttatagcttggcatccagacttgcatggtagattctcagtcaggagtgcttattacttggctctgaatttgaagaatcaagaggatacaggtccgtcgaatatggcaggcgatcgtagatgggacctgatctggaagtgtgaagtccctcagaaagtgagaagttttgcttggaaggttgccactgactcccttgcaacaatggctaataaaacgaaaaggaagcttgagcggatagctacctgtggggtatgtgggtcagaaactgaagacacccagcatgctcttcttcgctgttcccagtcaagatttttgctgatggctatgcaaggtgatgggcactttcctgtgctcactgatgtgcgtatggataataaagcctggctgtttgatctgttagacaggctatccgaatctgaacgggcggcccttctcttggtgttatggcgaaattggtttgttcgtaatgaaatcgtccatgagaaaacccctccaacgatcgagtcttctaaaagattccttgagagctatattcagtcactgttcaacatccgacaaaagtctgtagttggttcagagaaaggaaaaaacgttctaatctgtcttggcttatgggaaagaggtccctccaggatcaagaccagcttgcaaacaaaaatgggtgagaccgcaaaccggatggttgaaggttaatatagatggctcttttgatgccctgtcagagaaggggggcattggcatagtcatgagggactgggaggggagggtgatttttgcttcctgcaaaaccctgaacagctgtcatagtgcattagaagcagagttggtcgcgtgcagagagggtattgccttggcgcttcagtggacgctgctcccagtacaggtggaaacggactgcttggtagcgttacaaatgatccaagccaaagaagttgagcgctcggagcttgcctttgccgttagagagattaaggatctcctcgctggaagtcgggagtgt

SEQ ID NO: 68165 - DNA, 2018 bp, Oryza sativa
cctgcacccccatcctgtttggatgtttctacaacaaattctggaaagtcattgaatcctttcttttcctttgtatcttcaacttctctgggctctgtacttgtattttcatgtgtcatttctgcataagaaattgcggtatcatccattttagtgtctgcactgtattgttcatcagtatgcacttgggatgcctcttccttttgagttgtgaccagagattcatcatggtgaacaacattgtcttcattttgcattccttgtttttcttctgcatcttcaatcactttatctgattcttgaatggcatgcatgtcaacgttgactttgtttgtgtatccttcctccgctctgtacatgtattcatcattctgtggaacagctataggattctgtacaacagataggacagctcattactctgataattatgtgatagcattaaagtaaatgaatgataacagctactatgcttttgggatgccatattcagaaatgagttaatcttgagaggcatgcaattgttgatagaaactgggaaatgttcacttagagaagagctggcactcaaaaggcttgcaggtcttttgtgttaagaactaagaagggtccatggccaagctcatagataaatctgccacttaaatgcacatgcatatactgcgaaggaaataatattataaagtagcaaaactcaagttcatctctcttcactttttgttattttgtataactttatatcctttccattttccatttcttttcactcaagatcactgtttttcgttcattcttcgaaagaaaaaaaatggtggctaacattattttcaatgtttatgaaattatgtatattgggtaatattcactacaacaaatcttacattctctagcatctggtcatttgaaaggtctgaatcaacttgaagatctctctccagagatgatgccaaacaaggttcaacctgcaagttgagcaaaagataacaatgttgttcagtataggcaatgaaacactttcaccaaaccatgttgttcagcatagatttagtcatatgaaatctaatcgcagcataagtcattctgtatttacatatttcttaaaggtacttctacttcaaaagttagtccataacaatcctctatgctaagagaagtaatcagtaatgcttcaaagtttgtattgccaaaagaaatcaaaagaatgagatgatagtgctaaaaagaattcttagttgcttgctaatcaatgttactcacccatcatactcacagtgacataagttacctgtataatgaaaaacttttttaccattttatttacatttctaatttggaaaattaacaattttcagttagttgaactagaatatgtctaaatttgtcacattgcatcaatggaaattctgtactgacctcttcatttctaatttcaccagctatttcatcatgttcactacttgaagttttttctaccactgcatccttttctgtattctcatgcacatcttcattatagtttttggcagaaacctctaaggtgccaccactatttggtccattctcttcttcagtctcttcttttatttccgtaatgttttcaaccatcgcatctgtagttcttgggatggaatcctcgggttcatgttgagttacttcatcattgagcatttcagtaaccacggaatctgtttgttcagcctgcaaaatttcattggatggtaacttactttcaccgtgcttctggttacaagagattttgatgaaaatagaacatgaaattagttagtatcagagatattcacctgaaatgcatcaatggactccacttgtgtgtctatgatgaaatcaaccctcttgtcatcatgtttctgttcatctgtctggagttcttccttttgcttctcaatttcttcatcttccttctgcttctcaatttcttcatcttccttctgctgttgatccaagttaacgttcttcatgtcctcatcttgttgcccaatatccactgatctttcacg

SEQ ID NO: 68166 - DNA, 1147 bp, Oryza sativa
cattttaatgtctaaagtgaatcatggaaaccatcattagtgatcatttacttcagaagtcagtccttataaaatttagcagttagcactgcctaaaatatgcattactattttatgtattgtaaacattttagatggatgagaaaaagcattggttgatacttaatttgaacataccttcagttctgctgactcatgtatattatcttctatcttttcatgcactgaaattacatcgccgattccattacccaaattttcttcatttgattctacatgataatcttgtagtgattttccattatctgttggagatggatcctctgaagtagctgtctgttcatagcagatttcttcatcacaagtgccttcagtgcccttcatttcttccatagtctccaagtaatgcacttgctgaataccatgagtcaactcaacagctgatagattgctttctgaaaatttctccgctgaagaaactgcttggcctgcatgggaggtttcttcagcttcaatggcatcagtatccttgacttcttccactaattctagttcatgcccttgatcaatatcaacagatgggtcaatttcatatgcaactctatcttctgcagttggatcttcaggggtgacaatgttgctttggctggatgtttcttctgcctctacgagttgattgtccttgctatctgtggttaattcaagctgctgtacgggttggacataaaaaggttggtcggcttcttgttcactgctttcttgagctccattctcagaagtggtaaaattaatttgcttggatatttcttcagtttctgtatcttcattttcttttacttctaccgctgatttattctcctgcacatgctgatcatcaacgtttggctcaacctcagtcactgactcctcacaggtagaaactccattttgctggtaatcttcagtgcctttggtttcttctgtggagtccagttcttgctcttgctgaacatcagtttcctgctcacttttgactaagtcactttcttgcactgcctcttcaggattggaggaactactgagatcggtttcttgatctgtgaaactctgcgcttgctgagtgtcaaaagtcgcctcctttactgttgtgatctctgggctgcaggaa

SEQ ID NO: 68167 - DNA, 730 bp, Oryza sativa
acccacattaggctccagaggagactggattccagccggcgcttcagctagaacctcatcggcaggaatatctgtcatgattgcaggttgtgcttccttgctttcttttgatgaatccagatcttgagcatcaactgtttgctcaatagcatcatcagttttacaaatttcttcctgcaccatggtgtcattcgttacatgaccttcaacatcttgttggccatgatccttggcctctgcattctcacatttgagaatggtggtatcttctgatgcactctctccatggctaagagaatcagtcatctcttcttcattgcttttattgctcgggtaagtacttgttccatcagatgaagtttctacctgctcttgactttcctgattaatttcatggggctgctcatttgaaatattctcttctttattcacatgaccattcaaagaagacgccgtgccatttaaactatgttctgaaggaattttggtttcagagggtgcttctactaaaacttcgtcctctggaatcttcaatattccttcagttgaacccatggtttgtgcctcgcccttgatctctttaatagaagaaagcttgctgtcaagttgtgcttgcaaatcagtcgcagcttccacttgaacttcctgggaaatgtataggttaatcgaacatataaaactgatacacttcatgtgacagtgggttgtcattatgacatgtacattgttt

SEQ ID NO: 68168 - DNA, 850 bp, Oryza sativa
ccgggcggctgcaaggacagcggcggcggggctctctctctctctctccaccgctcgcagtggagctggacggggcgccggcaagacggagcggcaaggcgccgacgacgacgaccagatccagcgccaggatgcacggatccggtacccctatggccggatctgctgcttccgggcggcggcgacccgggtcggcaagtcgcggcgtcggcggcgtggaggtggcggtgtcagcggccggagggcggcgtcgacaactggagggcggcctcggcggcgtggagttggcagcgaggcggaggacacggcggcatgaccgtggctgcggtgacaaacggcgagcgtgaccagttctggccggacggctagcggcggtgcttgcggccgtggtgcagctgcggcggaggtggatggcgacggtggcggcggaggctggtgagggcgacgacggctgaggcagccgctgcggtggctggcgatggtggcgacggctgaggcagccgtggtggcggcaacggctgaggcagctgcgacagcgaggtggcggcggcggttgaggcagccgcagctgtggtggtggctacacgcagtgtcgaccgtggatgagggggaggaggcacggcggcctcggacggctagctgagggcgtggtagacggctgcatctggccggcgcagtagcgtttggaggaggggtcggaggccggcttggtacagagaggcgcagcggatggcagtggaggtcggctcagcgcgagaggcgcgggcggcggagatggaggccggcttggcgcgagaggcgcggccgatggagggaggccagattggcgcgagagacgcgtccggtggag

SEQ ID NO: 68169 - DNA, 701 bp, Oryza sativa
attcctgcagcccagaccaagctaacaacaaaggcattttcatagtccatagagatcacttaccgtcagagatccaatcacagagcatattcctatatacactgctatgttggtctgcccatagcggggagcacaatgcgccatcaagatcagtgagaccaccagtgcaaaggccacatagcaaagaaaggctgcagaaaatacaaagtacaattgtgatgactgacgataataaagtacaaagggaaactacaaggatataccaggttgtgtcgccaggtgccaaatctgctccactgagctcggtgtctcctcttcaggagcatgaaggatgatcactgttgatccgactatacagagcacgcagcccagcactcccatccgttgcagcttctcattcaggatgaaatgggctagaacagcactgctccacaaagattacgcattcaccacgcatgtgcatggacagattaaaactaattcaaaccatgggttctaaccaggaaattttacaagcaaagggaacacatcccagttgtacctaacaattatgctgagagcgccgaggggagtaaccagaacagccggtgcgaacatgtaagccacgaaatttgcaatctcaccaatgagcactacgaaattcggaaaaaaaattatcaagaatttcgaataattttgcactagcccctcaagaaataagc

SEQ ID NO: 68170 - DNA, 1823 bp, Oryza sativa
ccgaaggggcaccagcctcatagtcgtcgtcttcctgcacgcccttctcggagttcttgggcaccgcgaggacggcgaggatatgccaccgtccgtcgtccgtagtgtacatcgcgctaggcagcgaggtgccactgcgcgtggataaggtccacgagctcgcgctcgggctggacgtcgccgggacgcgcttcctgtgggctctgaggaagcccactggtgtctcagacacagacctcctccccgctggcttcgaggagcgctcgtgcggccgcggcgtcgtggagacgagatgggttcctcagatgagcatactggcgcacgccgagaaggcgtcgcggcagcgattcgtgcagtcgcggtggaggtcctggaggaagaaagcagcaaagcgtttcaagccaataccaagaagctgcaggagatcgtcgcggacatggcctgccatgagaggtacatcgacggattcattcagcaattgagatcttacatggattgaactgaagcatctcaggatgtacacctacaactacaaaatccttggaataaaatgatttttgtttgcaaaggccgaacggtggggaaaattctaatcctgattttttttcattttttttcttcgttatttatcaatttgataccgtggaacgtctaattctttaattagtggagaacttaactttgcactcagcttgacaaattgtacaggcaagatatcaagatcatgggctttttcatctccaagcggcgagggcggggacacggcggctcgttcaggttccacacgacggtggaggcggcgcagcaggccatcgccaccgggcacgtggaggccgagagcgcggcgaacggcgtaggcctcaccaagctcatgggccggagcgccggccaccggggagaagagcggcagacagctaggcgagcggcgcaagagagagatggccgccgctgccccacgcgcctcgcgcgccatcgcccgccgccagccatgcgctgtccgtcgtcgcgccgcccgccgccgccgcgcggtccgccgtcgcccgccgtgctggacgccacccggcgagaggagggagcagagagatggggagagccggagaggaagaagaagatgattggatttggttatctgagaatgacatgtgtggcccacgtgggccacaccactgtagctgacatgtgggacccaccatttttaaattattttttctatggctgacatgtgggcccatgatttttattattttttaagatataattgccatgtcagcgccacatcaatgccacgtgggatggagaactagtcaaacaagtcacgtaggcgccacgtcatccaaaaccgccgagggactttgtttgcccggttttcgaaagttgggggacgggtcgtacccggttttgcggtcgagggatgaaaatcggattgtgcgacaaatagagggacccaaattgaacttattccttttcagaatatacttcccaaatccagcttgcccaggtcgaggtggagttgtgcagttgaaataggcgtcgaattagaagagcctcgttctgaaatttcagattcctaatacctaggcctccttgctctttgggcttacaaaccgaatcccaggctaccaattccaagagtaaatttgtcgcgaaactatcttggaactgcaacttcgagtccaatcagtttttactctgtttgcagtttcttacagttttggcagtgaaattgtagtttagtgaaattgctccaatgaactcaaaaacagagtattgcacaaaactgttttaactgctatctggacttctgagttctggcaaaacctgct

SEQ ID NO: 68171 - DNA, 703 bp, Oryza sativa
attcctgcagcccaggcgaggggctccatcttcaacacctcgtcggacacggaggtcatcctccacctcatcgcgacgtcgctgtcgcggccactgctgtcccgcatctgcgacgcgtgcgagcgcctcgcgggggcctactcgctgctgttcctgacggccgataagatgttcgccgtgcgcgacccgcacgggttccgcccgctggtgctcggccgccgccgcaacggcaccgtcgcgttcgcgtcggagacttgcgcgctggacctcatcgaggcgacctacgagcgcgaggtggagcccggggaggtggtcgtcgtcgaccgccgcgacatgtccgtctcctcagcgtgcctcgtcccgcaccgcccccgccgctcctgcgtcttcgagcacatctacttcgccctcccaaactccgtcgtcttctcgcacgccgtccacgagcgccgcaccgccttcggccgcgcgctcgcggaggagtcccccgccgcgggcgccgacgtggtcatcccggttcccgactcggggttctacgccgcgctcgggttcgcgcgcgcgtcggggctggagttccagcagggcctcatccggtggcactacagcggccgcagcttcatccagccgacgcaggcgatccgcgacctcgccgtgaagctcaagctggcaccggtccacggcgtgatccgcgggaagagcgtgg

SEQ ID NO: 68172 - DNA, 806 bp, Oryza sativa
aacgagcacgggggagccgcggtgccccgacctcaacctcgagctctcggtcgggccgacgccgagctcgccgccggcggagacgcccaccagcgcgcggccggtctgcctctgctaccacctcggcttccgcggcggggaggcgtgcagctgtcaggctgacagcaagggcccacacgagtttagatatttcaggccgttggaacaaggccagtacatatgagatatgaccatgagatgtgagatggcttaattagcttcaattcccaacatgtgtaacacagggagtttttctagtggacgacaatactgtttaatttcagaaaaaaaaagggaaagaaaaaggttctaatctgttcatatttcttactattatccaatcttcatgatctcaatctctctctctctttattatttttctttgtagtaattaacttcatgttggttcctctaaaaaagattggtcgatgttattcagtgataaatattcctagatgatgataatcagatagtggactaaggttggtgctaaaagggaggaatcgttgggcatctgattctagtgctggctctttgcattttggatcatgtgaatattatgcaaagacatcatgtgttttgtttttggtaggtaatatatgtactagtagtattctttgcttctacttcacaaattctcaggatttcaaatggtatgaagttaggcactagggaacgttgggtaggtaattattcgttgagatgctattttgggagtatttggaactggtagtttggttgcaggaatgccataggagcctttgggt

SEQ ID NO: 68173 - DNA, 705 bp, Oryza sativa
attcctgcagccctgaaaaaagaatcgtacttgttatttatttttcttttttcaacttgtaacggtagtagtacttctgtcacgtagtgcgatgtactacgactgccgagctcagtaataaaccgacgactaatcaatggattttggagcaatcagtccccaagtcccaacaaaaaaaagccgtatccagtagtaaccagtaatggattttggagtatactgctgcaacaaccggacacaacacatcggtgctcacgagagaaacagtcgtcgtaggacgagtcaccctccagcacagtgcaacgaaagctaggctggtgtcacgcaacatcacagccaaacaagtctcctgtagctcaagccattgcagtccacgggacgatcatacgaagctgaaaacggaatgactatccaacaagtacgtgaaacgcgtacgaacttccactttacgcccagtagcaccgtcctactgtttcaaaggcacctactacctatgtgatgtgcccacagaaccggtcccaaaattggtatgcacggatctgttccttctctctcagcattgatcagctacttgaccttctacatacaaatcactgttcacccttcaacaaaaactattttagttcgatgcattcttttttttatactactcgtataataacttcacttgagtgtcttctgttgtagcctgggaattttcccaac

SEQ ID NO: 68174 - DNA, 748 bp, Oryza sativa
gtgagctgggcgaggagtgggcggcggccgagtgcggcaggagggggtcgaggcggtggtccaggaagaaggcgagggggcaccaccgccgcggcgggggcggaggcggcggcggcgggctctgcaggagcagggaggaggcccccgcggggaggaagcgggtgatggtggtggtggaccagagctccggtgccaagcacgccatgatgtgggcgctcacccacgtcgccagcaagggggacttcctcaccctgctccacgtcctcccccacggcggcggcgacgcctccgcgctcgccaactccctcggctcactctgcaaggcctgcaagcccgaggtgcgtgcttaaagctacccagctttctaatcatgcaagcccaaatattaattttttttaggaatgagcacttcaatttctagtgtttttggttcattgatcgtgtagaactgcactgtttttttttcaacttatgaattgcacaatgtgatatgtttcttgttctcctatacttgtcattctgacttctgaggtggcacactgtgcttatcattttgaacttgagtgacacactgaggttgccattctgagcttgtcactcacttaatataattacggcgaggtgctttacatttttgcattccgagcttataagtggcagactacagtaaagggcgttctagtttgctcaggaacatataagtcatacagtgtatgaactatgaatggcaaaagtttggtttaattga

SEQ ID NO: 68175 - DNA, 1597 bp, Oryza sativa
ggtgagttcaagtgcctcgagctccacggctccgagacggtagatagatggtaggggtgaaaacggtacagaaacgaatggaaaccacatttatcattttcgttttcatatttttttgggaatcggaatcggaaaccccgaatactaaaatggaatcgaatattatcgaaaccgaaaacatcgcgaaaacaaaccggcgtgaatatagtaacgaaaaattatcgaaatacaaaaccccttaaactaataaatccaattcttaagtctgaacggtcaacaattcatcataaaacacaatcatataagtccaattgttaagtcttaacagtatatcacaaaacacaatctatggaataaattgtctatatttaagaaagtaatgttgttgataaatcccaatgtaggaaaaaaaatattcttacgtaacttcatatttgcataacaaatatttttaaaaaaatagcagcaaacaccatggtaatcactattcagtgcttcaaaaaagaatccagggtatttcactcacaaaattttcggaaattctgagaacattttcggaaagtttccgaccgatttcgagttccgacggaaactgcccttatcattttcgattatgtttccgagaaaatatttctgaattcgtttccatttccgaaaaaatccgaccgacaaattccgttttcgaaaataggtccggaattcggaaagtttccgtaccgttttcccccctaatagacggtggtccagtctaggtgtcacttcgccgatggtctagaccagcgacgagatggttgggaaatggtgatgggacttgggacatggcgatagcgggatggttcatcagctagatggtggggcacgacaatggtaagtgtggggctctgtcttagccttcgatgcttcgcttactcttgtcaacatcgacgggacaacgatgaagtgggtgtagcttggttgcgcttgtggattagtcgcggtaggtgaggggatgtgagaaggaggttgatgtagtggaggaagaggagttgacaccatattatggaggtggacaagaagagcgtgagagagaagggtgtgcccatgagatatgggctctatgtatttgttttatttactaaaaactctctaccacatagtcagccaaaaccgctctcaaaacagtctaagaaaggtcaattaatccgattttaatagttaaggaaatgactgatgtgacgcctacgtgactggtttgacttggtcctcgtcctactttgtcacgccccgaactagtcccgaccggaactagcccgtgacgctccaaattaacctgttaatcgataccagtcccaggaaacagtgctggtatcatagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccataaaactcatcgtagccgacttgctcctggaagaactcctcgtcagcaggatccacttcatcttctttagcaactgg

SEQ ID NO: 68176 - DNA, 765 bp, Oryza sativa
cacggtgatacgggcaaaagcgtgcacaccgggcggttgcacgtgacaaggggagacgagccaacggctcggattcgccggaggttgctcgacggcggcggattgcggcggcggcaaccggcggcgggagaagagggaaacggcgacgaggtcacgagagaccgattcccggcggtgagagcatccacgcgaccacgggaatccgatgctagcgtcagattggacggaactacgccgagcgaggccggcgacgagcgggtgctacggagctcgggcggcgacggcggcgagcacacggcgagcgacggcaacggtcggggcggcaccggctagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcggccggagtcctcttccgcgtccttgctcgtgccggctcctccgacacgcgcaacgacgatcggcgacggcgaaacagaggacggcaatggcgcggatgcgaaaatgagggagtttggaggggaaggagctggggtttaaagggggcggcaatgtcggtttgggaaccgacttagggcggtcaaggcgcgagctggcgctcggcggtcgcggccaaagcggcgacagggaggatgacgccggcgggggaaaagggctgcagga

SEQ ID NO: 68177 - DNA, 1614 bp, Oryza sativa
ggcaaacaacgatcccaagtgccttcgaaatccaaggcacacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcataggaggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaatttgtgtctttcttctcctgtattctttttattaattcttttatcccttcgtcgtctttctgagcctcccggatttgcgactccagggtaggctgtattgtcaagctggcagggacacctgactgtaccacggtcagtcttaacttctccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcacatctgttcccgattaaatagtgcctccagatcttaagagcatgaaccacagctgccaactcgagatcatgggtgggataattggcttcatgaggcctgagctgcctggatgcataggccacaaccttttgttcttgcattaggacacatcctaagccttgtcttgatgcgtcacagaagatctcgaaatcttttcggatatctggcaaggtgagaactggggcagtggtcaaccttttcttcaattcttggaagctgtcttcacaggctgcagaccattgaaatttcttttccttctttaacagctcggtcataggtctggctagcttagagaatccttcaatgaatcttcgataatatccagctaagccaaggaagctgcggatctctgacacgttcttgggcgggttccaagcaagtacagcttcaaccttgttgggatctacttcgacaccgttggaggaaatcacgtgtccaagaaatgctactcggtccaaccagaattcgcatttcgagaatttagcgaatagttgatgatctctgagcttttccattatcagcctcaggtgttca

SEQ ID NO: 68178 - DNA, 898 bp, Oryza sativa
cattccaactgcgattcctttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcgtcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgtggcggggttgctcaacctctgcgttgcgggaaacagtacgatgcgaacggttgctgtggtgagactgctcattagctgattcatgattttcttctggctcaactctaccatcctcaaaaccaaagcgggctggtgcacgagctgcacggcggggacggctagccatctaaactcccagaagagcgcggggtaagagtcagataagcacttaggagggcaag

SEQ ID NO: 68179 - DNA, 1057 bp, Oryza sativa
aaacgaaactattgaacttacaatactcaactactcatttctcaagtgcaatgcaatgcccatgtgcattacacatttacacaagcagtaacatagtcaatctataaatagaaccctgtccaatgtctacgagcgaacagtttgaaacggaacaaggatgatcaggcgagaaggtggtcgtgcagccacccccgcatcagcgcgaacgcgtcctcggcgtcgccgtcgtcctccagcgactgcggccggtgcgcgaacccgtgccccctgccggcgtacacggcggccctggcgcccctcgcgcgtgcctccagcgcccgcaccgtctccaccccgcacagcgggtcgccgtcgccgcacacgaacagcacgggcgcggcgagccgcggcgccagcgacgcgtccatcctggacccgtagaagcagacccccgcgctgtaggcgccgccgccgccgccgccgtcgcgcgccagcgtctccaccagccggccgcccccgtagcagaacccgattatcccgagcttcctcgacacccccgccgccgtgaactcgtccaccagccagttcgtgcacgcgtcgatgtcgcccgacacccgctccggcgcgtgcccggcgagccacgcgtcgaagccgtccttctccgccttcttccacgggctcccccggaacaagtccggcacaagaacactgcgtgcaacgatcgagcaacgagagttgaaagaagcgagagagagagagaggcggcgcggcgtgatttacttgtagccgtggcacgcgacgcggtaggcgaagtcccgggtggcggagtcctcgaagccgaagacgttggagaggaggagcacgccggtgccgttgttgttcttgacggccttgaggaggtaggcgcggacgccgtcgcccttcgtcgacgtcgccaccgatgacgaggtccgcgcagttcaccatctcgcacgcctcgtcgttgtcaacgctcgacacctcggtccggccgctgcggcgcctggatacgtcctcccagattccgcggcaaggtccctgcacgggagctgggaaaccg

SEQ ID NO: 68180 - DNA, 1126 bp, Oryza sativa
tgcggaaccgggggtggcgcaacaggtatagcattgcaataaccagcagaacctggaatggtgtcacatacagcacaatggcaacaaccagggacaagaatatgaagatggcggtggcccgagggtctctccagctaagcaaagcatgggctctctcaccttgtgtcgccaggtcaccaacgactgtctgcacacgacctccaacactccttagtctatcgtagcgcattcttacaatgtccgctggcctgctgctagggaatgaatcaaactcctcatcaagctcatctgggtttgtaaactcagcatggcatagcttagtgtccatgtaaggtggatgccttggcttgtaacggtagttccataatccaatcatgaacatgtagaggaagatggtaggcaggatgagctctgggtagcagatcagtattagaaacaacatatgcaccaacacggttgtaattgggtttcgccagcttctgatgccatcataccacttggccgtcgctgcaaaaccacagaacagcgaggtgatacggtagaagttggccttgctgcggcggagactgaacatgtgcgatcccacatcgagcatgtactccacaacctccctgcgaagtggaggctcggcacggctaagcctcgccgcgacaatctgcattgcctggtgcctcaggtaatccaactgcatcactgagattggctgtgtgtagtgcatctttggcagcaatggacggccatacagcgcaatcatgttcacccatgccgtacatgtaaatcgcacagccaaatgcaactctccagtcttcttaaggccactgggcttgagagccaacaaagggtagaaatgggtgtacaccctgtcagtctccagggtagagagccggattctcaccttgccgatactctcatcccgggcatcgccattcttgccaatctggttattgtcaaacaccaccactgtaatcaccgtgcaaggatcaaacacctcccaagtatactgctcattccactgaggattcagagtgttgagaatggttctcgtgcgcacccacttcggtccatacttggcaacacagtaagcatcggtggtgcgcccatctttcccctccattggtatcaagtt

SEQ ID NO: 68181 - DNA, 1173 bp, Oryza sativa
gcggagcggaaggcgaggacaaagcgtgtggattccccgcgcatttgcgccgccgcggggggagggctgggaaatgctccggattccaccgtacggcccacaccgcagtgacgaggagggaaaggaaaacggcgagattgctaccttcccacgggtttgggccgtgtggagagcacacctggcctcgtcgcggtgtgggcctgatcctacagtatctttggttgcgtgacctgacgcgctgaagtgaagtcagctttgtcctgaccgctccaagggaaaccgagatggacgcagattcagtgacattaccccatgagatatcgtcctcgtaaaaccacaatgctataaacaacatccggatgaaaattacggagttgtttggttggcataatcatattgtcaaagtttgctatacttcatttagctaacatgcctaacatgttgccaatgaaattaaagccacacttcagccatagaagagtaagcttgccacacttttacgtgccaatgacatgtgagacccacatcatcgtgaaggaatcttgccacaagtgtggcacgaaccaaacagatatggctgggcacatttagaccgaaccgacccgaaaaaaccgagatcaaaaaattcgtttacctgttcggtcctagtcatcgaaagaccgaatttatttcggtcaattcagttattgggctcggttaactgaattaaccgaaaatgaccgaaattttggcgcaacaagcgaagcccaataagcccaatagttatctaaccatagaagaagtggagaggcgcacagcattccccatcctctcggcctcggcctccaccatgctcggcctcggcctccagccctccactgctccggcgtcgtctcgccttcgtcctccaccgtgccggcgccacctccgccctccaccgcgcgggcatccatcgcctcgggggcacatctgatggtgcctcctccaccccaacggcaacgagtggcgccaaagccgatttaggatgagtatatgacagcgaagaaagctaatctgggtttttatgaaatttcttcatgtgtatgattttttgggatgagtatatgacagcgaagaaagccgatctaggatttttatgaaatttcttcatgtgtatgattttttggatgagtatatgacagcggggctgcagga

SEQ ID NO: 68182 - DNA, 1549 bp, Oryza sativa
aatgtatctgtatcaaataagatgaatcaagcaacacagtgtaagaagatggcatttggaagtatgatgacatgaaaattcaattgcctgtcatgccaacctgaaaagggtctctgcagacttggctgcggtgcaaaagatgatcttgctcttggtgcgttgtgtgaggaacggactcaccattttgttagccgcaatgtaccaccatggcacgttgatgaaaatctgcatgtcatccacaattcagttcattcaattctacaaacatttgaaaggtcactccaatatcaccacaaatgtacccttgcgtgtcatttctaaacctaggagcaaaaggaggaaggggttgaagggaaaagatccctatcttgattgcacatttgcacaaccatatctagtctagttatcgcaagacaggcactagtcaacttccacccattaatcgtccaatcatactgatcagaaagaaacatcaacagcatatacagctaaagatcctactagtatctttaaccaaagtacgtacattgagaaaactgatcaggtacaaacataaaaaccttcaagtattgagcaaagtgattctaattttgcgctgataatgatgaaacaattcaggaatgtaaagattgagaagttatagagaattaaccttcttggcgatgaactcggggtagttgtcctggagcagggcgagcgcctggcgggtgacggtgcggtgcttgccgagcatgggcggcgagttcttgaggtcggtgacctgcaccatggagcagatgccgctgggggagaagtcgagctggtcgaggatgccgcgctcgaggagctggatgcgccacttcaggactcgctcccgcttctcctcgtcgccgaaggccttctcgtagaggtccttgtcctggaactcgccgtagacgttgtagcagacggggtggccctcgcggtcggcgccgcggtagaacaccacgttctcgagctccggcaggccgaggtcggcggccaggacggcgtcgatgccgaagcgcttgcgccacagcaccgccgccttgagcatcgccatggcctccttcaccttgaactccctggcgcggaggaacttgagcagcacggtgtccgtgcgctcgtcgtcgccggtcagcggcacgccccatatcagctcctccttcggcgccgcagcctcggcttccgcggccgcggccggggcggcgacgacgacggtctcctcgatggcctccaccgtcttgctggtgccttcatcctcggtgaccacgacggtcttctcctccgtttccggctcggccggcttggcctcctccgccgccgcctccgccttgggctcctcggccgcagccgccgccgccgccttgggctcctcctccttggcgggctcctcggtcttgggctcctcggtcttgggctcctccgtggcggcggcctcagcctcagcctcggcctcggccttgggctcctcggcggcgggggcctcggcggccttgggttcctcctccttggccggctcctccgccttggccggtgggggctgcaggaa

SEQ ID NO: 68183 - DNA, 984 bp, Oryza sativa
tatataatgaagagcaataaataaatccaataacataagcaacatgcctgtacaaaattgctcgagagaggagattgagatcaacttccaacgaaaaaatggctttcctaacttgatgctatgataactcggcattttacacataaactcacttgttcaaacatgtgtcaagttgcaaatgatatctgaaccatcctagggctgcaaatatatatagggctctcatatattatacatcaaatcccggcatggcaaattgtaaggcaaatgtctccacctgattccggagttcaataatgtcattattgttctccagacctttcagaaaatccttctgaagccttccatgctccttcaaaacaatacttgctatatgtgctgccctcaaaaggaattctgccattatctcaaagtcactctccaagcaacctctagttgtcatggcaggagttcctgcagcatggtgatgagcacaaaagaaatctactgttatgtacatgtcataaaacagcattgaatgatcaaccagtgtaaggagaactaaccaatccgcacacctccaggagaaatcgaaccattatctccatatattggtgttttattaagagagatatgacatgcctcacagaccttctcaaagttcttccctgtgcatattttaaggagcatggctaggttagaattatggagacaagcaaatacgcactccccctaccccaggcagcaggttcttttcagcttatttaccggattattgccacagattactttctccatgtttctaaaaatatgttttctcaacaaaaaaaaaagttcctgcaataatccatggattactgcattgtttagactatttgttctaagctactccctctgtcccaaaataagttcagttttcatctttcccatacataccaatacaaaaccaaaaagactagaatacctccactttatcaaatctcaatacaattgggctgcaggaat

SEQ ID NO: 68184 - DNA, 1824 bp, Oryza sativa
aaattagtaaattcgattcaaatttcggattcaagtcgaaatttgagagtttgaatgtattcttttggtcgagagggcccagtactagccttaccagtgcagtcttcccttggagtcaccgacgtcaggatccattccaactttcaggagatcctcaaggaagctgctgttcccggtggctgccaccgtcagcagattgcacggtatgttgccgtggtcgtactcgccggcggcgtcctccccgagcaagtcctccaccttcatgtcgtgcatctcgatctgatgctgcacaccacaaaccacacatctcagttcagtagtttgctcggaatccaatccatggatgagtctgatcaccgtgggacgacggtgtacatttgtgtaactaaaactttttttcttctaatatattaatgtgtattcgtacaattcttttgcgtgttcgtgaaaaaaaaaagacgacggtgtacatgttcaccgaccttgaggaagttcttgatgatgacgacgctgtcctcgggcttgctctgcatggcctccttgagcgcggcctggcgcaggcgcagcagctggcacagcgtccgcgtccgcagcgtgaagctctgcgggcggtcgctgagcgcgctcacctcgccgaacacgcccctcgtccccagcgtcgccaccacccgctcctcggcttcgccgtcggagtagatcacctccacctcgccggacaccacgatgtagacgtcgtccggcgcctcgttctgcacgatcacgtcctccttcggcggtatgtactccggcttcatcttcgtaacctacacacgaattaaatccatcctcattgttgtttgtctaatcttcttctcttcgggggtgtttagatcagggtgtaaaattttgatgtgtcacatcggttgttatatagggtgttgcatggggtgtttgggcactaacaaaaaaaataattacagtatccgtcattaaactgcgagataaatttattaagcctaattaatccgtcattagcgcatgtttactgtagcaccacattgtcaaatcatggagtaattaggattaaaagattcgtctcgcaaagtaattgcaatctgtgcgattaattttttttaacctatatttgatacttcatgcaggtgtttaaacgttcaatgtgatatggtgtaaaattttgaggtgggatctaaacagatccattgtttgtctgaataaaattgagtatggttaatgtgtgtggttaccatgagaaggagcacttctcttgagacacccttgaagaggtagacgtccttgacgacggggaggaagaggtactcgcagatgcccttgcagatggatttggggagctgatccatcagctgctgctggttcaggctctctgccctgaacttgaggcacatgtaggccagtatctgctgcttcagcctaggcggcaggtggttccggcccacgaaattggaggcagcacgaatgctgttcctctacaagttaaaaaaaaagagtaattaaactggtcggtacatgcaactcaacaaacacatgcaggttagtaataagaattcttacgaattccatggtacggcgggtgccctcaacgacgaggttggtcatgttgccgatgaggtaggcggtgaggccgaggttgaagagcatgtagaagatgttgaagatcatctcgacggtgttctgggcgtgcatgtcgccgtagccgacggtggtcatggtggtgatggaccagtagacggaggaggtgtagcggatccacaggctcgcctcctggaagtccgggatcaccgcgccgatccacgtcttctccctgtg

SEQ ID NO: 68185 - DNA, 1383 bp, Oryza sativa
attcctgcagcccatccctcctccctcctcgagctctctcgccggtgggttgccaccgttgatgaccatagcggctgagcatggaggccaagcaccaccacaccaacggcatagagggcgagtgttggtggaaactcccctcactcatttcttctgtcgtggccatcgccaccaccatgccactcgttgtgccgtggaggaagatgaaggcagggtggccgtgggcatcggcggggagttgaggagggaggagggaaggccagcgagctcaccatgccgctcgtcctccatgtgaggtgcgtagctgccatggatattagcctccgtcttgttggcctctagacccctccaatatcgccggccaccactgcatctgtggaaggagagcaaagaaggggggagaagacgtcgttggccacgtctggttgggtaagggttgaaagggaaggaggtgctacccactgcatcttgtggcgataggcagggtgaaagaggtaaggagtatttcgactagtgctcagtctccatggtagtctgcgatggtagcagcggtggccgtccaacgagggagctcgaggagggaggaaggaaagacgggagggagagaggagaaggggaatgaggcattgtcggccatggcaaaagaagcgagtaggagcgctccagcctccagcgctcccgtcggcctctgtgcttatcgtcagtggtgactgcgggaaggtgacaacaactgcaggaaggcggcaacccggcggtgagggagcttgaggagggaggagggatggctaggagggagaggggagaaggaggcgtcgccacactgccgtccgtggagatagagaggagggttccactatttttgttatcttctggctgactaacatgtgggctccatattttttattttttattttttatattttgcttctagtgccacgtcaccttcaagtatgtagcgcccgttccgtcgtggcgcctagcgggaaaattatctcttaaaaaccctaactgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccggccccctctctccccgggcgctctctctctctctctctctctctctcgcgcgctctcccatctctccccccccgctcggcctcgcccgtacgctgctcgcgcgtgcgagagccgccccgagcgcctctttccccgctcccccgctcagcctcgcccgcacgccgcgcgcgcgtgcgcgtaagccgccg

SEQ ID NO: 68186 - DNA, 1719 bp, Oryza sativa
catgcaccgcgtcccttccccgcccgcgcgcgtgcgtcgcgtgctccctccgcacggtgagccgagccgctgacaagcgggtcccacccgggaccgcgcgtggtgagcccggtccaccggctctctctgtcctccctcccgcgcgcgcgcgagtttgggccgccttgggccggccggcccatttagctcggccagactgctccatttctcttgggccgcgccctagccgtccgagaaaagtctatattccctccctcccttcttttctttttcttttccaaaaaggatttaaataaatactttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttatttttgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttacatttgatccttcctttgttaattgttataccatgtccccttgtaaccacccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccaggtgtacggtttcccgctctcgcacttaaggaccgattcccttggaatttcatccaaacataagacaagtacgaccacatgggtggaatgggacacccctggctgagtaactagcttccacgccttccctctggccactcagacgccaggtacccttgtccgtacaacgagtctcagccagcgctgactcgcatggtcgagctttcggaggctcaggccactcagcacgacctactccttgaggcttaccgctcccttgcccgccgctacgccgctttggaggcctgtctagccgaggagggtgtcacctcagttgacactatctcttgggactcaggccgcctctgccacgccagccacctgtcctcccacagctcccgcggctctgccctcactcccagtggcccgcgctcccccagctcgcgtgcgccgtactcaccagtgtactccccctacccacacccagttagcccttcctacacccccggacacaccccagttgcttcctcccgccgtggcccacgctttatccgcaccgcgcggaagcgtgttgttggttcttccaacgtgttccgtttccactacccagctcccccaccgccagcggcccgtgctgctgctggccctcgacaggttccgccggtcccttcgcgtcagccgatcgacgtttcttcgactgaggagccgactacaggaggcagccaggccgacgaggagtagaggaggcagtcttcagcagccgtccgtgtgataggcccttttgttccgccaccaactcttttggagtcgtggcgaggtagtgcgt

SEQ ID NO: 68187 - DNA, 1842 bp, Oryza sativa
ttcaaaacatgccatttgcaaactctatgaatagtttcaggccaaaccgctttgatcgccacctccatttgatgacagttatctaaaaaagaagttcacaaccattcgagattaaaaacagaagacatatcattaaacacaccactgatccatccaaataaacatatacctgttaaaattgctgcaggcctattcccatgcattgcatcagtaaatgtttggaaaagccacttgaatgcttcgattgtctcctccctcaacaaagcgcaaccaaaaattgctgtttgaaaatggttatttacatcgacaaaaatcccaaatggcatgttatacctattagtctgatatgtagtatcaaaagtgattgcatccccaaaatggtcaaaacttaatctggaaagagaatgacaccaaaatatatttttaatccttgaagcaccatcaatctgtatggtgtaaaagaaattcttactgcggcattgcatttccctaaaaaaattcagtgtcttctgcacatcattgctacactcatcccttttgatggcatacgccattcttgtcacagccctccttgtaaagggggttaaggacggcccggcgtgcatacctgaaagtaatccatacatagctgtaggtgtcatcccattatctaccatttcctttatgttcctctttgtcccttcatcaatgaaattatgagaccggaagtgtttagtatgctgcaggtcccgtttcatttcatggttgtgctcactaacgaatgcagaaactctccacttttgactttcagaagaacgatttaacctgaccatagccttgcagcctatcctggtcggcggaccagtgacggaattatctctaccctgcataaattacaggaacaccttactacgtaaaacctatgaaatgatgatcctacgcatcacactatagaaccttgccaatcttacaagaatacgaaaccatggttttcaaaaaaaaaaaaagaatacactaaagatttttacctcgcgaatgcagcagaactcttgcatggacttcacgcctccatctttgtatctgttcttggatctccttataccaaaaccagtgaacctagcgtacagattgtagaacgcatagccatcagagtcctcattgaaggtctgcccaattttcggcaacagaatggctgggtcagagagtgaaataggcagcagatcactatcttcctccccctcaaccacgatcctaggatcaaaaaaatgagaattcagctaacaatgcagaaagggaaattgtacactacaatcacactgacataaaaaatacctttccaacggaactacgtccatgggttgtccactatgatcctcgccacctttctccggccagccttcttcctccatagctatcttcgcgaatattgtttctgtccagcacggattctggtagctacccctttcggcaaacagaatttgctatagggcgtcattttttccagctggttggatatatactgacaaataattccggtttattttccattagctgttcaacaacctccccgaaaatcaaggctcctacgtgcgaagcatgttattggactccggaaagtcagccactagcaacattaacgaattctgatgaaaccataccgccacaaaaatagcatctataacaaacattccgagtacgcaacgctacactcacagaaaccaattcgaaatctctgctccattcttgtacaatattctgctcgaagaacttcatcttggtgaaggattgcattcacgatgacaacagggagtttgcagtacacacaacttaaatagataaatgaaaggataacatctcaatttt

SEQ ID NO: 68188 - DNA, 1870 bp, Oryza sativa
cttatcgcgattagctagctagaagagagttagctaggcgccatggagctaggcgtgccactgccacgacggcccgtgcccggtagctacggcgtgccgttcgtctcggcggtgcgcgaccgcctcgatttctactacttgcaggggcaggacaagtacttcgagtcgcgcgccgagaggtacggctccaccgtcgtccgcatcaacgtcccgcctggcccattcatggcgcgcgacccccgcgtggtggcgctcctcgacgccaagagcttccccgtcctcttcgacgtcgccaaggtcgagaagcgggacgtgttcaccggcacgttcatgccgtccacctccctcaccggcggctaccgcgtctgcgcctacctcgacccgtccgagcccaaccacgccaagatcaagcagctgctcctctccctcctggtctctcgcaaggacgccttcgtcccggtcttccgctccaacttcggcgcgctcctcgacaccgtcgagtcgcagctcgcgagcggcggcggcaagtccgacttcaccgccctcaacgatgccacctccttcgagttcatcggcgaggcgtacttcggcgtgcgtccctccgcgtcgagctccctcggcaccggcgggccgaccaaggccgccctgtggctcctatggcagctcgccccgctcaccacgctcggcctgcccatgatcatcgaggatccgctcctccacacgctgccgctgccacccttcctcatcagctccgactacaaggcgctgtacgcgtacttcgccgccgcggcgtcgcaggcgctcgacgccgccgagggccttggcctgtcgcgggaggaggcctgccacaacctgctgttcgcgacggtgttcaacagctacggcggcttcaagctgctgctcccgcagatcctgtcgcgcgtcgcgcaggccggcgagaagctccacgagaggctcgccgcggagatacggagcgcggtggccgacgccggcggcaacgtgacgctggccgctctggagaagatggagctgaccaggtcggtggtgtgggaggcgctgcggctggacccgccggtcaggttccagtacgggcgcgccaaggccgacctggagatcgagagccacgacgcgtcgttcgcgatcaagaagggggagatgctgttcggctaccagccgtgcgccaccagggacccgcgggtgttcggcgccacggcgagggagttcgtcggcgaccggttcgtcggcgaggaggggaggaagctgctgcaatacgtgtactggtcgaatgggcgagagacggagaaccctagcgttgacaacaagcagtgccccggcaagaacctggtggtgctcgtcggaaggctgttgctcgtcgagctcttcctccggtacgacaccttcaccgccgaggccggcaaaaaggtggtcatcaccggggtcaccaaagcttcaacctccgccgtcaatcgtactgcttaagccggccatcacttcaggcgtgggtcgtcgatcatccactcaaccagctccgtcctacgcatatgcaataagaaatactcgtacctgaattcttgcatggctaaacactactaataagtgtatgtattctgtttatttgttcgattccatatttgtaattttgttgttattgtttgctgttgaattacgattgtgtattttacagggctgacagtgtctttaaacacctctaatatgtatcggatcaatctgccctagtcatgtctaatttgtgaagatccactttctttaattattcaatcatgcatttttttttcttctttgtcgtcgtccttcccccacgtacatagcacttcatatctcttagaataaaacaagtaatctttacctg

SEQ ID NO: 68189 - DNA, 4202 bp, Oryza sativa
atggtaccgacgagaccgtagtcgagttggttcaactagatctcccagcgacttggctcctgtaggctccgacttcgtagctgtgatggatgtattggcggtgagattcgatgccttatgtcctgcccagggggtcccttttataccgcgggtcagttgatctccaagtaggactcggagatatcggacccctcacgatatggtaacgacccagtctcgtccgagtaggactcctcccatatgtggattctgtttctatcacgtgatagatttccttaacgtgtacaggaactatccgtatacgcgcgggtataccatatcagtatacaacgtatatccaaggatagagggtataccttatccgtaacactgacataatgtactcacaatgtttcactatgtatagattcaatgttgcagtgaattgaaacattcttttgcaacaaaatcacccacatattatggaaaccctctattaaggaaattcgttttattttttttctaccaaaaatgtttcacctagtgtattcgtgatgtttcactatgtatggattaaatgttgcagtgaattgaaacattatttcgctatttgctgaaacattgtttttatataaggtgacacccgatcttaaacgattgaaacattttcgatctacttagtgaaaaaattccaatacacttggtacaacagcgtgcaacatttaaaaatagttcaataataagctaattttttttcatcagaatatatccatgtgtggtctaattttaacgatttaattgcaacaaatttaatggtacaatcgaatcatgatttggataaataatttaaaagaaaaaaaagtttaaagtggttttgcatgcatgcatgctgacgtcagctgacgtgggcgcctgatttttttacacccggatcaggcgcccgacacctagtcccttcctaatttgatatatattgtacatattactattttataaactttattcaatttaagaaatttgacttatgataaaaaccagaaatatcttattttattggaggagtactacatttgtcacgtgaaatcaaaggctctgattctttaattttatttttgttaagtagtcgtgaggcttcggtatattgggcttctgtatcttccagttgaattaattaatggttggttaattcagtactccacaaagacagcatatatagctatacgtatatagaccagctgttcttcagtcctcatctagaattttctgccatgcatatatatggaacttaatcatccgacgtgcgtgaagtcagtcatctatataataatctacagtagaaacgttgccgccgcgcgccgccgcttggcagccggcgagtacgtcaccaagtcatcatcaccaaccaccgaagcgtgacgccgcgcctgtccggcgtaagatacgtgcaggtacgccagtagtgactgatatggtttcaactttagtacaagcttagatcggtagtacgtccaggactgaacggtatctctcacctctcacccggatcggacttttcccggctgaccagtgaccagaaatgtcaactaaactaatcgcatgcagaaaaggagggttgaagtgagcagatttactacgatagcatggtaatttaattcgtactatcttctattttgtccatttcgaaacataacgtattgtatatgcaaaggcgttctaatttgaaaacattctcaccgcgtccccactaatgcaccctccatactatacatagtagctcagatgtgtgtttgaacagttcaattcaaactcatcacgcatctttgttaactggtgtcacgccccgaactagtaccgaccggaactagcccgtgacgctccaaattaacctgttgatcgataccagtcccaggaaacagtgctggtatcacagggagacagaatatcacagcaacaacggtctctttattatagagtacggatacagtcatgttgggctacggacagatcccgagctcacaactgcattacaaaagggaaacggaagcaggacttggaccaaacaacacaggcgcgacttgggaactaggccgaaaccctaaaactcatcgtagccggcttgctcctgaaagaactcctcatcagcaggatccgcttcatcttcttcagcaactgggggggatttatttatatagagcaagggtgagtacgggagtactcagcaagccaagggaaaatagatgtttaatgcaggcttcaaggaaaggctgttgtttttgcaattgattttagttgaacacttttctaaaaacaactaagtgagtgcttctcaaacgacacggctgagacggtgcgtctcgtccggtcggagtatgtgcatgtatcagtctttaaaatttaaaacaaggttggcacccggccaacagcttttcaaacggacacccgggccaacaactttcaaacggccacccgggcctagctgatcccatcagccgcagatttttcaaacagcgaacccctttccataacagcaatttcacaagcagtagtcaaataaaactacgctaggaatcacctcacatccgcccatgaccgtgggcacgactgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggtgaatccacatgtctctcgacatcaaggctcccctgataagctagttactcagccaggggtgtcccattccacccatgtggtcgtacttgtcttatgtttggatgaaattccaaggaatcggtccttaagtgcgagagcgggaaaaaccatacacccggtacgttccccggtccgcggttttggaaattcatttagttcgcaagcgccgacccaggtgtcgggttttccaagtcttttgtaaaactccagttttacccaagttgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacatattaagtgcgatcctattaatgcataatattttgcaagcaacataattaaatttcaagtataggctcaagatgttcaaaggtggcttgccttgctaaaggtctggagcttgatcctcgaaatcctcgcactgcgggtcttcgggctccggaactacacgcgaaacgggacaactcaacaaacggcgaaaatgaagccctaataatgacctcaaagcgtgccattagatagatctcgagatttgagaaattttggaagttgaacggagtcaaacggatttatggttgggaaggtattgaatttctaagattattggatttttggtctaaaggaaaaggatttaattaaatcctttttggaaaagaaaagaaaagagggagggaaaatagacttttctcgggcggctagggcgcggcccaagagaattggggcggtccggccgagctaaatgggccggccagcccaagacggtcgcgcgcgtgggagggaggagagagagccggtggaccgggctcaccgcgcgcggtcccgggtgggacccgcttgtcagcggctcggctcaccgtgcggagggagtacgcggcgcacgcgcgcgggcgggggagggacgcggtgcacgcgcatggtctgcggaggaacggatgcggcgggcccacgcgcagcctcacggctcgcggtggaacgcgcgcacgggaggggctgaccggggtcggcccgtcccaacctcggctgagctggcgccgacgtggcgcctacgtggctgccacgtgggctggcgagaggtagacgacgacgccggccggaacggacggcggacaacagcggcgagcggcggagcgaaccatggcgataccggcgaaaacgagcacaccgggtggttgcacgagacgaggggagacgagcccacggctcggattcgccggaggaagcttgacggcggca

SEQ ID NO: 68190 - DNA, 1188 bp, Oryza sativa
ccgggggaggggagggggcgagagagagagagagagagggagagcgggagcgcgccgggggagaggagagggccgggggagaggagaagataggccgagagaaattcggcccatcgaccctgggagaggcaaaatagacttttacggaggaattgatttggaaagggtttggattcgggattgaactcgacgatagatcggggatttgagatctgagatggcacggacactagacaacaagcaaagaaacaaatttcgcaattagggtttttaagagataattttcccgctaggcgccacgacggaactccagggttaagcgtgcttggcctggagcaatttgggatgggtgaccgaccgggaaattcttcccgggtgcacacgagtgaggacaaagtgtgcagaaaagacatgtgttggtctgtgagggcagtctatgacctatgaaagctatcagatgtaagtggacccggcctgggggaaggcggacgttacaaaatggtatcagagccgactctcgcggtttcacaggcgcgtgtgtcgcagttgcgcaggcatggtgcgcatggctggtgtagaccgggagtggttacacagcatggcacatgcgctggcactggacacatgacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccaggggggtgcacacgagtgaagacaaagtgtgcagaaaagacatgtgttggtctgtgagggcagtctatgacctatgaaagctatcagatgtaagtggacccggcctgggggaaggcgggacgttacaactagcaagccgaactttcgacaaacaatgcatgttaatgttggcgtcgaaaatcgctagacgcatttaggatgtatttgaggaggaggggattgagaagattgggaagatacacaaaacgaggtgggccattagcgcataattaattgagtattaactattttaaattacaaaaattctttactatgatttttttaaagtaattttcagatagaattttttacaaaaaacgcaccgtttagtagtttagggggctgcaggaat

SEQ ID NO: 68191 - DNA, 2079 bp, Oryza sativa
attcctgcagcccatagaaacgcaagagctagagctagagttaggcatatccataagatcatcacaagaggtagaaatgctagatgatgcaacatgagcaatatggcaagtagcactatcatcaagcaaatcacaagatatgccaacatcaatgagagctccatgttgagtagtggaaaggaggttgtcatgagcttccttaagcttctcatgagaaatggtaagtctctcatgagaagtctttagctcctcatacaaaacctccaaagaagcatgatccttctttagggtcttgaacttgataatctccttctcactataagcatggagctcctcaaacatactcacaagctcatcataggaaacatcatcacaatcatcatcactctcactatcactaagagatgttaccttagaggggctctttgccatgagacaaagtggagcgaagagtgatggtgcctccttgatggcaacaacggccatcttcttcttcttggagcttgcatcatcaccaccttcttcctcggacccggatgaggcagagctctcctcatttgagtctcattccccgatgaaggcctcaatcttcttctttttcttcttgagcttcttcatgagcttgtagcctccactcttcttcttggatgacttgtctccatcatcatccttggaagggcacttggaagcaaagtgtcccttctcaccacactcaaagcacctcaagttggagagagtcttgttgggtcttctatttcttctcctattggagttggagccccttcctctctcctttctccttcccaagagatcattgaaccttctagcaagaaggacaatctcttcctccaagtccttattgacttcattcaccttgctcttgctcttgtcttcaacttcggcttggagagcaatgcacttcttggaaggtgaggcttcctccatctccttcttcttcaacttgtacatgtcattggtgttgatcttccccaagaggcttgcgggtgtcattcttgacatgtcggagttgatgagcatggtgacaagggtctcatacttctccggtagagccctaagcatcttttgggcaacctcaagattggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtactctcatggatctccgccaacttgttccaaatctcatatgcggtctcaaggttgctcactctatcgaactcctcttggctcaaagagttgaacaagacattcatggcttgggcattgagtttgaggttgcggtgatcaatctccgtcaagggtgtgccggtgatagcaaagcctacatccacaatactccaaatatggaagctcatagctttgaggtgagtagacattttaattttccaagtggaatagtttgtgccattaaacatgggagccttccctacatggttcacctcgttcgacatcttctctctaggcggtgaagcccaatcaagagagaccaagctttgataccacttgtaggattgagatgtcgactagaggggagggtgaataggcgatttaaaactaaataacacctaatcaaaactaacctaagttgctaggcttggtgagggtgaactctaactaagcaactaagttatgttttgcaaacctagggtgatagtggctcaattatatctctaggaaagtaaatcacactcctatgtcaaagttttgcaatcctagggtgaaatgatctcaagtatgtctctagaaatgtaaattgcacaaatgtaaatgcgacaatcaaatgagacaaggagacaagagatttttcaccgaggtttggaaactcgccggtttcctactccccgttgaggcgagcccaactccaccgctcaaccacgaagccaccgcacgccccctttgtcaaggggtgggcaaggcgggagccggcccacggagaggactacccaagcctcgatcactagggtagttcttccttcact

SEQ ID NO: 68192 - DNA, 2726 bp, Oryza sativa
ctcccacccccaaaaataagccgtgggggcgaaatcccccaaatttgtgttctgccggtctgacataaggtatgtggccggtcagaccgtgctactctgcaccgactagaaaactagccgttgtagccctgtcagagggccctatcggcctggtcggtcagaccgatatggggtggccggtcagaccggcctcggctcggtcagaccgccatcggctcggtctgaccgaatacggctccatcagctctgtatcggccatcccgagcagcaccatcccggcctccagggggccggtttgaccgcgcatgtgccgccggtcagactgtccttatgcgccggtcagaccaccttcttgcggccggtcggaccggccagggcacgccggtcagaccgccactatgtggccggtctgaccgcccctggtcaggccgaacctagtgaagtgtgtgtgtgtgtgtgtgaaatgtgagcacaagtctaaatgcataatgacctaatgtggcaattaaaatcatctctttgctaggtcattacccctcttaatagtacggcgaaactaaaaataaactagcaaatttgatcgccctacacctcgatcaattctaaattaaagcgctagttttatcgtcttctttccctttgctttgcgccgtcaattttaatccatcgataatcatccatgcgcacatatgacgtggacctaacttaaaatgtatagctcaaagacaacggttagtccacaattagcacttgtcattaattatcaaaattaacaccgggggcctagatgcttcaccaccaataaactaaacagttacatgcatatatttatcgattgcatttcttgactcctttcctttcacctaccctttcacctcactatttatatgcctctccacaatggcatgtcttagccatcgtataggatcataacagattctttgtgaaaccagtggatgcaatggctgtgatctcttcaaattactgatggttttcttgatgtcttatgctgtcaatgctatgctacagtcattccttcaaggtttgtggtgtgttcctttcctcggcctacaatttaaattattatttttgttttacttataaatattcacgttagtattttctttctttctcatgtgttctttgtttatctgttttcgctcaccgtgatgatctgaagttcttccctttttctactgcttatatggacattgatcctgttgatgttgctttatggcaatgagcaactaagctccctatacgaccactatttttctatgatattcattcatacagcaatgattcttgaagtttattctcgggtactaactaaaatttacttgctatttcatagcaggcctatatctttgtatgcatcggaatgatgcatgtcagcacaattaagtcaatcttcctttccaacgacctgactcagttgaagcaagcatcagaaaatgcgtaactccaatctttctatttattattgaatttttgtaatttttttaatagttacaaggtgtatttaaatcacaacaatcaagtgtacccgacgcttgaagtaatggataaatttacaatagtgctaatgtaggtatacaactggctagatatatgttgcgtctaaagttttcttttatcatataaaagtgtcgcggtaacgcgcgggttactcactagtttcatacatttgagtgttcggctttgtaattgtaatggagatgccattgatagaacccgaacaactgtctaattagctcaagaggtggctccacacacatagcatggtatttcaatcggcggagttatagatagatagtatgtttttttttcatcaatttcaaaatatggtataatctgtggtaaacttccaaaaccagtttcatcggttagagtgcattttaccaagtgtgttgtgtgtcagctgaactaacacattataacggttgctggtggtgtttgagacggatgaagatgtaaagtaagggcatgcaaaacgagtaaaccattagggcatgattaattggttttaattattgcaaatttgagaaatatatttatttgatattttaaagtaaattttatatagaaatactggaaaatttagaccaatccattgtcgtatagtgcagaacaaataaattgcactgtacacatatgtcacttgtccattgtcgtctagtccggttaggatacctggctttcacccaggcgacccgggttcaaatcccggcaatggaattttttttctattttttctatttgtctatttttctatgtttcttttaggggatctacatgtctttatgataagttagcagacttaactcaaaactatacgggacctgcagaacttcttgacaaatcgcacataactcccaagttagcaaattagctcaaactaatcaacactttatttagtggttttccgtgagcatacgagaactaacttgttactgttagtgtgacaactcacaggtcacaggattcgcagcatgttcacggttcaccaatgaattatatccacattaagtaaacaaactgtccaaagaaaagaaacaaaaaatcaaaccgagcggtgaacacaactacacaaggggacatgatctgatacactaatacactacctgagcaataatacgcacgaggcaggagtgttgtctgtaaaaagtgaggcatcaataggtgtagtataactattttatcacgaaaggtgaaaaagactatct

SEQ ID NO: 68193 - DNA, 1843 bp, Oryza sativa
  unsure (1)..(1843): unsure at all n locations
attcctgcagcccccctgtccatggcatcttcttcctgcaaatatttttatgggtcagaaactcagaatggcaacttttagcaccaataataaatgtcctaattaagtctagcctagttagatatagtccaccattagtggtaatcacgtacatcctcttcctcagcctcttcagcatgctcaaagaaacttctgatactttcaccctttgtaattgtcacaaaaccattccctaccaccagtctgtggtgtacgcacgattggccctttaaggcatgtgctttaacgcacagctctgtgtaggtcccatcaagcttccaagctctcaaagttatgaaatagtcttcaaactgatcaagattaataccatctctgtggacttgtacattcatcccaacatcttcaaagccgaaaacatcagattgcccttcatctgtcccaatggcccattcaaaatgatgataagatccatctgcctctgataaagtttggcgccaatcaattatgacagcatcctcaaacacctagaaaatagagaagccacatgtaacttgaatataactcagaagctattgaattgaagttagaatagtgaagtgggcatcgaggaggcaccctgacctcacactggaaatcagtgtctgcaacacagaaccaactggtgcagcgaggttcccttcgcatgcgtttcagttccttcagttccttgaattcacggataacattccttcggcaatctcgacagaatctcttgctctcaaacctattgacanntttgtattaagaaaaaaaanntaaaatcaatcctacactgatcaattgtcagttgctggataatacaaacaaatagatgcattattggcaaaaaaaaaaatccctacatatctaggtagatcatagatagctatcagtatatgaaaaagaaaatagcaggcccttattgtatttgcatcagatagctatgatcgttaatagaattcactgaatatctgcaagtcagttatgaactcactagttcaactatgttactaataatgtccatgagctgaatgcctattcaggtcaaaacaacttgttatcactaatttaaatttgcatgatatggaggtcaacttcattatgctcacctacgcataagtctttccatgaaatcctcctccttcatccgcagaagagataatctagtttcttcactcaatgctgaccagaaatccaccagtgtatcacatgaaaggcgagcagtatgcagagcacatgtttctcttgttccataccccctgctataactagctaggcgttggctaatccatcctctgccactgccaccacatgcatcaggataaagcatctctctttccctttctcttgcccgtgcattatcaaatacctgattaaaccaatgttgaatgcattaaggtataagctaatcaagtaaacctatcctgtactagcattgaaacttctaggttaacttaactccacaaacatgacttggaggttgcttaagaaaaagtaacagaagggatcaatataaaaatcagagcaaattagttattaattgtacaatcgccaatgaactacacaaaaagagacatgaatcccaagttgaaaacttacattctgaagcacccgcaatgattttgcatttacaaagcagtcaagaagcgtaaggatgccatcttttgttgctacaaggcctccccaaggatgaactgatgggtcttcttgttccccttgcctaatccttgtttctccagttgtgttcagacgattaatatccgaggcatcacgctgcagtgtcttcccatacatgactatttgcatgaaactttccagaagcaat

SEQ ID NO: 68194 - DNA, 9023 bp, Oryza sativa
aacaaaatatctgtgtgccaaaatggggaaagaagttcaaatatcgttatgtcttatttagcagttactcttcaatcaaattatatttacaactatactagtttatcagcttgctccaatggaagaaaataaataacaggatgagaattgaacaaatatgcaaggcatgaaatttatgattgaagagtgtgtacaatatgcatagtttgttgataaggtcagaaactcgtaaaaacttaatagagttagaaagaaaaaaaacattctacacgagccaatggcttgctttcctaaaattattctgacagaattttattttcctaacaagaacattttcatacatcagatttcatcagcataacagcacttacaggctactcaaataatcatgaacgacctaaaaccagtccccaacttttttacttcatttcaaatcaagtgccccatgctcttgcaaaacgaggaatgactgattcaattccaaaattcatacaggaagtaatcggtaacactattttgccccccacgtttatataccaaaccaggcgtacaaatctacctgccaccatagcttagagcaatgtaccgccagaatcagctcaaagccagtacaatcgagcctatcagaagtcaaaattaggatatatgcccatgaccaagtgcaacccgattgaatctaagcatgaaaattcaccactcaaatggactcacaagcttagataaaacaaaaacagatcaaccaaacaacctagctttccccgacgccatttgcagacaactcttctgcgaattacgcacaaacaaaaaacgctaatccaacccacacgcaagcaactgtctcagtccgatcctcggataacaccaccatcgattcaccccgaattcccaccgctcacatcaaacccagccccccgaccagaccaaagtcgttgcccacgcgagcctaccttctggaggcgatccaacgtgatctcgtcccgccgccgcgaccagatccccgatcccgacgccgacgccaccgccgtctccgccgccacacccggcatcacgcccctcaagcctcccgcagacgccctcaacacaacgacgagctcgcccccgatccaccgcccatccaagtggccgccgccagcgacgacgcagccggaggtgacccgccgcttcgccgcagcttggccccgggtccgatcggccgccgccggtggctagccgagtgggttttggctcagacggcgagcgagatgggaggaggggagcggagcgccgaggcgagacgaggcgaggcgaggcgaggtgtgggggtaaaaggcgaggagaaggggaggagaaggggagggatgaaatgggggagggaacgcgacgacgccgtacgctttttaaccgccacggttaggccccgcggtgcgagctgcgatgtctggaacatgggtttctagctgtttcgggatttttagcgggattttccgctgtaaaaatcagtttaaccgaggcggcggttcgctaatttggtgtcaaatgctgtcgcgtgacgttttcctcgggtggctgtctttgttttcttctttttttttattttagttttatttatttccttttgtgggatgatttctttttggtatttggtatggtgtgtgcgagtagctagtactatcttgactatatatcggagctatttttcttgtatgtttttaattaaaccgtatggttggtatgtctagttggtctaatatataaatgagatgagttactatattgttttcatttctattttaagcatgtcgctttgaggatgagatggtgatgatgaaacaacactctattcaaattcggtcattcagagttgaatttaagattaaatcaccctttagttgccttctgcaaaataaacaattcactcccaaaatcctaaaactcattaaaaactaaacaacggtttttcgtctattcatggggaagacaccaactgaaaataaccagatttactgaaaagacaccaaccaaaatagccaagcagagcccaaaaactttctgctctggactttttcaggcaattacataaaaaagcagaaggatggaaaggactgagaaaagatccacgaaaaactcaaaagggaaagctaaggacagcagatcgatgccagagggcaagcaaaaggcgaagctttctggatcgcgtgctgccgatggggtgcgcaaagccccggcgctcactgccctcgggccccacctggcagttttctactactcgcgttggacggcgaaaatgaaaaattccaatcgggcacacagaactacagcaaaaacgtatggttgctaaaaatgcgatgaacttgcgagctgtacacacaaacgatcatcgatttgtcccttcctcggcatgtacgtacaagctaagcaattaaagtatacttttccacgattcgacactaactcacgaccacatccacatgccagatacattgggtccggaaaacagcagccctgagcaccgaaaacaaaagcagataagaagagagaaaaaaaaaaagaagaactgttccaagagacgcaagaaaatcgttgagccatcacccatcatgccacgggagcggtcgccgctcggtgcgcgcgatgcatcgcacctggcggaccagcgatgggccggtggatgcaccgtgggcgcatgccaccagcgcaccgtgcgcgtgcgcggaagctgtgcacgacggagaggggggcagtggatggggtggggtggggaatgccatcgtgtcgtcatcgcctcgccgtgggagggcgacgttatgtccccatgtgcgagatccggggaccgggggggacatatggagacgacgatgatgacaccgtttcataagcagcgcgacacgatgtgtgtgcagcgcagccggtgatggatggattgatggcctgatgctatactgtacgcctgtccggtcgtgcaagtgctgcttaatcggagaacaggaaaccagtgacgtacgtgggtaccgtatccactgttgctgcaaacccaaagaggatataattttgtcacgtgttgatctgaccttgtgaagatgataaatagggactactaagctgtgtttagtttcaaaatatttattcaaacttctatttttttcatcatatcaaaactttcctacgcacataaacttacaacttttccgtcacattgtcccaatttcaatcaatcttccaactttagcgtgatctaaacacagtctactccctccgtcgtgtccaactttgactgtccgtcttatatgaaatttttttataatttgtattttcattattgttagatgataaagcatgattaatattttatgcttgacttatctttttaattttttttcataatttttttaaacaagacggacggtcaaatattgaagacggaaactagggtttgtccttttttttacggtgtgagtagtcgttaatcttagaacttcctttgaaattattggccgttgatgtaaatccttaaagttacaccatgcagtttactggaaaactctagatttcattattcctactataaaactgtgaattgtgactcactgtgtttctatataactgtgaatttgtgactcgctaatgatgtaaaggagctttcatgtaaagccacaacagtacgaacatgtggcggttagttttgcgtctacgaaagtcaccacatatactttcgaagattgaaccaatatatcttagttttgataaaattgtcttgaagactggattagtatatcttaagagagattgacgatatcatcacaagtgcattcgaagactgttccgatatatcttgagattaacatagtaaccataaacatcccgctgtctatgccacctataaataaaaatataattagcattaactctgagcacttatgttaagttaagaactttcaaaatgacaggttacatcataaaaaatctaactgactaagctacgatgagtttgtacatgggtgtcagatttttcccaaactagctaaatacctgtgcttggctacaaataaaaatgaattatacatgtgctattgtttggaacaagttaattgtaaagtttatggaacaatttcgtccctgattcatgtagatgtctttccatgatgataattgataaactgaaattgtagagatgaaataaaatattaacaatatgtagaaggaccgttttgtaaaattaaaatactggaagatgttgtttgttatattgagttgggaactcacttcctccatacggaaaacggagcaacgcattttcttatgattaattaagtatttacttttttttggggaaaaattgattaatatgaatttttaaagcaactttcatatataaacctttttgcaaaaaaaacgtaccgtttagtagttcgaaaaatgtgcgcgcgagacagagggaagagaagttgggaattcagagcaaagaacacagccgtagtatacaacagagttagtgggtgatagattcactgtcaccactattaccttttttaaaggagtaaagatgttcttagatagtactagtaggagtgtagccccgtgctgctaggtgctaaacctattaaaccaggcccggtcctgtcaatttaatggcttggagcggtgctaaaaagataggcctttaatacaactctgataatataatgatgtttctaacaaatgtaatgtataaaaaaaaattcttatcaaacaagctatatatctttcctctcgtgggcttcctagatcttaagttcctatggcctataggctcctatttccatagcatatatatatatatatggggttgggtcctttgacttcgagggctcattacgatggcacagctcgacccccctaggccaggcctgattaagaccgtcccatgcttaactatttttttctacattagagtcagaactaactaatgtgattcttcggtattattgatttctactcctccgccaaaaaaatgaatttaggattggatatgacatattctagtacaacgaatctggatagaggtatgtccagattcatagtactaggatgtgtcacatccagtactagattggttttttataaacgaatgaatttctaaaacatttatcaataaaaaaatgtctaagaaatcaaatgtatcttgctactttttttttcaagtacatacttcctccgtttcataatgtaagttattctatcattgtccacattcatatagatgttaatgaatttagacacacatatatgtttagattcatcaatatctatatgaatatggacaatgctagaaagtcttacattataaaacggagggagtatttatttttttatgaataagctagtaaaaggtaaatatgtataaaaatgtgtttaatgagaatttcatacgtttgttttttcttgcgaaacaatgttgattatattatatatataagagacgattgttacataaacaaagacattaaaccaaaccaaacttctccacatcttaaaacgtcgcaactgatacgagcatacgatgtagaacatccatcgcgccaagccagcctcccgccgctggtcgtgcctcctcgcaccaagccggcctccaccgccacccggtcgcacctcctcgtgtcgtgccggcctccactgccactagacgtgcctctacgcgccgaacctcgacgctgcacaaaagcagcagaacactttttagctcacgtcgccctccccatgggcgacacgagaggtgatgccaccactgacttcctccttccctcctccttctctgcctcgccactgcctgagcgggtgccggcaaagccacgcggccgcaaggacgacgacggcagggctttgcccagcgtacgctcggacaacccggggagctggccgggctgcggcgttggcaatctgcgccgttccggctagatccggcgggacgacggttggcggcagggcaaagtggtggcggcgccgtctagcgatgggtggtgaaggcgttcgttgttgacggcggaaacccctgcccagatccacgggttgagtgatcgtgatggcggcggcgggacctcctggcgcgtgcggccgggagcgggtacggagccgaaccggcgcggaggacgacgacgacgtcagcggcacgacgcgggccgccccccgcagcgagcccggcgcgttggcaggcggtggtgggtgtgggcgacggcagggaggccctcgcccggaagccggcgcagacgatggctgaaggccgtcgtggtgagcccaacaacggcagtggtccgccggtgagttgcacgacgcggtggtttgttggacggccacgggcggctagtcgggggggggggggcatggcagacggccacatttggctggtgcggcagcggggggaggagtgctcggaggccagcacgtcatttgtcatcgtccagatatcaagtggtaccaactttacgacgtaggtgaggcatgaagtggtactttcccttttactcacatgtatcatcagatacctacatgtatagcagcccccttcacttaaacatgtcatctttcatgtaattattaatggtgaagttgagggaatcgggccgaattctccgaaactttcatacatgtccggaacttcaatccatggtacatggagtatatcagagggtgtcaacgtcttcacggggaggtgagtagatcagattggattcgacgcactagcacacaaaatatcacctaacatggcattactccagacagatctgatcgactgaataataattatactaccaggtataggccagtgcgcgattccatctactaaaattcagcatttcagccaataatgcgtggcttacagacagtcccacggccgtactacggactgcaatggtacaaccactagtgacaaagggtacaactgcagaagaatcatcctacaatcctaatagaagtacttgcactgtgaagaaatttcaaaagaatttcaaattcaataaatgaaaatatccggtctatcgaagaggctttacgttgtaaatttttactgcttgttgtttgctggatgtttgccgggtgcattgctttgcatccagtttacacctactgggccagttctgttttcctttctcaatttggaaagagtgctgggcctgatgttgggctgaaaaaggcaaaaccacatttgttaaaatgagtttcttttagcacatacaccttgaccttcccagcaatgtagggcacttacacaccattgttaagcaaaccagacaatatttacaactgacctgaatttcagaacaaaaaaattgcttgagatcatccagaacgtgatttcccctttgtgctgaactttcctcacaacaaaactcttaaacagagggatgcacaagttcagtccacataatctctaatataggtacttaactaatacagtattctcttaggcctactttcagaaatgatggccagacaatctcatttgtcttcagccgtttcatatagcataatgcggcacgtactgtagcacatcctgcatggcaagcgaacaagccagctaattcgtttcacggtggaattcaagttggtggtcatggttggctgctaggcaacttgctgagaatgttgtgctctggcttgtggtcacactcgaaatcaaggtgaacaaatgcccgctcgacttctgggagctcctcgatctttatttgaagtgattctccaatagcatgtgcctccttaaggggcaattcctctggcagctcaatgtcaacctgccagtccgttgatcaaattagctgggaagagcatatatatttacctaaaagggaaaaaaacagcaaggcaacagaaaaactgaggtaccaacctcaacaaagtaaagaaccccaaaggtgtatgctcgaactgtatcgacacgcttgatttgaggatgatgtctgatggccaaatatgtcaacttctgcagcatttctggcggagctgattcacccactagtgacactgcatcaaggatagcaataagcatcattaattcagtatacgactatctgccagttaatctagtaagtaactttcagaacacataaggaattgtgcaggaattacacttatatggtgagtcaatttatatattttttttcggaaaaacatgttccctacaatcctgcttcttgcatgggtttagttcatcagatttccatgtccattaggcctatcaaagcaattgatcctaacaagagttctggtatgaaactttttactacgacaacagataatggatgtgggaggggggtaggccaattataaacgaatgcaacagatgctggagtactgcaaacctgcattttcccacaccgttccagaccagtttgtaattgtgtacactgcaagggcaattgcaccaactgggtcaatccaccagtagaacatatcaccaaggacagcagcagccaaacccacaacattcgtgacgacgtcaaaataatgatcctgtgaataccaacccaacaaactttgggaaactgcactcatttgcctttcaaagcatctattgaaattaaaacatggagaaagatctaaaccttagcataggcacggactatcttgttaccagatgttctgcagtagagccagagggctagcttaactactgttgcaaaaatcatgatagaatatagccatgtgagctgcactggagtcaatttatctggagtctcgttcactatcagcttttccacagcttgaacaaatacttggaatcctggaaatgcaaataaaaagcacattgctgtgttaatgcataattttggcacaaagaccatactaagttgagtaataaattttgtagtttgaagacaacaatactgttgcatatacaaagaaagcaagtaaagacatgaattgattgtccattcttgtcctggcaaagttgcaagcatacctaatgtagccattacagcagcaaagatgatgattccaacaggctgcaccctcagtttaccaataggatacttgtagacgttgatgctcttcatcgagagatgtgtgaacca

SEQ ID NO: 68195 - DNA, 5504 bp, Oryza sativa
caagtcataagcaaacaagaaaaaatgtagaccaccataaatgtgcactgagtgtgttcaataaaatgcttcctgtcttctgaaatttattttacacgcacaatatatcgctatgagcatctctaacagaccgggctgacatatcttaagatgacgaagtcaacaccaacgtctcgttgttgatgggtacattgcctaacactaagataattgcaaatgcaagtatctgtattaagtctatggcttaaattcgggtgttttagttccaccgtaagaaagctagccgattgagttaagttcacttcgtaaattcatctttgtatacgtgatgattttttatttgtattttagaaattgacgtaatgatcgtctagatctgtgcatggagtgtgcaagacggcaaatgcatcttaaaaaaaatacatactcctctagcttcgtcttaaaatatgatataacaacaaaaaaaattagatgggatattatctaatactacgtattcatatcaggaaggagttacctaaatacctaatgcaacatgctgtatttgaacaagagaattcgcccagtggaaatcaaagcaattattaactaattattgtgaaattcaagtgttttaaattgtgcccaatgttcaattttgttaaagatgttagtgatatgctctagaggcaatcatagaaatgattgtatcacatactatgtttacatatttatccgacattgttccttgaaatagataactctttattagttaatgaatatgtgattctttcataagactctttatgttgtttgttactatttctaaaggatccctgatcaaatatcatatatggaacaaatatgtttatatgatcagcacatgtattaattgataatcatgtctcatggatcatggtatagagataccaaattaataatgtggacacatgttggtgaatatgttgttggatagacccaacatgagacactgcaagagccatatgtgttgtgtcatcagtgatctcattgagtgttggtgttgaatccttagatctgagattatcatggttctcaacatgtgtagtagcttacttagggactgctaaacactactccgtaattgggtagttataaaagtagttttcgggtatgctatgaaacatgtagtgggatataaataatcaagataggatttgcccctccaattgagagatatctctgggcccctcgatgttgtagattatggaagtgcatggccatgccaaaggtgattgaggagtcaatcacaagttatataatctatcaacaggttcgagtgaatgattgagctattagaggatggcacatatctagccttaagcttaatcgatatcgtgaggcaaaggggttcatacaagtatacactagaggttcagccgatatgatctttatgtatgcccggtgggtcaatacgttctgctagggggccgctgttgacgcgtggaccgaaaatgagttttcaggttatagccgagtatatatgaacctacagggtcgcacgtttaatgggccggaataaggggattggatagagatccaatatgagcttaattcggatagagaccgaataggagtcctacgggccttggaggcccgagtgatggatcctatatattcatgaggggtgtgaccggcggaggcatagcatcacgtgagaaaccctagccatcacttccctccccaagcaaaaccctaaccgcgcgcgggtgctagcacatctgcgcgtggcgttccgtccctgtacgtgtggataccggtagaggcgccgctgatttgcggtgttgatcggcgtgagagtacggcgaggagaacacacgaggaggagaaggtcgagccggtgcgatcgactacttcctctatatcgacgcgcgctacttcgcgagagttccttcgacttctcagcgtcttcttccgctgcacagcgcgtcgagtggtaacgatctataatctaatacttgcatggttcctcgtttacgcgatagaaaattttgttttatgctatcgtagtctacgcgtatcccaacaaaagattctagacgaaaaaaagcatagattgggtataattattatgttaaagtttcttcctatgtactataatttggaactgggtgagtatatgctgagaggcaaactgtacatgattggtctcctttggagtaaagaaaaagtatagcaaatttggaggatcgaattccttggaaataattatcatatggttctttggatcaaggaatggctctttcaaatttctttgaaaattctatgaaatggatcatttcatagaaatgttggaggatggtttctcttgtttgagtcgtagaattcctacattctttcatacggtgttaccaaacaacatgttttgcagactgcacatatccggttggatatatagaccgagtaaaaaaaataccattcttttaaaaaattaacttgttttgctaattcctgtggatttctatgtagggtttatcaatactcggcatatgattcataccctttttttttctatttctatatttttaaaatcttacgtataatcctacgttctaaagaagtccttagttactaaccatgtatactactctatctgtttcatgttataaaacgttttgactttggttaaaattaaattgttttaactttgatcaagtttataaagaaaagtagtaacatttttaatccaagacaaatttattatgaaaatatatttaattattgatttgatgaaactaatttaatattataaatattatatatttatttataaatttactcaaacttaaaacagtttgactttgacaataaccaaaacgtcttattaggacatgaagcgggggagtaggcaatagctgataattccaatttgatgggtggggtacacagccacatcttaccaaagctcagttctcgcgccagcactatgatctgaaccgcacatctcatgatcggtggtctagccctctgtgcacaccactctcacatgcgaaatagtccccttctattttcccctttttcttatcttattattacaaaatcccttttaagagggcgtcccagccgcaccgcagtccgcacgtccgcagcacgccacggtagcgcgacacccggccttccgcccgaacgccaaaaataacaaacaaaccacgacccgatcgcgaatcgcagggagaggagacagggagagaagagagagagagagagagagagagcggaggagagaggcggctcgccggctcgagctcgactgctccccactcgcggccgggagggagggagggggagagaaaggagagaggtgattcgatggaggcgaagggggagaatgacgcgcgggcgccgctcctggcggagcggcggcgcaactcggtcgggtcgatgcgcggggagttcgtgtcgcggctgcccaagaaggtgctcgacgccgtcgaccccgagaggccgtcccacgtcgacttctcccgctccaagggcctccgcgaaggtaccacgctggacagccctccccgcattacttctttgtaaagcgcgttctgatctttcccccgttttcgatctgtcctttgtccttttaggtttggctgtggcaacgttgcatgaaagttgtgattctttttaggctctcctttttgttagtcatcacttgggtgttggtgagtttgtctttggggtttggctgtagtagcttttcagaattacggtggataatgccgttcttgctggtgatcgcgcggtcgatgttgttgtatggatggaaatcgccttctattcttgattcaccatccacttgcgcgtgcttggtagttgtgtgtcgtcctttggtataccgtttgacggtgacggatcaagttcgtgggtttactatcttttggttcgcatttttacggtcttttcatatggttttagcgattgtaacatattgaatgactcctaatagaatgacacgcagatctccttctggttctaaagaataacaggtggcgatttatcccgactataatgttttcatgcatgctcctaggcaaaggtcattcgttatatgttctttaaaaaatgctaagcagctatcaattgtgtacgaaaaatctttcaggacaatgttatttctttcttgctctgatgctctctctaacggacatgctcttttttttttagccaaagggggaagaagagtacatagttcaagagatacaaccaatataaagaaaaggcggtagcttgggtagggggagggctatctcgcagcccatctagagttcttttttttaaaaaaaaaatctaaattgctagaaaggaaactgttgtcgaagttaaaggaattacacatcaaggagaacatctccgtttgatctttctgtctcctctgcatttcttctttgtccaggagaaccaggacttccactgttccacagtctatttcctccaccagaacagtactttttctccggtcctggtcaacgtaatacaaaacatgggtataccggcctttgtttacctgaaattttagctgtgccttttttaattctgcctgcctgccgtcaattcattttagcactatatacttccctttccaactttggtctttatgtcttttgaaattgtagcttagatactaaaacacgtcaagactaaattacagtttgtcaaaccgaggtgatatgtagattatacaaaaaccagccggcgttggctgttaataccaatatatttgtaaggatgttctgcatctaccagtggaaatttttgacttctctaccaatagcatgtactaaaaatttggttacgagatttcattggttgtacatttaattattgtattgccattttgttccctgtctctttctttaaaataagtgaggtgggtgggatgtattttatttatttttaatccacgatttgatgtaaccctgcctagctgtatcaggattgtgagactgtcaattgtcgctaagtggaaaaacatacacctttacttttcataaacgactacaaactgtgttaaaaatggtgggatgaaaacacttaatgcaaatattacgaaataagtaatactctttgtatcagggagagaaatatagaagtataatgtggtgtttactctttagtatttcttatgcagtaagttctcagttgtatgaatcaccacatatctttcttgtactgacattaagtatagagataagatttgcaaatcctggactataataaactagtttttattgttcctatattcacatcattttttagagtttgttcttattaataattttttcactacaaactcttaatataactgttaagataaggtgtgcccaatgtgttatacggcttattcctaatatttcataaccctggacaaactccccatgatccatatgaagggtaacaccaattaaattctctctttttatatgctcaaaagacactgctttccttcatgtgatatggttaccttttgggctaatataggagagaaagaa

SEQ ID NO: 68196 - DNA, 12639 bp, Oryza sativa
gtctttgagatccatgcacaaaaaatatatagctacgaaaaatccatgcacagatctcaaaatgtgccatgacacaacccaagggcattaagaagtaggatggaatcccattaagtggttaaaatctatctccctcaaatgagatcatgcagccaaagtgttcttcaaagggccaggattaatcagagtttgtcatgcttttcattttttcgtcaaaagctagtaaaacacaacgtgcaacctatattattaggcacagaactgctgccggcttctttggtaatgcccaggtacaactcagaagttctattcaccggatcaacaagatataccataacataggcattataatctatctcaccttcatgttcaatacctgtctttgctttgctattagtctaagtttagttgggcattgatcgatgaaacaaaatacaaacctggtgaagaagagctaggccatgaaattgcacaagtgcaaatcttgattgaacagcttcctgcacttcgttgctccatcttttcacgatttctggatttgcctgcatataataagtacagtttttgacttccgaaaagaattatgttttttttcgtatagaactatagaagtgtacctgaagcagatggatgccactaacaagagcagcactagcaaccacaggattcttatcaactatagcttgtttcaaatatctctcaatttgagtaaggagggtgccatcaattattctacacagaactctgatagcattggcacggtacatatccgtcttgctgttcatatctttcattaatgagcttgtgactatgataacctgttgtgtaaaattcaaacaatttagaatgacaatacaagaaacaagttataattcatggatctaaaaacagtttcctttgacctcatctgatgatggtgaaagctctttgatcattaaatacaccagccgcctaagaccagcatccttggactggaacagctttgttactgcaaagaaaacttctgtggcctcaacctacatcagaagcaaatccatcagggcattgagagcataaggcaagtttggttgcacgagatgtagtatcctacctttgtgaatgtctccccttggttgagtaaatacaatagcttagtgatgacctgagaaattccaagacacatcaaacaaagagcaaagccataataatgaataacaagagggtgaaacatacatctgaacacaatactcagaactgagatgaaaatgagagaggtcatgcaagaaacacttacttgcgagcacttcctggcatcaagctgcggatcatggaaagcccttgcctcctgcagaacggctcccttctcaatccataaaatggcgagtactcaactgtaaaagcatccatgggttaataaacaggtaataacttgaaagcattttactacactgactgaattcaatctaaaaacaagagataggacactctctataaaagatcaaactgcaatatcaaaatgaaatgctctgacgttaaggtaaacaccgcatgtaaccagcttgcattgagcaccaaaaaccttaccatatttggatcatacaaattggccgaacacccatatagactaagggggtgtttagatccaccggcaaatttttttgccccgtcacatcgaacgtttgaacacatgtacggagtattaaatattgataaaaaaaaaactaattacacagtttgcgtgtaaattgcgagacgaatttttcaagcctaattgcgccatgatctgacaatgtggtgctacagtaaacatttgctaatgatggactaattaggcttaataaattcgtctcgcagtttacatgcggattatgtaatttggtttgttattggtctacgtttaatacttcaaatgtgtgtccatatatccgatgtgacccggcaaatttttttgccagtggaactaaacacagcctaaggaacggatctactcctatatgcaaattagacgtgcgaatctccaatggaaagtgaaacgaaatggttccagcacacgggcgcaactgaatctcatctcactattggatcaccaatgggcctagccgactgataattagaggatgaacataaaaaaaaaacgaagtgcgtcggaaccgaacgcctgtgatgcctcagaggagtgatcgagcgcactccagatccaggtaaacccaagctctcccactccaaattctcagggccaaagcacgccaagtcgcaaaacagaaggccactctgaccagcggagagaatcaaacattcaaacaggaagctcgcacaaccaccaccacaaactctcgggggcggacatgcacacgaggtcgagatccaccgcgagatcccgccagatccggcatctccgccgctgggccagcggctcccagatcgcagcgcggccgggagaaagccaacaggaggagaattaggaggggggagaggggactaaccgtcctcgtcgtcgtcatccttcttcatgtacggctgcgccatctccggatcggtgaggtcgccggcgagggagcgaggcatgcgacgctgtggcaggcggcggcaaccaccgaaccggggagcgtggggtggtaggtttttgagggccgtggggtggtgcgtggagggaagcttttcccccttgtcgcgctccggatcctacgaaacggtggcctggccgtgcggtggtggtggtgggggtggcctggccgtggtgggggagctcgggacggacgggacggggaggagctctctttgctcgcgccctttttgcacttgggtccctcggtcgagtcgagactcgagactccagactgtggaggccggtttgttggggttgccacttgccaggtgttgggccagccctgcctgatggaagggacacggccttttggcccaaactgtccagcaccaacctcgacccttttgggaattttgaaggtaggaaaaaggccactttgactcccttaaaagtatgctgaatctaattcataccccttaactagaaaaccaggtaaaatgactcctctaactattaaaaccggtataatttaactccctcgacggttttggatgccagttttgcttatgtggcgctttgacttggtccaattggctgactcagcgtgtgggacccacatgtcaatgtcacattttccttctctctttctttctctttttcccctctttttctcctgcctccgaatgacgccacaaattgtcgtcattcatggatacttgcaaggacatcgtcgctgcccgtctccccgccgcgggaactcggccggtgacagatgctcatgtgcctgtgcgcgacagtccttctcctcacttcttatcacctgctccatccttctctctctttctcttccctttcctctcccccaaggcgaagcgacaccgtggcctcgaggcggagtggtggctggaggtcctgatgcgcggcatcggcctggcctcaagcggagcgactttctatgggagccgtttttgctttatttgctggattttactattgggtgggtaaaatctttggcagacatatcctgaaactttaggataaatccatttttcgattactttattcagggttaatctgacattttttcccatgcatttcttaggacgtcggcccggcgtagagggggatggcggcgggccggcttggagacggggtggtggcgtggcgcgcccagacgccctgcggccgcctagggaggtcatggaacaggtcccctccaccgtcggcagcggctcggctagctcggaccctggccgacacaggagtagcctcgctgcaccgcctcgctccaacacgaaggtggtcctccccgccatcgctgacgaactgcggcgtgtcgaagttcacggacacgccgtcccgagtggtggcactctgtcacaccccgaagtttttctccctagccaaaatttaatttataaacgaccccaagaaaatgcaggtgcaaatcaagagaaaaccctaagaaagtaatgcaaataataatcggatttgatatgtggaatttttcttgagttctacatgtcgaaattcattaacaggatttttagtggaattttcagagctctagaaataattttaaccaattaaaattgagcaagcaatattttaattccagggaaaatcctttttcctttttctttttttctttttctttttcctccctttttcctcctttttttgaatgggccgccggcccattctcttcttcctccccctcctccctccgaggcccatccaggccgccccgccactctcctctcccggggtcgccgacaggtggggcccacctgtcgggtccttcccccacctcccgccgctctcgctcgcgccgccgcgcccgcaaccgccgccgcgcccacgtctccgcctccttcgggccacgtcgaccacgcccgcgcgtgcgccgcgttccctgcgcccactcccctctctcttccgttcgcgcccgcgcccgagatggccgggattcgattttcgaatcccgcctctctctcttcccccactcccccacgtcggccggcgattcccgcctctcccggccacgtccggtcctctctctctccctatttaagcttccccgtcgctccctctcgctttttccccatttcgccgacctctcccgagctccccattgctcccgcgccgtgcaaccacccgccgctgccgtttccgcaactccggccgccgctagccgccgctaggctcgccgccgcaccgcgccgtcgccgccgttgggttcgtgcggcaaggtccacctcgtccacccctcctccgtcgaggttcgccgccggagccccattcccgtcgtgcgtcggtgagtgacgccatggccgccgccttcggccggcgccctcgtcctctcgcacttcctctctccctctaacccctctccttttgttcgttaggaggttccggagctcgtcccgccgtcgccatcgtcctccgtcgcccgccgtcgtcgaccgttgtcggtgaggcctctcctcctcttttttctctctctcccgcaccgtttcgccgtcgcgcgccatggtcgccgggtcggtttgcgccgtgcccgcgcgcaccggccgcgagctcccgccgccgtccgatctacccttgggtagatcggggcagtcggttcggctgtcgcgtggccgccgcgtggcgcgccgctcctccccggtccgtggacccgatccgccgtggaccgccctccccgagccgctgactggtggggcccgcttgccggcgcccttcctccctctcccgagccgctgaccggtggggcccgcttgccggcgccgcccccctccgcgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatggttgtgttccctgtttcagtagtcttatagcctgtttgcaatgtttgctttgtatgtcgctagattccgacccctccgacgctccggtgtacttcgaaatagtcgccgaggttcctccagcagcagagcaaggcaagtcatgcttgtcacttgaacatgttgatcctatattgcaaatgctccattgttttctttcaaatattgcattgttttataatattactatgggatggttacctattgttacagccatgctttttggataccatgctcctttgttagcttggggttataacatgattagagtttggactaggaattgcttagccatgcttagttcaactagttcacaatggggaaaatcatattaatgcttagactgttggttctaatggttttgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcattcaggcaagggtgggcgtgatagagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacgaaaacgtgtcgcggggctgtgtcttgtgggtacagttgtacacctctgatcagagtaaaactattcgaatagccgtgcccgcggttatgggcggtcaaccagattcaccgtgattagtatcaccctagtgtaatcttttgaatttggttagtttaggtggatggttgggcctgtcgcaacgtgggatagcgttggatagtggatgtttaattaattattacaacggtttaatctttcaacttctgtttataaatgctcgctttatgcaaatgaaccgctctagctcttctttgataattccgtgcatcatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagacgtggatctgaatgtcaacattgtcgtttgtgtaccccggctggtcctggacggggaatttaatgcacattctgcttgaaattctattcgggaatttctgggcgtgacacgctcggcgtactccaccaatggcagtggcacgggcgcagccgcacagagaagacgcccacgtgctcctctcgccgtcagtcaccgcccactcccagcgccctgaagaaaaagaggtagaaaaagagggggaaaagataaaagaaagagagttgaggaaaatgtgacattggcatgtgggtcccacatgctgagttagccaattggaccaagtcaaagcgccacatcagcaaaaccggcatccaaaaccgccgagggagttaaattatactggttttaatagttaggggagtcgttttacctggttttctggataaggggtataaattagattcgagatacttttaagggggtcaaagtagactttttccttgtgttaacagtgaaatttggtaagcccggagtaatcatccgcttagagtcagcatcgacttcgaagtcctgagattagccgatgagacttatcacgtcgtcagttgccggattcttgctatattcggttaaggaaattgatctactaaaggaagcttatccagaagagaccgagttcaaagagaatgcgacatagcaagttatctattaattaggaataatttgttagtttccttttatctttaggaaagtgtgtttaatgtcctataaggactttatcttttccttttatttgtagtttcattcttgtccgacaaggactagtatctccctatgggtataaatatgtacacccgaggtcattgtaatctatcaatctctcgatcaatactactctcggcgcatcgccaccctctttaccgaggtttttacttatcatccgacggaacttggcacctagttgcattgtgtttagagacgcatcaatttagttggaatgtctcggttaggtccgatcttctgtcttagccaatatatctctacaatcacaaaggtgttctaaatagatttgttatatccatcacattagacagatctatcggctcatcgagtattagattatcatatacaatctcgtgctgcatcggttaggttcgacctattagattgttgttgataatataagtcttgttaagccgataggttcatgctggtgtttatcggggtgctagccgataagttatctggacgttgcatcggcttacaaggattgcatatacatataagtttgacttagccgatcgcaacaaaggtttcactgtttaatctaatcttgtggattttatgacatcggacctacagccgatgtatgttttaaccgtcggatcagtgcttattctatcatatcattgctagctaattagtttctaatggattatgttattgttatactacattatcatcagccgactgcctttatatcattatttaagtcaagtgtcagactctacattggacataaagccgatagctcagaaacctatcgctatcggctggcatcggttatcggctggtatcggcatcggctggaattatttcatcggcttgtcaaccgatcggctatttgatctactctttacatatcttgtcagttgcagaatcaaactgactagcacgcccgcatctcaccaacctttggatctgcattggagctaagcagatctcaggccagtgtgtgtttttcgcatcaacaccttgaaggtattctggaggaggaggaagttcactttaggtcccttagttcgtcgcccaatctatttttcgtccttgatccaaaaaccggatataatacatccctcaacttatataaccatacaaacgaagtccctcggtagtattgactccagttttaactgacatgatgcctttgactaagtcttcgtcccacgtgacattgacatggcgcttacgtggcagtttgacaaaaaaaataaatggaacaaaattaaagactaaaaaaataaaacaaaatatacgggacccacatgtcagccaaacaaaaaaaataggacccacatgtcagtggttcccacttcttccacctcaccctcttcccctcttttccaatcttcttttgggtgtccatcctccatccttccccgctcctatggcagcggcaagagcaagagggagaggagcgcagcaaggacgccgagcgcgacgggcggcgagagaggagcagtgtgcaacaagcggtgagagtggagcggccgctctccgtggggggggggatggccatcggggagaagggcaatgaccggcgggaaggagctaggcgatgggcgcggtgtcaccgagctcgaccgctgtggggaggtctagggacctccgctcccgcctcgccatcaggcctcctaagctcccgccgcggcgaggctaagcaccaaacccacgacaaccacggggatttgggtcccctcccgtcgatgatggatccaagagccagtcaaagttggatcccctctcgtcgcgtctcctaatgccgccatcggatcccctcctgtcgtcgttgagttccccttttgaaggccgacatcaccattccctctctctgcacagctgcttccccacttctcctgcagacaatggtctccattacaacggaagaggagcaagccggcagtgacctcgtctcccatcaagcggtgccagtgaagataccccccttctccctctctatgcatgctcgctagggatgcaagtgggtagtcctactacccgcataaaaacccgcttgctagtctatttttcgcatgatagtacaaaatttagaagaaaaaatgaactagaagtaggataagcaggaaaaaaaagcctgtttgcctgcccggcttgcatccctaatgctcgccagccgacgagggagcttgaggagagaggaaggatggccgggacacggcacaaagaaacacgtgcagtacgttcgacgcttttcaaccgttccattagggcagtcccaacccatattgtccataagcagtgtctatggtgccatgtcaataagacatcacaatagaaactacactctacaacctatggtttcttaaagtgggccattaataaatataaactacactctacaacctatggtttcttaaagtgggccattaataaatacatcatctctcttctctaccaatcatatttattcttcatctattataaagagactattctctccaaatgcaaaacttgatagtgtctagtgcatgggttctcgtgttgaaactgtgtcttgcatgagacccggtttcttcctctattcactctctctctcttaattaatacagtgtcacataagctaaaagtcctacatgacagtagttaatgccatatataccatcttagatggagagttgggaatgcccttagaaacaagctgactaaacttatgtaagttccttcgaatgtatccttaacttcaaacgaaacctctcttcttccttttctcgattcagtgcaaacctcaccagtagatatatgcaagataagcgcaatatcgcattactcatcgatcggatacatcattaaatcacacgataatacagccaacaaagcagtcacgtcaaacgatcggcctgcaatatgcacgacagtatcccaattcccacatacacggtacgccccggttcccatcgatgattcgccatctcgcaacaccacacagtttccactttccacactcacgcaccgaagaaatagtcaagtctagctcgacgcctccgatcatacggctagcgatgctgttgccgccggggtggctcccccgagtcggcgctggagtgggtcccgtactcgctgctgtcctcgatgctgctctcgaaggccaccttcctcaacctgttgatgtcggaagcgtagttgccggagtcgtactccgaccccgtgctgaacatcatgctctgcccgggcttcaccccttcgttcaggtcgtccagcgacgcgtcgccctccagcgcacggacaatctgcaatacacgcaaagaagaaaaaatatcatatattgccaggcaaccaggtgatcgatgatcagtttgatcactgtgagctgtgcggtttcaattacctgcttcatctttgggcggcgcttggcggagtggcggacggcggcggcagcgcatgcggccatgcgctccatctccagccggtcgaacttgttctccaggcgctggtcgatcagctcgtcgaaactgccgtcctccgacaaggcgcgcgccaggaggggcctcgcctgtcacgaccaagcgatcgagtggccggcgtgtcagaaccacgtatgtaagcttaggatgtagtagtggtagtttgcgatggaggcgagggtgacgctcacccagtcaaccaagctgtcctccatgtagttcgttgggtcgaccggtcgccggccggtgatcagctcgagcagcatgacgccgaaggagaagacgtccgatttgtccgtcagcttgccgctcgacgcgtactcgggagccagatacctacacacatgtaactgggactcgtcatccgtgcccgctcgtccgtcatgcatgtcaacgagcgagccacggtctcatgttgcactaacccgaaagtccccatgacgcgcgttgagacatgcgtgttggtgtccgtggttagctttgcaagcccgaaatccgcaacctaatgcaaatgaattcaaacaagtcaggactagctagttcaatcttaaacgcagcttaaacaagctggtgtgttcaccttagcatcgaaattctcgtccaagaggatgttggccgccttgatgtcacggtggatgatcctaggatggccttcgtacgtgacaaccacaatgcaacaaatcagatcgttagaaggacgtacagacaggatttgtccctgcagactgcaaattaaacgaaaagtttattagggaccttacaatcttcgtgaaggtacgcgaggcccttggctgagccgagcgcgatggcgagcctcgtcgtccaggccatcaccggcacgcccttccctgcacgcatccggcacacgcgcgtgtcagaatcgaacaaaaatctcacgtacgaatggcgcgttacgatggctgggaaaagagcaggaaagatatggagaccgtggaggtggtgctcaagggtgtcgttggggacgaactcgtagacgaggaggcgctgggatgagccggcgatgcagtagccgacgagggagacgaggtggcggtggtggacacggctgatgatctccacctcggcctggaactcgcgctcgccctgcccgctcccggccttgagctgcttcaccgccacctccttgccgctgcccgcgaggacgcccctgtacacgtacccgaacccgccctgccccagcaggttcgccgacgagaacccgcccgtcgccagcgccagctcgtcgtacgagaaggagctcttcgagaaccccagcgccatgcccggtgacggcggcggcagcggccccgccccgtgcgacccgctcatctcgctgctcggcggcgcctggcctggcgagtactgcgcgtgccagccgccgccttggtccacgctgttctgccacctgggcatgctgttcgcgtagtacactttccctgcatgcacgcggacgcgggagcgcaccccatgtcaactgcacaagatctctctgcggcatgcgtggcgagcgcaccatgccgtcgcgtcgcgtgtagatgtgtgcttaccgttctcgtcggtgtagtacggcatgtgcatgtggggaggtctcttcttcttcttgg

SEQ ID NO: 68197 - DNA, 1126 bp, Oryza sativa
agacatgctagcgcctccgcctgggccgaagaaccgcattgatgcaaggttttgtggccagcaagaagcaccaaccccttcagtctctgaatataaatccgacgcttgcatccccagactcttctctgtaaccagcgtcaacattcagtttagcgaaatattccggcggcgcacaccatctgtcagcctgtctgttcatacttgtagttggaacttttttattatgttccatatacatagggcccttccctttgtgatcatcttcccgttgtcggatcggctacaattgattttcatagcttaccaggaagctagccgagtcagctattgatgcatttcctttaccatggatcacgtcatttcgcagatgccaggctctccaaagtaaatacatctgccttcgctgaagtactgagactgtccagcagtactaacagccaatcagggcccgtccatgaaaaactccaaaaaaaaaaggagtttatgtatattaccatgcaaatgctttgtgccatgtagatttcttttctttcttttaataaagagccagtaatagaaattaaatgaattttgtatcagtaaaaaaaaacagtgactgaatcttcggtcattaacagtcagcagttgtcaaataacaaataacttatgcccatataagaaaacagcatcgaaactggtgtactgaacactatcgttccatgcatctttgtgtaacgtcagacaggacagggaaatttcatacaagtaaaaacaagagcataaggatagattttgctcaaaagtagccagtatcccattaaataaagagcccgataatacaatgtagcagcagctcaattagaatcgaagcaaataaagtatttcactcacatatctaaaccagaaagaaatggacatccaatgaagaaacgtatgcaaattactcagttccagggttaaccagtaatgtttggagcattggacaatgcatgcactgtccgtgttcgaaactcatacagaaacaattatagcacatcacccaactatacaagtgactcagataacatactattcaaacaactgttccgaatcagctatttcacttccaggagttcctgccgaagatttaacaaccgtctgggctgca

SEQ ID NO: 68198 - DNA, 9888 bp, Oryza sativa
ttcctgcagcccgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcatgagaatttggatgatgtaggtgatgaaggcttgatgagagctatgaagaacatgtcaattggagatgtcaagcctattgaagtggaagacaagccatccacctccactcaagatgagccatctacttccgctacgccaagtcaagctcaagttgaagtggaggaggagaaggcacaagatctacctatgccaccaaggatacacaccgctctttccaaggatcacccaattgaccaagtgttgggtgacattagtaagggtgttcaaactcgatctcgtgtcgcttcgatctgtgaacattactcgtttgtttcttgtcttgagccaaaacatgtagatgaagctctttgtgatccggattggataaatgctatgcataaagagctcaacaactttgcaagaaataaggtgtggactttggttgaaagacttagagaccacaatgtcatagggacaaagtgggtctttagaaacaaacaagatgagaacgggttggtggtgagaaacaaggcaagatttgtggcgcaaggtttcacacaagttgaaggtttggactttggtgaaacttttgcccccgtgacaagacttgaggctatttgcatccttcttgcatttgcatcatgctttaatataaaactatttcaaatggatgtgaaaagtgcttttctaaatggtgaaattgccgaacttgtctttgttgaacaacctcccggttttgaagatcctaaatatcctaaccatgtttataaactctcaaaagctctttatggtttaaaacaagctcctagagcttggtatgaaaggttgagagattttcttttgtcaaaggatttcaaaattggaaaagttgacaccacccttttcacaaaaatcattggtgatgatttctttgtgtgtcaaatttatgttgatgacatcatattcggttgtactaatgaggtattttgcaaggaatttggtgatatgatgtctagggaatttgagatgtccatgattggagagttgagcttcttccatggacttcaaatcaagcaactcaaggatgggacgtttggcttggaggatgcgaagcccatcaagacacctatggcaaccaacgggcatctcgaccttgatgagggaggtaaaccggtagatttaaaactttatcgttccatgattggtagcttgctttaccttactgcatctaggccggatatcatgtttagtgtttgcatgtgtgcacggtttcaagccgctcctaaggagtgtcacttagtggccgtgaaaaggattctaagatatttaaagcattcctcaactattggcttgtggtacccaaaaggtgctaaatttaagcttgttggctattccgattcggattatgccggttgcaaagtggatagaaagagcacatccggtagttgccaaatgcttggtagatcccttgtgtcatggtcatccaagaaacaaaacttcgtagccctctttatcgccgaggcggaatatgtttcggcgggtagttgttgtgcccaattgctttggatgaaacaaatcttgttggactatggcatatccttcactaaaaccccactcctatgtgaaaatgatagtgccataaagatagccaacaacccggtccaacattctagaaccaagcatattgacattcgccatcacttcctaagagaccatgttgccaagtgtgacatagtcattagccacataagaaccgaggaccaactagccgacatctttaccaagcctcttgatgaaacccgcttttgcaagttgaggaatgagttaaatgtcatatatttctctaatgtggcttgagatggtgcaccatggttgcttcctttgcatattgtatatttgctcctatttgctcttatgctttggatttattgccatttggttcttcattgcgaaaatggagcatatcacattaagggggagttttgcactcttgcatgtgctctacttccttttatatgtaagcaaatcaactagtggtgctagtagtattttcaaaatgcccaagtcaacataagtcaaaacttttgcaaaatcaatgtaatttgaaaactatctcttggaaaatgtttcacaaggttccctatatgttttccaactctcactttgtaagaaaaatgatttttgaatgaaaatgccattttggccttcttttgaagaatctagaatcttgtttttggtcaaaatgagattaaaccccaaaatgagattgagaaggaatttgagaaaagtttcaaaacaaagttggtagtgaagaagatttgaaatgtttttggtattcaaatcatattcaaaaaccaaatatttcaaaagttgtttgaaaatcaaattcgcccaaaaacccctatagaccataaatggtcacctcctagcactcaagtgagttttgttgcaaatcttcataaatttcaaatattatgaatggttggcaatatttcaactcacacatttcaaaattgctccaaaaattaaatttttgttgaattttattgtgtgggggtagccgaactgtgcaagggctgtgcacagttggctgggggccaggcggtctgaccggcgctatatgcgcggtctgaccggtctggtggcgacggtggcccggtcagaccggccgcaccccggcagtctgaccggccgtgtatagccggtctgaccggccggggatggtgggcccgggaatcttcccttttcttctctcttcttcccctacccgactccatctcctcccattcatccttcttctccaactcgaaatttcttctcatatctcctctcccaaaccctagtcacctccctccaccaaatccatccggttcaaccgtcaaaatcactccgattacaccgtaagtgattctcctccgcttcctctctctattccatggattgatttgagtttttattgagtttgtgatccatggcatggaaccctaggtgaaggaagaggtgttcttcaatttgcaccaatagagggtagtttcttggtgtgattcaactccttcaaccggtaaatcactctctctctcttgtgcattgctctcaaatcggtctattttaatctctagggttaagggtagtttcccccattgcttcaatctctatgaaatagacctacaccttgatgttcatgttccaatcttgtgcaactttgtcctagcaatttttagaatcatttgtgtggattgtggaatgattcggttgtgctactgtcagcggcggtctgaccggccgtgagacgccggtctgaccggcccatggccgtcggtctgaccggctttggctctcggtctgaccgcccctgacaggcagcacccccattccttactcttcactatgtggcttctaaaattgttgcttatccatcctttgctccttgtttttcagctatgcctccccgcactcgccatggtcatcgtgagcccacgcccaatcccatcagtgagaatgaggaataaagcggagatgagtatgttcaaagtgaagatgaaaatatggaaaatgttcagggtgatgagatggaaggaagtgatgatggtgatgacaatgggagtggcaatggtgaagatgatgaggcaagtgatgatgggagtcctctcgattccaccatccaatttgtgcttaatttgaggaatgctcaaaaatacactatcctccgtcatcatcatcaattctagaggcctaacgattgtaatgatccaagatttcatacacggttccaaaagtccgtgtatgaacaagtgtatgccaacaaagccttcgccgaacacaagtggatttcttggaggcacattggtgagacaccggagtttgaagatttgcaagagatgttccggaccgttgggattgatagaattgtcaccatgaagcaaccttttgatgaagatctcatccggcaattctatgccaccgtatgagtgtccggcgattgtgatgcaatgaagtggatgtcggggacccttcgatgctctatcaaccgccgtgaattcaaggagctcttgcacatccgcttcaacaacggggatgaccttcatgatgagcacacccacaaccccttctccattgatcacttttctcagttttatgaagaagggggaaggcacacatatggaaaggtggcgggtttgagggctctcccaagtgtgatcaaccgtatagtaagggccaccatcctcccaagatgcggcaacaatgatgacatacgcggagttgcttggcatgtcattgatgccattttggatggtcgtcggtttgatgttatcaaccttataatgaaggagattgccatctcaaaggggactattgaacaaggaatctattatgctccctacataatgaggttgattcaaagcaagttgggacaaattggtcacaatttaaaagaacataaggagtacaagcctcgtctccaactctccactcctagagctccttgtgtgcgccaaccaacttttgatcaaggtgcaagctcaagtgcagcccctcctcctcctcatgggtatgatccaagtgattttttccatccacaatatgcttattttggaatgcaacccaacgagtacttcaacccggtacttggggctattaataccctgagtgaaagcattcaacgcttgtctaccgggcatgaagctttgcatgaggatgttcgtggcttgcgcaccgatgttggcaacttgaatacttcggtgggaagattgcatactagggtgggtgtcttggattctcgagtccaaactttgaagagtacccaagcatttgtgtatcatcgtcgtcgtgatgctcatcatccttccacttcggcgcgtcctccttctccaccacaagaatgaagacctttttggtacttgatgccaaaaggggggaaaaagtgtgttcctatgtctcgtgggttgggactagtagtagtgaggttagtcacctcatatctaataggttaaggaggtttgggctatattatgtatgggtatgggctattactctatattgtgtgttccttttcgttttgttgatctctatgtcatttggacccttcgtggtcttgtaatagcctatatttatttgtgagccctttatgtggtcttaatgtgaacttgtgctatgatggatggttggtgtgacattgatatacttgtgaccatcttatgcattcggttgattcatatgtgaagttcacattataatttgtctatgtgttgtgctatgttgatttgtgaaattgaattgtgcattggctccatatttgctatttgtgattgttatgcacatgtttagggggagcttttgcttgtcaatgcaatatatgtccatgtgctctatgtttgattatatatatttgtggtgtttatcatcaattaccaaaaatggggagattgaagcatctaggcccccggtgttaattttggtaattaatgacaagcgctaattgtggactaaccattgtctttgagctatacattttaagttaggtccacgtcatatgtgcgcatggatgattatcgatggattaaaattgacggcgcaaagcaaagggaaagaaaacggtaaaactagcgctttaatttagaattgatcgaggtgtagggcgatcaaatttgctagtttatttttagtttcgccgtactattaaaaggggtaatgacctagcaaagagatgattttaattgccacattaggtcattatacatttagacttgtgctcacatttcacacacacacacttcactaggttcggcttgaccaggggtggtcagaccggccacatagtggcgatctgactggcgtgccctggccggtctgaccggccgcaagaaggcggtctgaccaacgcataaggccggtctgaccggcggcacatgcgcggtcagaccggccccctggaggccgggatggtgctgctcgggatggccgatacagagccgacggagccgtattcggtcagaccgagccgatggcggtttgaccggccaccccatgtcggtctgaccgaccaggctgatggggccctctgacagggctacaacggctagttttctagccgttgcagagtagcacggtctgaccggccacatacctccggtcagaccggcagagcacagagttgggggatttcgctcccaacggctagttttggtgggtgggagtataaatactcccccaccagcagcaagggggctctcttggcacccaattcaattgcatacaccccttgcatctctctcacactcacttgagctttgtgttcatccatctagtgtgttagagggttgtttagccaagagtcaagtgcatttgcttccattgtagagctagtgtggcatttgatcatctccacgccgggtcattgcttgttactcttgaggattgccacctcctagacggcttgtggaggagttgcccggtgacctctccgagaagattgtgaaggaggcccggcgccggtttgtgagtggtttgggttcaccaccttcggagtgaaggaagaactaccctggtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctccttgtctcatttgattgtcgcatttacatttgtgcaatttacatttctagagacatactttgacataggagtgtgatttactttcctagagatataattgagccactatcaccctaggtttgcaaaacataacttagttgcttagttagagttcaccctcaccaagcctagcaacttaggttagttttgattaggtgttatttagttttaaatcgcctattcaccccccctctagtcgacatctcgatcctacaggtggtagtaattaagatagaaaattaaacgatgcatgcaacccaattatcatgggagtacctctcaaaaaaaaactcatgggagttaattggtttggggccggcctcctcgctgggctagactcacttgataggttgtggtctgcagaccgaagctacatctagactaatcacagccttgaaaataaaatctaacgggggtaaacaattctggtgacgtggatgcaccacaaagtagaaaaatggtattaattatagttagcggggatcaactttaaaggaatataggataaatggatggagcaccataaaacattattggttgtgtagacttgacggtgccactagctctgtcactgccatgacctattgaatcctactacctaggtttttatattttgggacagagatagtataaagcagataaaaccttataattgctcaaaacaataatatggatgtctcacacaaaaatacaaaaacacaacattccaattgattaatgtatggctgataacctatagataaataaaagaagagacaacaataatttataggtacaatttttatatatgtattatttgtgattgaaaccaatgttgaaaatagactacgagaaactccctttcctctcctcgtccacacaaaattaactttaaaatcaagtttaacattaaaacttagttgtggttgataaacatggttaaatgatgttacgacgagagaggaagattatacgtatcaaaagttttttttcataaaatattaggttatacctaatgccagatttcttcaaaatatgaagagttttcttttctattctataaaaatctctttaaaacaatatatactacagacaaacaaatgacttagttattttttttgaattgattttgtaattttttttcctccaaaacccttctaatcgcatttcactatagaatcgaactcaggcggaagtcctggagggcggagaaaatcctgagcatcacaagtcgcgacctcacagggaggggcggcggcgctcgccgtgaggcgcgggagggggcgcgctcgcggtggtccacggtgaagtgcggcttgctcgccgtggggagtgcggtgaagagtggctcctcctcatctagcagtctctgctccagtcgtctggttccccccgccagccgccactcgcgcatttcgtcgaacgccttcgcctccatcccctcccaccaatcaatccacgtgctccagaaccctaaccctcgtgggggcgacgggggagaggttggcatctggcgatggcgtgttgctgcctccgtgccagcacggcgccccgcttcctcctcttccgcgccgccgcgcggcgagccccattgccggtcgcggtttccaggaaggtacatgctatagcgcccccttctcttccttctgatcccttttccttggggagtgcacgaatcgaaaacaatcagcatattagctagacgcaatgaggtttggggcagcgcacagccattccaccaatgcttcaatgacattgccaatgtttgttgttcatcgggccactgttgtaatgttatgctgcaaattagactatccaaacatttttttctcttattatagatgatagttattcaagggttatatacggtcacactgtcattcaatccaatgatttgaatgtaagataattaatgttactgaaattttctatgtaatatcagggtttctcggaacagtccgtattgccaatcacagacatgatcgagaattttcaaggaccatccatggagaacattccacgaattccattatatgatgatagcttgccctcaagcttgttgacaacttctccgaatcctagtgatagtgtagctcatgctgacccttcaaagagtagaataatgcttgttgatggaacctcagtaatgtacagatcctactacaagatattgggtaaatgtttcctgattctctttgttacatctgtattggtatattatgtttggcttctcctccttatcaaggtaaatgcatgtttagaaaataagtgttttgatatttatatttaaactaaattccactggcatgattaatacatgggaactgaacatttttattcttcctataatgtgaaggcacaacagaatgttgcaatatgtcctagatacacacagacacatgcacaaagggcaaaagaagttgtacatgtgcccacacttgatgttttatttcatgacatgaaaacattttctcaatttattctcataatttgggcatgatcttttgataaaaaaaatatgggcatggttttttgtggtttaacttctctgctgctttcctaccctgagaacacccatccattatctcagtatatatctgtcttgttgaactgtgctatgctgtcatagcatcttataagcagcagaaagtttcattattggtttccggtagtatgttcctttctaattcctttaggataatcatgtcaaaggcactcaaacaaaatcatgttttgcaaaactaccatagtatttttctgcacaaaactggttcagctgctcacattaaagagcactaaaatccagggttaatttggagttaggtgcccaattgcattaattgttggattcaacagctttattttttttcctcatgtatgcagcacagctgcagcatggtcaattggagcatgctgatggaaatggagactgggttttaactatatttaaagctctgtcactggtaagtatatttttttatagatttttttgtggcatacttgttaataagcttaaatttattcatagt

SEQ ID NO: 68199 - DNA, 900 bp, Oryza sativa
aatctatcatcgtacaagtaggaagtgcaacattgttgaagtggagaaatattaagcaacgtcttttgtagataagcaaggttttcaaactgctatgttgcaaaacgtggattgggtagtgaaattttgacacacatgctgtctttaagtggcattgtttaatgaaccagcatgagataagacttacttgcgatgaataagtgtgatgacagaagatacacttttttctttagtatgcttgagatgaactgttggtatttggagttgttggaaactgatgatttactaaaaacatcgcctgtttgaaaaaaaaaggagtatatgttagcctcataagtttatccccggttgacatctgtcctttgtggatcgttatagatttttatcatgtggcggtgttacaattcaacatgttaaccttctgcctctacacagaatcttcttttctcgttgtaatattttatgacatgcgttcctttgttgtgattccacttgattttgtttataacatgtgtgatccctattataactacattgctttttatatctccaggttctagatatgctggagttcattccatctcatgcagcggtacgctcatcttttttgtagcctaaaattatatggtcttgttcatatctgtcatttttctcatggaacttttgttaaaataaagtgttttagaacattgttggatgaatcatagagaatttttaaaaccctttatataactaagatcacagacaccccttgcaattccaatcatatttcttgctaacaaaatgtgaaagtttcatgtctatccttaggaactggggagcattaacacatggtgctaaaccatggtaatgagaagtgcatataagcaacttaaattgtatgtttagcccataattagg

SEQ ID NO: 68200 - DNA, 726 bp, Oryza sativa
cccaatatctttcatttcagctctaaaacagaaaaatggaccacagttgcacacgattttgatgtgtcaaagtatttttaagttgataatgtgatagaaaataaagttcatacactgtatataatgtgcttgccgaagaaaatggtggttgcatgatctatagacatagtgatttcattttgttcttctacctatttatttattatttattatgtgctgtaatcttactgtttgataaaaaccttaaatcaactcatcaaatatgttatggaccctatgaagtctactgtcccccatctttttaagggaaaaacatgattctcatgtctgaaaattatttcatgttatgatatatgtttgtacgttaccaacacttcaccagtgcaatgcagattcgtaagctaattttctatatatggtagtctatcgaccaagttgtttatgatgtgaccggaaccatgttctttttcaggagttgaagggattggagatattaatgcggtaaaactgataactaagtttggtatgttcttctctttaaagtttttttttagattgtcgccttggtgcgaaccactcgagctaaacacattctgttctaataaaggactgcttgtatacactcaaactactcaagattgaaaagttcatgatttccctgtgatcaatctacctgtttagtcttggttattaagttctactcccctaaaaaatataagtagtttt

SEQ ID NO: 68201 - DNA, 10050 bp, Oryza sativa
  unsure (1)..(10050): unsure at all n locations
cttggagaatctgttgaaatctgtggatgaagttgaggaagaacgaattaaacaggtatcattcttaatattatacattagatgagatatcccctcttcgcatttatcagcatgcacttatgcacagaaatgccaagatacagaaactgggttgcatgacgcttttgtttcactagaacagcgcaatacaatgaccccattaaatggcattgatattttaccctttagtataatatgattatcttcttgaatgttgattgcacatactctcttgtcaaatatatcattttttatcttatgacttctcaaatggttgagcaaatcatatttggtgtggtcctttacaggctttgatatctcaatctgaacaagcaatgctttgcaaaagcctggtaatcttttttttatgttgctcaaaagtcctttctattgtcttgatgaatcatgaaatgcaatcatcttccatattatattgtgagattctatctcaaccagactcttctcattgaatttacacttcttgtaggccacattacgttctgaccttccatcctatatggttccttttaagacatcggatcttgtgtttcagaagccaaaggtagcaattgtagcatcatatatttatgaaaacaactaaaccattactaaagtttgtccctctgattcctgcttacactgttattcttgcccgcaatgcttcttcaggatgatggagccaaattcataaaactcttgcgagctttggaagcatatgcagaaggctcgtcagcagacctaatcataagaagagccgcctatctttggaacaaacttaactcatgactatgctgatgtttccagcagtgacaacatacgaacttttcaagcacaaaagttccacctgagaagataggtgccttggtgctatgtttctgtcaaatttggtgcgagcggctcgctgtgctttctggcacaaaaggtggacggtgcatgtttagacaggctgtgcataccatgaaactgataattagttagttttgtagataaaagcacgtcatggctcatgcaatctacagaacatgatattttttacactctaatgaatggtggctgctggctggaaggtggaagaatggcatgtaggtacctgaaagcttaatcattcgattatgtgcaacttcgtagaaatattatctagtgacatgtcactattcatatgcacaatgataccaagttggtcacaaaagtatgtggagtacgtgtcttttcctcttagcaggtgacgggtacctagtacgtatactcccttcgtctcagaaaaaaaggcaaaccctgaattttcgtgtccaactttgactgtccgtctcatatgaaatttttttataattcgtattttcattgttgttagatgataaaacatgattaatattttatgcgtgacttgtctttttaatttttttcataattttttcaaataagacggacggtcaaacgttagacacggcaacccgggtttgtctttttttttggacggagggagtgtacctacgcagccatctacttgcggactaaagtcaccaggcaaagcaacactccaagccaaacaagccgacgcacggcggcgtcagctcgccgcgaaaccgcgcctgcggggatgtagcacgagctggtctgcggcacctgctgcccctgcgtcgtccccggcacgccggccgccgtcacacagtaccccgtcggcgtcatccctctgctcggctgcggcgtgttctgcaaaaaccaaaaaaagacatggagatcagatcagggacgtccattccattcgatccaaagactgcaggcagaatcggtaggcaacgagcatcgatgaaacctgcaccgtaactggagtaacggtggccggagccgccgtgccgggagcggcggcgagcccgatgtcgtagttcgccgtgaggtcagtccggtagaggccgaacgaccgctcggactccggcccacccttgaggtcctcgtcgtagagcgcgaagaggtacgtgtccaccgatttgcctggncgtcccgcggcgtggccgaccttnngcgacttgagggtgcgcgacgaggttgccgttgtacgcctggcgttgtccaccgtggcgccgccctcgtcggcgtcgcccttgtacggccacccggtctcggcgatgacgatgtccacgccgctgtaccccttggcgtccagcgccgcgcggatggcgtccagctgcgcgtcgaacatgttggtgtaggtgagccctgacccggcgtcgacgcgccccgggttcggctggaacaggcagaacgccagcgtctccggccgcgtgtcggaggcgtaggcgaagtacgggtacgggttgatcatgaacggcgcgccgttctgcttcaggaagtccagcaccgggtccaggctcccggcgaggtcggcgtggaacgcgcccgacgacggcgggtccgacgacgagagcaccgccatggaatgcacggtcgagatctgctagtcaaccgcaaactcgttcaagaaaccaccgcgatgcgtacgtagagatgctgtgatgagatacgtgccttggtggttgagccggcggggagcgcggcgaggaggttctgcatggcggggaggagctgcggcgcgagggtgggatcgccggagttgagcagctcgttgccgacggagatggcggagacgggcaccgtggtcgggatgttcgcggcagcccaggccgacgctgccgccggggaggacgcgaggttggggacgtcgccgttcgggacgccgaggaggatggagatgttggagcccgcgagcgcggcgacgaggtccggctggggctcgtagaggcggaccttgccgatggacgtcgacttcagcaggttggccgtcgacgccggcggcgggaggttgtcggctatcgtcccatagttcactccgatgaacgactgcgacgctgcaaatatcaatcaaactcgcatgagaaatccaagtttacaaaatttcagcaaaattcatttcacatacaaattcacatggccaacgctgtcgcaaacttcgtacgcgcagcatctgctaataattacttaattgtcacgttaagcatatggcagtggtgagagcacacgcaaacgtactacctccagagcagtagttggatagcaacaggacgagctgcgttgtacagctttggcctctttggggcagccattatctgtcaaatgctgccgggcgtgaagcgtgatcattgttcctctttgtttggccaatggcgagagctgttgcctgttggtcaagttcgaattattctcccccaaaataaagcctccaactattctagcggccgttaggtgatggatcttgcgcccacgagtgttggctcctatgctttggatatttgatttggtatttgctagattccttgaccaacccttttggtgtactcaatgcgaatcgttggtaaaagtcacctcaccaggccaatgtaaattgagcatggttcatatgcagctagcgcagattacagttcatgccaagttgctctgttctttttttctttttcaaaaaaaaggaagagtcaacttcgggtctctgcaatgtttagctacaaagtcaacagccatagcacaacggcttcttaccatttctaccgtttgagaataaagcgttgaaaaagtctgattaatcctataaagtatggaacaaccgggtaaattatctcccaaaagtatgaaattggttcaaataacctgtagagtggttttggccaccgggaccacgacgaacacacagtgacatgaggatgtaattgattaaatgcatttttactcctaactatagcggcttaggaaagaagtaacgtgatcggagaaagttagtgattgaactattcggctgaaattggttaacgtgtctgtcatgcaaacaataccactcggtcgcatcaccgcctaaaagaacacttacaaaccatcctcacatgtttctttagaaaataaaaaaaacttccaaacaactttgatatgttgtttttttggaacacggtataaacgtaaatattcatacacatgcgtgcacttatctctataaacatatatatatatatatatacacacacacacacacacacatacacacacacctaatatcatatctctttaactagcttaaaagtacctcccagaaactatagaatactttatgtggaacgcttttcgtactttaggggcacaataaccgatttcatacgttatgtagactgataagtgctttaggtattaaataaagagttttctctaacaaacaatatatggtgttctgtatattaaccgtcgcttttgaatgcaatcccaaaataattcctctctttatctaggcgttgggaatatgatcaggagtcgtggcagagaaactccatttctctccccactttgcccctcgtgttggcgaaatctcaatttctcggagcaaaaaagtaagatctcatcaaatcctccccacctatttattagaaaaaaaaatgtgccatcaatcgccatcttctttgctcaccattccggaagctagaaaaggttcggtaactcggcacgaatgagtaacctgcatccgtaaaaacgacgcagaatttcgtcctaccacttcgctgaactgactaaagtattctagtgcagtacgctaattcgaggaacaaagaatcacaacgaaagtgaagccattgttccactattccaaaaccgaactaagctaaccagttaataagcatccagcgagcgaaacatgatctgaagatgattcggtgataccatttcatctatctatctaccaacaaaatgcaaaaacgaaatcaaaactttcaccgcgataagaaacaacaaggtagcatgtcaatgatgtacaagaagcaacgaatcactggcacaattcgcaggagacagcttgagtgagaaagaagcgctctagcgcggaaagaacttacttgccaagtggaagaggagcgcttgcagcagcccagagtgacagcagcatccagccacctcctcgcccccatgccaccactgccagccaagctactagcaacaagaatcctactgcttgatgcaatctcgccgcagcttctcagatgttcgagtccaattatggctactacttgggatcagtgaaatggtcgaagactcaaaggagctcgagtggcaaactggcaatgggagaggcaaagaagaagacaaggaggaaagaggccaggaaggaggaggaggaggcgagtcgtcgatgcagtctttggcccccttgcttgctgcgtaaaataagaggagagaaagcggcggggcgcgaggtgacaccgtggggtcggcagcacaggacagggacgacgacgacgacaagggttgtgtgcgggagaagccgcggtcaccgtcgcctcgcctcctttctcgcggtgcctgcctctgaccgcacgtctacacgcgcggcgcggcccgccaatgcgttttttcccctctcctttggtgcgtcaactcgccgagaaatacagccccggcatataagaggaaaaagcgaaacggtagtatttacaaatgaaaaataatttgtaaataaacttttatatacgtgttcttaacgatctaaaagcaaaggctaaaaaataagcaacaataaaaaaaatcccaaaataaactctaaatttaaagttgaaaatttaaattttagctgataagcacaagcataaagataatggtgataagcaggtgagccgtaagacttgtttagaggagattctgatagctacaatttttttttaaatcatcgcataacataattttctctagaccgtctaaattttcacttagacttttagaatttatagttgtagaaaaaaataaaatagaagatagaagctagagaacccatttttttctcaccagttagtttaatcataagctttaagaataaaaccgcagtgtggatcggcacagcgaatagtggctttgatcagggaagggaacggaggcgatacatcgttctcggttctcgggtgtacttgcttctatctttttcgtgaacgcgtaaaaaatgtgcatgtcaatatatcgtcgcgaggatggcccgtgacgagtatgtggctgtgcggttgtgccgtgagcctgactcgcgagagcagatcagcgtcgtacctggaattttggtttcgggaggtgatgggattttgctgtctgtcaacaatctgtcatggacgttaagcaggattgcatgagcgagcgagtggcgaatatgggcgagtcgtgttgtggcgcggaaacagccacacgggtggttatcgtcgtaattaatgggtatactaatcaccggtgctcatctccaattattaagccgctggcgctcgctgagtgaggtaaagcgattccatatgccataatgccacccggatcgtgatggggatgatggcaaatatgggaagaaaacagcgtttcacctcttgttcatcattgccccggttaattgcagtagtatgcacaagaagctttgacctgtgctgctgacaacctcgtatgagtgcgaatgctctcctcctcgtcggtggttactggcccgttgctctatcacaagttcacaactcacaaattaaacacaccatcgtccacaaggcagagcaaggctaccaggccaccgtgtccacgcgcggctgggtcccctttgtcacggacgcccgcggtacccacggcccacggccacgggggatcggctgcctggccatggtggacttgggcgtcctcgaattcggctgagttaagtggcagtgtctgtgaagagcatctttttcatccttgaaaaagtaacatgaggtaccaatctaatctaaccattgatttagcagggatatgatcagtctaataaaaacagatgtcctctcttcgtcgtccctgcccatccgtcgccgccgtgcatccagcccgccgccgtccccctcgagctagccgccacgccgctgctctcccgacgtttttttctctcgtgaaacagaaaatgacataaattccctcccacccatagtaccacttcaatgagaaggtacggtaccatgagggacggacgatttctgaccgttggatgatgccagaatcaatgatcaagatttggtactccataacctcaataacagtaaaaaacctcttctgtgaaattttcggggacatgggcaattggccaaatggctggctggatgactgaagccggaccgagtaggtctctgtccgttctccgagcctgcgttgacgtgttgcgtggctgtagctgtagtttaggcgatctgtttgctcggattatcgagatggcaaaatgggaaccatggtcaggccagagtcggcgtgtctcgcggcagcatccgaaaatatagagcacttcaagcactactggagaaatgatctttaccaggtcgaggaaaaaccacaattgtcccggttcataaaaaacagggactaaaaataatttttagtccggtttataagttcaatgggaagatttgatctatcaaccgggactaaagatggcaaagatggtgttggacgacacgtggctgcgccatctttagtcccggttggtgttttgtcccagttattttaaccgggagtaaagatggacatctttagttccggattcgccgtcagtttccaaccgacgttaaagatgggttccagcagtgaagcgttaaagatgggttccagcagtgaaggcaaactaggcaaagtgtgtactatggagtgatcacacgcgcaaatagcaagtgtgtggatatgtgattcacgtttatacgtaagtaatttaagcattacgcgctgacatcccatgtgtaggtatgtatatatatactcagggtaggcgacttcagacagaaactgtcaggggcaatgtacaagttgtaaatagacacatgtggttcatgatggctgagggttttgtttcctaaataaaatagggagctgagaactgtttgtatcgggctaataagagcatctccaacagtctctacatctcactcttcaagttaaattttaataattctaataaaaaaacatgctccaacaacctctccaaccggatggctaagccatccgactgaccaaaacccttcctccactagccaaatttagccactctatttggctgaccaatggtgggccccacacatccagtcttctctatccccacacggcaaccaatgaggaggcacaagaggagcatgaggaggaggcatggggaggagctcgagcacggcagccgccggcccccgctcgtcgcgaccgccgacctccgcactcgccgtcgtcatcatgtcgcgcgtgcctatatctcgtcgtcgccgccttccacctctcgcgcacctggatctcgtcggcgccaccttccacctcgccgcgcctggatctcgtcgtcgttaccatacacctcgcgcgtgcccggatatctcgtcgtcatcgcctctcgcccgcccggatcctcgtcgttgttgcctcctgcctcatgcgggcggatccccgtcgccgtcgccccccgcctcacgtgcgctggcgtcctcgcttcagagagggccagtaaggagctcgaggatgggccgatggggttgccctagcgggaaaagaggaagcaaggaagaaaagaggaagaagggcggtggaggctgacatgtgggttccattgtcatagactcaggatgaaaagtacaaatggagagtctattggagcgaggaactagtttgacttgctaaatcagataaagagttggctatatgggtgtttggagagccggattttagtagtctgttggagatgctataaggtcgacaggtcgttcatcaagtcttgcacccaatgttcatgtgaattcagtcaaaaatgtgtactcacaagtcacaacgtgctatcggaaggcattagtgtatcctctgaaactgcgtagtacgtgctctcgtgcaagcaatcatgcatagcatagtgttttcaggtgtaggtgaagtaaaggagtaaaggactcattctcatgctaatacaaagatcgtcagacctctcgaaattagatcacatttatagaaaaaactacaacgacatctacaatctcaaattagttcatcaaaattcaccataatataaagtatatcttgatggtatattttatttggtattatagatattaattatttttctattaacttgttcaaagttaaagaactttgactaaaaataaaatcaaaacaccttataatacgaaatcaaaggagtatttttcagctacttcaacgtacggattattaacatggatcatttgctccataactctaaagatatgtttccttagaaaccttcttctattgcattgtttagatcatttattttaacctatttttaggtcttttttctcaagacatttgatttcttcctataatcaaatacgcaaaatctatttcgagaggcatctcgatttatacttaacgagcgacgcggacaattgcgtgagaagtactagtagcgttacagacatgcatgcaagtagtttttgctattaggttgtccatattttttttcttatgaaattttctcttaaattacttattcgatctataatccgattacaccgttgtgttcataacaattaaatctttacaacaagatctcacatgattatattttgatgaaaaatcacaaattacttttatgatatgtctaaattacttttagatttcactaagttacttcttagacatacaaaagtaaattcagtaaagcctagaagtaatttacatatattatagaagtaacttagaacaaaacgaatgtaactttggcatgtcatttcaagtaaatccgttgtagagataaaaacatgactctatctagaaattaaattaatcagcacaaattatggaattaactaaaaacaataataaagaaacaataataaaagtaatcacctcagagcattatgaatgtataggaagtattttaatcaaatttaaaagtaacttatatatatgataattaaatatatgataatttgttcaatgggctgcaggaat

SEQ ID NO: 68202 - DNA, 753 bp, Oryza sativa
atgtaaataacttttaagctttactgaatttacttttgtatgtctaagaagtaacttagcgaaatctaaaagtaatttagacatatcataaaagtaatttgtgatttttcatcaaaatataatcatgtgagatcttgttgtaaagatttaattgttacgaacacaacggtgtaatcggatcgtagatcggatgagtagtttaagagaaaattgtatttgaaatataggtggatggtgtctcttatagatggagtggtagacaaaccagctaccactagctgtgtagtcacgtctaatcaaatagataatccgccaaaataatgtagtagtaatcaaatagaccaagatcgtatatctcctattcatggcccgagcttgtgagttgtgactacgggtatgttcactttgatatcattttcaaccatattttttttggcaaagttaccaaaaaaaatatctacgtttagtttgttaccaaatttggtcaatacataagaaatcctgccaaattttggtaatattgtcatcttaccaaaattttggcattgccagaactttgtaaggtttattttggctacaatctgaacgggctctacatgtccatacacctgaacaaattttcaccatgctaggatctttgtgggctaaaatagtctagggtggtctgggccgtaggccttagcccaagctctaatctatccgcatctatctctctcctatattgtccatgctaaatttgggggctgcaggaat

SEQ ID NO: 68203 - DNA, 1269 bp, Oryza sativa
ccaggatatggtaacctaggaggaggcgcccgtgcaacgccctgaagcgtacgtggctctgcgtggtgcaggcctttctgataaaagatgaaagggtcctgccgcttttcggcccaccttggggatggaagcgtgggtggtgggtaggcacatcgcccaactagacgacgcccaagtcaactatatttgcactacaaccagttgcttactatatagatctttatagcctattttcagctcacttatatagcggttaatatttcactataaatatatggtccacaagtctgtctaacggattttcttagttcctgtgactaaaccagctataaacttacccgcttcttatctttctcctctcctctctcatcaactcagcatttagtcttcttatagccctctattatacttctattatacttgctctaccagtaatctactagcggccgaggtggtttcattcatcaaacgatgaaaagcgtggcagaatgggggcgtgcaaagcaatggagtacacatatacttgctgctgcttgggtgccagattggcatggttacttacttaccggaagactagcgcacacgaaaagcagcaggtcaaatacggaagcactgggcactggctcgagagaaaattttgcaaaagcatgtgctgaaaattttgagtgctcgcttcgggcttgagacagatattttgctcctgtccatttctgacgaagctgcggctggatggatggacaggctccccgtgcttccccccctcggtggatggcaaacctacctatccacttgtggtaagatcttacggccattggcttgccctcgacatggtccataataaggtttagtataactcgccaccgaagataatgattccgggaaaacgacggcggtttcccaactcgggcgacgtggcgacgcgcgcggcgcaaaccaatcgcgccgcgggcgagaccgagacgagatcacgatatcgccggaggggttgcgcttgcgccgctgggtagaggttggtgggagagcggcatcggcgagatggcaaccgctgctcccgccgcggataaacgcatccggcaaccggcatcgaacgtccgatcatggcacagagctttgctccgacaagagctaagctcggagctagtaacacagtgtcagtggccctgtgccgaaccatggacaatgatgatggccttatcccctctggtaaccagacagtgcgcttggactgaactgtttctggcctgatagctaatgtaagttatcctggtg

SEQ ID NO: 68204 - DNA, 920 bp, Oryza sativa
attcctgcagccctgttttgacttctgaggcctttgttattgctcttaaatccatgatcctttatgttgcaggcgggatctcaaggttgctctcttctatgctatcttgttttgttttgtcatggtgtcctgctatgttgccctttacttgagatggttcagactttcagccatctttgtagttttcggaattctccttccagtaggtctcaaaatatctaggcatagaaggctgaagaggaaaagagaaaggagattgttgttacctttgtccatgtgaatatatttttgatatcttgtaacattgtagtaaaaccgcgcaactgcaaataggaaattgcctgctttacttaatttacagacagttcaacttacacccaaatgtctgaatgtattacctattctgttttggtgcatgcacatacatatgcaccaacacccttgtctcagtttttgcccatctttttcgagctttgcctttgaaaggtaatgctaccgttagaaaatttctgatagtgaatctttggatatctaagcctgtttgttgtgattatgctcactaatgcatatgtgaaataactggtcaattgtcggtcacttggaattatgttttgttctgtgtcaagtgatctgctttccctgttcttagcatatcatgtactccctccgtcccataatataaaggattttgactttttgcttgcactgtttgaccaatcgtcttattcaaaaaaaaaattagaattattatttttttttgacttactttattatctaaagtactttaagcacaactttttattttttatatttgcacaaattttttgaataagatgagtggtcaaacggggcaggtaaaaactcaaaatctcttatattatgggacggagggagtagtatgaatacggacaccgtatgct

SEQ ID NO: 68205 - DNA, 6183 bp, Oryza sativa
  unsure (1)..(6183): unsure at all n locations
gcatctgtcaaatattcaaaatagtaatataatataaaatatttttctcatacagtttatcataaaaggtctcttatgtaagttaacaacaaagtgaatgatgcacatacacacctatgataattgcaatgggaaaagaatcatgtaaacaattacctgctggaagatttgcaaacgtggaatatgcaacagagtaagacatgtcatagtacaggtcacaatcagatatagcatgagctcttgcttgaggcgtcatctgaatttgtttaaatattagcaacaacaaaaaatcatctgtaacatgacaacataataagcattaaataggatatatgcctaatgaatatatcacttacatttggatcaacatgggcaatctttacttttgagactatgcactcaatcaagttgtcattcttctcctttgaaagaaaaacacgcttatggttatgtctatgatcatgcacctttannnnnnnnnnnnnnnnnnnntgcaaatacatgtctcttataagtgttacatttccattaaaaagcaacaaaaaggtacttcagagttcagacataccgtatctgctgtacggaaaaaccactgacaagagaaatatgatccacggtcgactccttcaaaaaattcagtaatccgtccaatgtaattttcctcatcaggaccagcctgcaaattagttagtttggttcatatggacctagtagacaagacatatgataagcaaatagataacgcatgaataatttacaacgatacaccatagagcatatgcaagccaaacgaaatgatattcttattaatctccacagtcaaatcaagttatgtacccatttcccacacaaaattgatatgcacagaacaatgatatgagaaaatttacgtgcgtacaaaatgagtgccaacaaattaatcgaaaacttaatatctcgtggttaacaaccagtagaacaaatagtaggataataagtttaataacaattataatgaagagcaaaacaaaaatggcagaaagtaaaaggtacattaatcatcccttgttagtcagtcatataaaaatgctatcgtaaaagcaatacataaaactaggaaacaacattggttaataaagttctaagaagtgtgaacaagatattcatgactgaccttgacatagacatcatcatcaagatgatagatttcatcatccacattagcagccaggtagtgacatcgagccttcatttcttcatcttcgtcaggcctgcataaatgaaaattctgatcaccattataaaagcagcataagaagagattaagagtactttcagaacaatgttagcgtaaaaacacacatactcctgcttaagaagcgaatcagacccctgcaacaaaaacaaaagagcatgtcagttttatttttcaaaatcatctcaaaatcgaagtgataacaaactttagtattccaggagataactctagaatagagttagaggtttactagaaattcttacctttctactgtacctcacgggccatcgttgtcgcgcttcatcatccggtactggatcgcccacaaagtggtcatctgagtcctccacccttctcgcagtgcttggccgcgccaccctcttcctcgtcgcagccttctcggctgatccttctccgacacacttacccatcctctcctctgcttccagcacgtcggctgcctcctcctcctcctccatggccatctgttcggcgtccggctcatccgcgcacacgtcttcggccagcgcgccacccgcatcgttcaccttcatcttctcgggcgcctgagccgccgacttctcggtcgtctccttcgtcttctccttggccgtcttcttacgggtacgacgcttgaccttctccaccccgcgctgccgcttgccgcgtgactctgcgggcgacaacccactgtcgagctcggtcccctcgggctcctgcgccgccgccttctccacgtcctccggcttccattcggtcgctccctcatgggcactaggcttctccttcgccgtcctgcgctggcgcttgcgcaactcggggcgcggcatctcgcggtcgatctcgtcgagctcggccaccccctccgccgccgccgccttctccacgtcctccggcttccattcggtcgctcccttacgggcaccaggcttctccttcgccgtcctgcgctggcgcttgcgcgactcggcgcgcgacatctcgcggtcgatctcgtcgaggtcggccaccgcctccgcctcggcctccatcgcggcggccgtcattaggcgcctgcgcgtggagcgcctcggctccgtcgccgccgcgggagccggctccgggaccatggagccgcaccggcgcagccgcagcccgcaaccgaggccgcggagatcggagacggagacggagacgacagcgagagggggggagagagaaggattagctagggttttacggctcagcgagctctcgatcgcagagtgtggttcgccttggataggagcggaagcaggaggcgctttgatggcttgcggcgtcgcgacgggaggaggtctcgagcaggccggattcgcgggaatgcgtgacgtcgtggtctcgtgccgacgcggaagattggaatggaaatcggagagagcaggggcggtgggcggtgggcccgtgctcgccgcagctcatgcaaaagagggggtcgtggcttccgagtgggccccacttgcagtgacggacactttccttcctcaaatcctcagttctgttggtcttctttttctctccggtggggatagcctagagactagtcaatggcttgtccttcccgcgatgtcagcagcatctgtgatctctcagtgggacccacgtgtcattgggcgaagactgatcagcgccgggagggccaagagcgggacgattcaaactttgggctttgagattcgtgtagacccattgtctggcagcggcgatcgtccgatcggctggtcgtgtgggtccgccaggagcagggtgatcacctcgttttctggtcacagtttccttttgtgtgaaaaactgaaaatttccgaaactttctggttaccgtttgaattccatcgtactcgtacgattcccttggcatacgttttgtatgggaaaaaaaggaagcattttcatgcatatctctatgctcaatctgtgattgattatacttactgtttgaattttgaatcaccgtgcagaaaaaaaattttgctcggcatgaactattcatcttcgccatggatggtgattggtcatggactcgcggttcgggggctcgcggcaagagtaccaaacatagttaccgctatttcagaagcccgtaactatttcagaagcccgtaacaaacaggccgtgagatacagtacactatttcagaagcccgtaactctctaaccagcaactagctaattgggccgaattattaatggctatggtttcctggcccggcccatagttaccgctactactcactctgccgagactgcattgtctacctttccaccttcccatcctcctcccgttccggccaacaccaccctctcctcccatggcctccgcctccgcctccctctcgctggcgttctcccctctcctcctccctaccccgcgaccccgaccctactcgcgacccatcaacccggggtttcctacccccctacggctcagccttgcgtgctcgccgccctcccgtcgcgccggcccggttgccgcggtcccggacggcgtcgccgtcgcggacgtagtggagaaggactggtccttcctcgatgctgcggcggcggcggcggccgcgggcggcagcctcccccgcgcgctcgcggcgggggccctctcccccgcgtcgcgggtgctggccgtgacccccgcgccgtccttcgtggacgccctcctctcggggcacccctgcgagctcctggtggccgcgcacgagtccctgtacgtgctggcggggatcaaggaggggcacgacgaggtgaggtgcttccacttggagggaggcggaggcggcaggggaggcggagtggtggagggcgtgccggagaggttcgacgcgttcgacgccgtgttcgtctgctacttccccgggatgggtgtctcggccgccgcgctgctcaagtcgctggccaagagatgctccaaaggtgagaagctatcttatctctgttttgctctgttagcttcgcaatcatttgagggttaaaactctgcattcctcgcttaattggagggcctagttgtgggtttgtacataatcagcggaattgctgtgttcactgctcttgaggtggtttgtgatggttaagaaactaggagtacattttgttgtgacaaaatttggtttgtatgactaacagtgacttgagatatcaatgttagtactaggtaacctgttgccttgccatattcatgaaataaattggatacattagtttacaattacatgtggttttgatacagtgtcctacatggtttgaatcgttaatccttgtgtgtgctgatttagtttgcttgaaacaattttgatgcgatttatggaacagacaaacagccgtaggcatgcatatacttgttttgttctgattattttcagttcctgtggttaggctagttttaaatcctaattctacattgtagatggtgtttgtttcatggagtgcattagctcaattcaggcactacttgtatagttgtatgtgcctaaccttgccctctaaagttttaatggggtgatttgcggccttgttgctttatatatgctttatagttcatcttttgcatctgagaattgaatcaagctatcaaaatgtccttgttcttagttcaatagtattcagctgtccttttctcttatatacatttgctccactcctcagctccgacaacccagcttctcacaaagctcttagattagctatcttaacccgttgcttcttattattaacaagacatcatcaaggatcagtcatcaacctttgctacatcccctagtttagccaaatttcatgaacatcgacttgtcagggtgcttcatgtgttgaggtcattctgatatgttgtgattataccacctggatatttcttgtatgcattttgtcttgaattgaaacgctgtatgccgtttgccataggtggaagagttgtcatctttttggatcaaggacggcaaagtttggagcaacatcgcagggaacatcctgaagttgtaactgccgatttgcctaccaggccttctctagagaaggctactgccggtagcaagtttgaaatattagagtttgttgacgagcctactttgtatcttgctgttttgcagtttcaatgatgaacttgttgaaaacaacaaattatatagacagcttgccatccatgccggcgagaatcaactcggctttgtagtttgtagatatgcaagaaattattgcaaagttaatgatccttatggcagccaagttactttgtagtatccctgttgacatatgggaattaccagaagcactggcagttaagggcatttacgattagatgaagccctgcgctttactgtgggatatatggatgaatttatgttaaatgtcgtaggactaatcgatagatttgaccggtttgggttaaatattgtgaaaataatgtgagatgataatttagtatgcttctatattgaggtttagaatataatgaattgtagaagtaattgctatgcatgcatggtgagttttaggtgtttagtgagttgatgtggcatgtttgcatgttattcttttgaatatactaacaactactactatgcttacatatgttgagttttagatgtttagtgggttgtaactttataaaagatataggccttgtttagttggggaaaatttttgggttcggttgtcacatcggatatatggacacatatttgaaatattaaacgtggtctaataacaaaacaaaatacaaattccgtcaggaaaccgcgagacgaatttattaagcctaattaatctgtcattagcaaatgtttactggagcaccacattatcaaatcatggcgtaattagacttaaaattcgtctcgcaatttaatatttcatgcatgtattcaaacattcaatgtgatggatgaaaagtttttgttttggtaactaaacaaggccatagatactgtgacgtagggact

SEQ ID NO: 68206 - DNA, 1145 bp, Oryza sativa
ctggaataagaactccgaagtctccgatcattttatgcacaattggtgtggatcgaccaggacccgttcagatccacgaaattagcaaggtgtgtttcacattgaatttgtatggattaccagttgtcacctctggattgcagttgacccagttttggatatactacctctgtcccaaaataagtgcagccgtggaaattcgtgtccaacgtttgaccgtccgtcttatttaaaaaatttatgattttctttaaaaaaattagcccacataaagtattatacatgttttatcatctaataacaataaaaatagtaattataaaaaaattcaaataagacgaacggtcaaacgttggagataaatagtaaaaaactgcacttattttggaacggagggagtataatacaatcgtcagctattgttgacaggaaccaaatctgggacagtgaccttaaattgggcctcatttctgcatcatatagcaggcattaaaagagaagcacactttgcagacttgcaggtaagcatataattttctagccccactatggcatgagccggcgaaccgcaattaggattttgctagtaaataatgtaagatccaagagaagttcaggcatcttactacaaggaataaaaaatcagaatttggccacttgacatttagttttcttgagcttgctcaaaatttatttatatactagtacttccatttattaccattagggcattatcgcattgtcacagatttttctcgatgaacagagtatgagtgggatctacgctaggtcaggacggcacctcacatgcctctcactgtgctatgctgcaactggcacggcattgctgctgatggctgctgcccatcccttcggtggtgtttagatgcagggacttaactttagtccctgtctttagacactaatttagagtattaaatatagactacttacaaaattaattacataaataaaagctaattcacgagacaaattttttaagcctaattaatctataattagagaatgtttactgtagcatcacataggctaatcatggattaattaggctcattagattcgtctcgcaaattagtccaagattatagatgggttttattaatagtctacgtttaatatttata

SEQ ID NO: 68207 - DNA, 1428 bp, Oryza sativa
attcctgcagccctgcttagggctccgacgacctagcgtacccgatgtcccgatgaaaatgatgcaattcttttttctgtatactgatccgtgaactatggaaatgtcacttgtaaattgctatgggtagaagctttccttgccaaaaagatcattctttctttgtgaaagcaacagggaatcagatcgacgccatgatgaaacaaatgcaaaacaagaattccagatgcgggctgcaccgatcagattctgcacgccacatgatcctcggctaagtggttcgtcttctcttgtccatttcctgccgctctcttcgacgctgaaagctttccttgcaaaacagaaagggggagaaggagatgaaagagatcagttgaaaacgagtaggatcatcatcccgaacgggtggatgaatgggctctcatcctctcaccgcgattgtgcgtcgtaaccgctattatcagcaagaggtatcgccgcttgccgcgaagtacagcaacgtacagttacacctcttgttgcttctttctcttcgttttgttctgacgccaaaaggaaattaggaaattctgaaagggacatgtgagtttgctgtgtgacaaactgacaatatgaggtgcagcttttcagcgtgctctgggcctcttaaactatgaatttctgagcactgaaatgaagtgagcaatacaaacaggaaaccatgtggtccttacgccagaaggtgtcaattgtgatatgatattcgttgtttctttgtaaaattgtgctgttagcctgttgctgttacagtgtgatcattttgcacttcaatcagcttgttttgggagtgtagggagtactggtgaacttcatttttgcaagtctgttgctactgactttctgccagaccttatccaagaattactagcagccacaccatcttgaaccgcagtgtttgcagcttactatttgttcttacaggacaaggtatttagttatctgagaggaataaatattcaacagtgaagtaagcgtcctgattcttgttaagtccagtatactaatatgatattctgattatctccctgaaaaccactgtttcgacagttgaggcgatcttttccacaacaataacatcaactcatcaagtgctcacattcactgatatgtgataagaccgatcatattcagtgaccattactgacgctgaaatgaaaatatcatctgttcatagtgagaaagttataactactaacccataacagctgacagcgtaatgcgaacaatcaagccacagtcatcacaaactgcagctacactgagatattgtctctattaatgtttctctctttgataaggaggcctcctattttctctacagtccttcggttgtcagtttgtctcccatcggtgtgatgtcaataaatgtcttaagataagaacacgacg

SEQ ID NO: 68208 - DNA, 2450 bp, Oryza sativa
caagtctcagcatccaagaagaacagagcacataatgtgttttggatgctaagttggtttgatgcatgggctggtgttagtatgcatgtgctgctagggccctcctgctccggctggcttgctgagaagtggctgcagcgccttcaccacgatggtcatgttcggccggaaatctgactcgtattgcacgcacaacgccgctaccgccgccatctgaaaacacacacaatgcacgacaagatagcatctcagatcgttcctgcaaacttgcaagaaactgatggtcttgtattaccttggcaactgcttttggaggatagtcatccccgagtttcggatccacgcactgcctcaccttgtcctcgctcaaccttggcgtcgcctagtccatttcaccagtagaaaatgttcagaaattcagcattgtccaaaaaaaaaaaaccagaattcagacaaccacaagagcatatggctcttggaacacatgaaaagctccaacaagatgtgcaagaacatggcctactacactacccaggttacaagactctgctgtctcttcggcatggtatggtccactggcttcctgccggtcagtaactccagtaggatgactccgaaactgtacacatcgctcttctgattaagctgtcccgtcatcgcgtaccttcagaaagcgaaagagagaatccatttgcccggtcaaaaattaaccttgacctttcttaccgaaagtcaattaatctactaatcttctgatcatgtttttctccaatcaaacacagtgtggattcagacagagaatgtattactcgggcgcgtggtagccgaaggttccgaggacgcgggtggagtgcaaccgcgcggcgccgtcgggaggctgggtggtgaggttgaagtcggcgagcttggactcgtagccgtcgaagaggagaacgttgctcgaccgcacgtcgcggtggacgatgggcggctgggccttctcgtggaggtactcgagccctctcgcggcgccgtacgccaccttcacccgctggctccagttcagcgccggccccggcgccgcgtccctcacgcccttcttccctgcagttttttttttttttggtttccggatcgaccaacacgtcgtgtcaggtttcatgtgccaagaagaattcgctgtaaacctgtggtcattaatgcatgtagatcatcagaatggaggaagaatttgtataccgtgtaggatgtcatgcagggagccgtgcgtggcaaactggtagaccaggattcttcggtttgcatccaggtagtagcccatcagccggatgaaatactcgttcttgagcctcgaaaccattgacagctgcatgtccacggaaccagatggttttaatcagcaacgtagatttgcagcacaaaagtttgatgttgaacacgaatccgttgtgtaattgttttactgatcgttaacctgagcagagaagtctgcttcagagtcgcttgacacgctgggatcaagcttttttatggcaaccggctccccggaggtcagcaccgccctgtagattcgaccgtacgaaccttctcctatcaaggcactctgtccaaagtgtccggtgatgttgttcagctcgcccatggagatggctggcacgtcgatggagagcaccttcggtggcgggccgccgctcctgggtgcatttggtcctcttggcttacgagggcctgatacacaaccaaaaacaggagatttgcacaattttcagtcttcagattcagcataaggattgtggcatactccgtgctaaactctctgtattgatgacataagttgatgtggccttgttgaagaatcttgtactagtaagctctaaaatgagatgctgcgaaggcaacacaagttggtcgattgaactacgaccttctcctactgatgtttggtatagtgagtaacttgagcattaaatctgaatgtgcagatgggtatccaattagaacagagaatatggatggtagtcataacgaattacagcttcttattttccctcaaaaaattacagctgcttatctatacaatttttctttctgaaagttcagattaaaattgcctctgaaactaagaaagacagagctggcagtgcggtatttaatctgaactttctgccaattcaattatcatcacgatgcaacattatacagttgagcaccttggcctctgtttcagctaaccacctgcagaaccggaggaggaaacggcgggatttcacctgcattgtactgcgtcgcaggtgtcgggcgcctgctgcgactgcgactggctgcacggggagcgtacgtctcctcctcctcgccgccgcagcaaatcatcctcctggctccggaaatcaagtgcaaggaccgtggcaatttgcagtttgtgctcccgctccgatccgatccaccggatcggccgggagcctcctgaatga

SEQ ID NO: 68209 - DNA, 5749 bp, Oryza sativa
tcctcgccgacgccgacgccgacgccgacgaggtaagagttctcgcgatggacggtgttcgccgtcggagaagaaggagaaggcggcaaatgggaacacaaatgggagcctaatataggtaggaaagaaacacgcatcggtagaccaccgcgttcgcgggggcgcgaacggagagaggagaggagacggtggcgattggcatgtccacaaatcacgtacactgcccgatcgaactcatgggctcacggctagttcgcaagcaaacggcacggccgccgctggtcgccgtcgttccgcatccaccccgccggccgtcgtccgcgataaggatcggcggaagtgaaacaattaacgagacctatctccacgagtccacgtagagggcccaaccgagagcccagttaacgaggaaacgacatcttctcggagtgtctggctggccgggcccaaaaaaggccgtgactttcgtttgtggaacgttccacactactggacttttgggctgcacgaacgaccgagcgaacacgaccgttttgcgtcttggtggacaagaaagaaacgacccgagaccgagaggagaggcgagagagcgtggagtatttgacttggtttcttaaaggttaaagccgccgctggttttcgcgcgcccggccgcccacgttattgaggcgagacgagagcgcacactgcagaagcatgcggcatgcctgccttgcgcaggcacagctacccgctctcgcagctgcatccggcacacagattttcggctcgaatggatatccgccgtagtctccaagtcgatctgttgttccttcccccctgtacgtctcaccgtagagttggagtggcatcatggcatggctatcccgtctccatgcttcttggctcctcgcgagcgcgaaaggccgctccagcctgggaccgatccacctatataaatcggcctcgctctgctccagttcggactcagatcgcaaccaacagttgagttgaattgagctcgaattgtactcgattcaccacacagaggaatcaaatcgaagcagccatggctctcgtggagggaaacaacggcgtgtcggggggagcggtcagcttcagcgaggagcaggaggcgcttgtgctcaagtcgtgggccatcatgaagaaggattccgccaacattggactccgcttcttcttgaagtatgtactactacatgctactacttactagtgccattcttcgcagagtcagtttacggcaccaaccattggtttctgaggcattatacatttcggtgtgcgtgattggtgctactatatctctattccaggatcttcgaggtcgcgccgtcggcgagccagatgttctcgttcctgcgcaactccgacgtgccgctcgagaagaaccccaagctcaagacccacgccatgtccgtcttcgtcatggtaatactaccatcagtattgctgcagacaagagtaaatttgttgtagtagtaggcactgacagaatgtgtgcgtgtgtcgtgatcaatcgatgttgcagacatgtgaggccgccgcgcagctgcggaaagccgggaaggtcaccgtgagagacaccaccctgaagaggctcggcgccacgcacttcaagtacggcgtcggagacgcccactttgaggtagagtgatatccagttgttgctccattcgatcgacatggaactctatcgatcgtgttctgattgtggccttgtcgaacgttcgtaaacaggtgacgaggttcgcgctgcttgagacgatcaaggaggcggttccggtggacatgtggagccccgcgatgaagagcgcgtggagcgaagcctacaaccaactggtcgcggccatcaagcaggagatgaagcctgctgagtgatatatatactgctccacctccatgatcctcgctgatcaactttgttgcattgtgctcgttcaatattcctcgccccacaaaagggacttttgtcggtgtgtgtatgtccaaatgattaaatcaactgctgttttgttctatgtaagatacataactcataaataaagatggttttctacatgccgtttatgcgcttcgatctgcagcattcggaagtacaacttcggtagtttggtgtgccgttcgctggatgggttggacgttgagtggcacacccatcacgccatattcttaccttgggccttgcacccaaaagggaaagagtctaattcacctccctcatttcttgctcttggtcgaatcacatccctcaaccgtaatacggatataacccacccaccaacttcttgtaaaataaagggagcaaattgaatagatcctattcctatagatggccaaatgggccgtccggccagcatggcccaagcaagaccgggcttgggccgatgttagtcgggctgacccacgggctacaccaacggtccaggcacaacccaataagactagggccgtattcggccagccagaaggcacgacagcccatcatgcttctacatagaataaatctatttttactccctcatctctctgggctggtgtcttacatggatagaataagtcttattttgtatctgtcttcactttgggccatgtcttatatggataaattaattctattttggatccctcaattatttttttgaccgtgccgtgccgagccggcccaccgtgccaaggcatcggcccaggcacggctgtagcgcccgttccgtcgtggcgcctagcgggaaaactatatcttaaaaaccctatttgcgaaatccgtttctttgcttgttgtctagtgtccgtgccatctcagatcttaaatccctgatctatcgtcgagttcaatcccgaatccagatccttcccaaatcaaatccctccgcaaaagtctatttcgcctccctcgggtttgatgggccgaatccctctcggcccatctccccctccctccccggctctctctctctctctgtttctctctctccctctcccccgctctgcccgtgcgctgcacacgcgtgcgcgtgagccgcgccgagccgagcgccctccgccctcgctgccgcttcccgccgacgccgccgaaatcgccgcgccgcccgttgcttcccgcgcgcgcgcgcgccatggtggccgaccgcctggtcgctgccgccgtcagcatctgccgcgcctgcccacgcctgccgcccgtgacgtcgcaccgctccacaccgccccaccgtcattgccgtcgtcatcgcctcggccccgccactcccgcgctagcctccaagggacggaggcagagcctccctcctccctctgccgcgacgcccccgctccctccttcttttcccgaagaggcaaggggacaagcccccttttctctccctcttttcccctttttccctcccgccggcgtcatcctcctcccttctccctgtcgccgcttggccgcgaccgccgagcgctagccctctcctttgaccgccctaagtcggttcccaaaccaacattgccatcctataaacccgagctccccccctttttcctttcctctcccattcacctccgcgccattgccgcccctctgtttcgccgtcgccgttcgtcgttgcgcgtgtcggaggagccggcacgagcaaggacgcggaaggggacttcggccgcgccctctccttcctcctccccggcccgaggccggagagattactcccgcgccgtcggcctctcgtcacagcgcccctcctcacctcggtgatgcctccctccgttcttcctcttcgctccatctcctcccctagttttcggtggtagcacgagtagcctccccgtagctagccggcgccgccccgaccgttgccatcgctcgctgtgtgctcgccgccgtcgccgctcgagcttcgtagcacccgctcgtcgccagcctcgctcggcgtagctcgccaatccgacgctagcaacggattcccgtagccgcgtagatgctctcaccgccgggaatcggcccctcgtgacctcgtcgccgtttcccccttccctccccgctggttgccgccgccgcaatccgccgccgtcgagctccctccggcgaatccgagccgttggctcgtctcccctcgtcctgtgcaacatcccggtgtgctcgccttcgcctgtatcgccatgattcgctccgccgctcgccgccgtcgtccgcagtccgttccggccggcgtcgtcatctacctcccgccggcccgcgtggcagccacgtaggcaccacgtcggcgccacctcggccgcgaccgggtcaagtagaccccggtccgccgcttccctccgccccctcgcgcgcgcggtccaccgcgagccgtgaggctgcgcgtggcccgccgcaccgcgtcctccgcgaaccgcgcgcatgcgccgcgcctccctccccaaaccctagcacgccccgcgtgcacctcgctcacggtgagccaagtcgccgacaagtgggtcccacccgggcccacgtgggatggacccggcccaccggctctctctctcccctccccgcccacgcgcgcgccttgggctgcctcttgggccagccggcccattaagctcggccgagccgccccattctctcgggccgcgccctagccgcccgagggaagtctaatttccctccctccttcttttcttttcttttctttttcaaaaaggatttaaataaatccttttcctttagaccaaaaatccaataatcttagaaattcaatatcttcccaaccgtaagtccgtttgactccgttcaacttctaaaattcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgacccccccattgtaattgttataccatgttcccttgcaccccctagttgcgcctcggtaatcgtgcactctgcacgggtaacaacggtcgccttcaaacttaaaatctgagaaacatcttgggtaaaacttgggttttacaaaagacttggaaaacccgacacctgggtcggtgcttgcgaactaaatgaatttccaaaatcgctgaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccattctgcacggactggatgatccgggttagtaatgtcgtgtgggtaaagtgtacccccctctgcagaggttattaaaactgtttgaacagccgtgcccacggtcatgggcggatgtgaggtgattcctagcgtagttttgtttgac

SEQ ID NO: 68210 - DNA, 1698 bp, Oryza sativa
atgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcgaaaagagttcaaataaaatcaattgcaaaaaaataacagcctttctttgaagcctgcattaaacacttattttccatggctttctgagtactcccgtactcacccttgctttatataaataattcccccccagttgctgaagaagatgaagcggatcccgctgacgagaagttcttccaggagcaagccggctacgatgagttttagggtttcggcctagttcccaagtcgcgcctgtgatgtttggtccaagtcttggcttccgcttcccttttgtaatgcagttgtgagctcgggatctgtccacagcccaacatgactgtactcctactctataataaagagacctctgttgctgtgatattctgtcttcctgtgataccagcactgttttcctgggactggtatcgattaacaggttaatttggagcgtcacgggctagttccgctcgggactagttcggggcgtgacaacggccaaactgtcaggccgagtcggcacaggcccgacaccagtcgtgccgtgccgtgcttgggctaggatggctgtgccgtgggccaggccgtcgggcctcaggccttatggccatctatactatatcctttgatggtttaggaagcggtttctactaacatagcaggttgacttcgttcaagtgtgttgatgtggcagtccagatcatataagaaattaaaaatagaagtaggtccgacgtgtaattgataggggttaaaataaaaaaaaatgttgaggcccacttatcatcgccatggccaccatcctggacaaccgacgaagaatttcagtgggaagttgggttgaggagaaggtggagataggcgacggcgatggggagccactcatggggagggaagctgggtgggaggcactggctctgactcacctcgatctcacattgccagcaccaaaggtggcatcatcggtgagcggtcattgagcaaggcaatggggcggagaagaggaggggttgctgccatcgtggagtgagtcccagaaaaccggggtggggaggagcgagatatcggcggtcgacataccgtccgccatcacccgccactgctgaagccgggccaagaagtggatccaactaggcggagtgtctcggctgtgatggcgctgtatacatggtgacgatggcggagacctcgggggtaggtagcgagcttggccaactatgtgacgttgagggggagctcgtccaaatcgaagcatacggaatcaaagatcggaaaccaccagggctgccgggttggcggaggacatggaagcgttaaggaaggctgcggcagcgtggttagccgtacgaggcggtggcgccaggccaccacggtcgggtcgtgatagatcttgtatgccccgaatgtctctgttgtcccacccgccatgaggaggatctagtgctagccgctgctgtcacttagcaccacttggaccaagttgatccctccgcattgatagaaatagcttcctaaactatcgaaggagtcaatttgtactttttttgaagtctgtgaaggagttg

SEQ ID NO: 68211 - DNA, 6531 bp, Oryza sativa
catacagaacaataggatacttgtaatggctgcacacatcactagttgatgcaagggtcgtaaggtacaacgtaatcttccatcacctaaaaaacagggataccatttagtggcagtaggggtctgttaggataggtctaaaactctaaattggagcttgaaacagtgaagcctactcaagcttaatatatggtttgacatgctactctagaggaatacacaaaactaggcacatttgttttgagaaactgcaagatcattctattcatggattcccaggactttgttgcagactgtgggcaagagttacatactattggaacatgtgaagtgttattcctagctcatagcaaggtatctactgtactatggaagagtggaaggccatgatggcatgggtaatgagggagagttttggggtgggagtttgactatgaactgggaggaaaaaccttcaggagaatctgcattaattctttcatatatttttaacttaaacaggcaacaatgctgtgcctataaaaacctggcgataatagacagtctaaacctcccaagttccaacagatacagctttgatagcttgctaattggattgatactatgcttaatccttcagctgagtttttcaatccctcaagctcaagcttatgaatgattatcctttatccctctgctttgtttgttgtagctgtgggattgctagactatttgtcttgcattgctagtggacgaactctcccaaaaaacttatcttctgaagaatcaatcgatgagttgtttacaatatttgatgatgtgcgaaggactgcagtgagtacaactgacagaatcctgaacttcattggtgagctactaagattctagatagtttatgctctttacaatttacgctcttatccatggaatgaactttaagcaagtgtatttaacttttaagtacactgtagtcagtcattttcatactagagatttgtttggacaattgggcaggtaggctgttagaaattttgttatgcttgcatttagttcttcagaatccatggtagtttactgctagaattgctgtcaaattgctgctaattcattgatactattttgaattcattcagttgtatattcatcattggaagagcaaaggtttgccaagaatatgaagttgctgttgtatgttgaaacgtatagttgcactatttgttcttgagctgctttggttaaattaagatatggtttactaaagtacatgatatttattagaattagatcctgataatataatattgctgcaaattttgaattccatacatttgttcaccaacagtgccagatattaattcatctggaatggagaaagaataagaaaacatccacaatattgtatatatcaatcacatgagtttctaaagcaatactttgcaggaacaagggctgtattctgggatatgcgggactcgttacttttctccttgtaccgtgctagtgttgaaagtgcacgtatggagatgtttatccctactattgatcaagtaggaaaccatacttgagatacctggctacctacattttatccttaattttgagttttattaatggatgaactggaactatgttgtaggttcttgaccaggtatgtgatctgattgttgatgccctacgtgaccaagttgtgctgagagtatttcaagcatgcatggtatatatttttctatcaatgttccattgtggagtaaaagctttattcatttaaggtagagtaaaagcttatgaaatgtggatttaattaggaagggcttatttggatcctactggatggaggcccatcccgagcatttttggagacagatgtggacttgatgcatcaagatcttgctatgatcaaggtaagaatgagatttgagagtgcattgtaattattatcgagtgaagaaagagcaaaagtctctttatgtatccagcatattttatatttttcaacatgttgatatctcggcgaaccttaacactgtaacaagatttatttgccttgactgtgattttcttctaggatctctttatagctgaaggccaaggtttaccattggatttagttgaaaaggaggctagactaactcatcaaatactagacctatttgtgttaaaggtatgctattcctttctcttttgttttgcagaaagaaaagttctgcagtagccaactaaatgaaaatgattttcaggctgatacaatcattgacatgttaataaatgtaagtgatcaattgcctcaccatcttgaacttacaactactcgaagaagacatgtacatgatgcccatacccttcttcgagttctgtgccataagaaggataaaactgcctctacgtttttgaaaattcaataccatcttccaaggtcttcaggtcagaagaatattaattctttctaatctagagtttagattatctgtaattttgttagaaataattttaatggcaggccattgaatttgtccagttggtagcttggggaaaataatttttggaaattggctatattagttcgggaatggcagtttgatattcatgcactgccttagcaatactatatggtggtgccaaatgggtgtagggatgaaagtgagcaaacatgtagttcagggtgtgatttggccaatttcagctagagaatggaaattgagccaggatttcttagtgttgtaaccccatttcatgtgtatttaagcacatactaagtatgctgctcttgccccttatggtaaaagaagatgaagaagcctattttgctctagcgattatgtgtttctactcatatgcactttaacagcggtgcttagcatttcctccaaattaagtgctttccagttctatcagttttgattagggaatgactgctattgctccatttgtgcagattatgacgatatttctacaaagaacgcaccatcaaaagcacctatgttttctgacatgctgaaaagtacttctttcaattggtcagaaacaggacagcagagttttagggttatgaagaagaaactgcaagatacctggcagtaaaatatgtcttggagataatcggcttggtttgcacataacttttccatatatgtgcagcaggtacgtcataaaaataaatttcaaatcccataacacctgggtatatgcaaaagaaaaaatgtcagcactgtatgcaaaaaaaaaaaaaaaaaaaaaaaaaaaaaaaaaaaaaaaaaaaaaaccttcacctcctgtgctttcaatcctgcctaacatttgcactctcggattatttttcacgattgttacatctttcatgtttattgcacttgtaaaaacactgtgcaattcagctacatatccaggatggttcttacttctcaaaaggttggtattgagagcaacaaacacacatttctcctgatgcctctgagggcccacagcctttgggaatcgtctggccctgatagaaatgaagcaaaccaatacccaaatttagcagtaaaaggtgtagtaataatattatatggtacaatggacttgctctatgcatgatgacctccgtatattaaacagatattacctcacataatgtcatttgacattttgcaacagatgacgaatgcaaaaggaagttctaattgcctattttgatgagttggaacttggcagaactggacttattatacctgggactatccacctcctgggagctcaatatattccctgtcatcaaggaaatgaagcatcaaagtaagctactattacactagtacctctaaatgtatttccgttgctgctactatgtgccgaagtaatgaggatgcgattaaatcagttgtttttctcgaacacgagattaaatcagttctccgttctatcttgcaaggagcaaggtcttctgagccctagaactaaatcaccatgagggcagcaaccgcagcatgcatctgggaagtgttgctgatagttggaggtcagagttctcatttctgactggagcttccccagcgtgatagcattcattgcagaccaatgtagaagatttttctggcgactacaggaacggtgtcgtgcctcaacactgccagatcgtcggagaaaatctgcatgtgaactctctggcctagagcggcagcaggatcaagaggggaaaagaattgcttgtttactgtcattgcacgagtttgcgttcatagacgccgttgccttctgttctatgcctgcggcacattacgagaagcgacagcaataatcgttcgcgggaaagaagctgggagaaaaatgccactgatgtctcctcataacctgctactgtagtttttgacgtattgtatctgaaattctgaaattctgaatgccgtagtcaaactgctgcatgagaaattagatgtatgttttctgcacccagcgacttcatcatctaggaattccagtcgcaggtacataatctggtcctccaaggctccaacaatattatgctctttatgcacaagttagtattaccctctttatgcccaagttagtattgccgcttttattcaagagaaattatcaagttattatttcatttctgagagctacaacaaaccacttaaaaggttagcatgagacatgtcctaatttacatcatcatgacaaccaaggctacaatgttcctactactcccgaaagtatagtttagtaccctgtaaagtggctgcagtttgcttggtactggtacgaactacaattcaatttggctcatgtgccatccaattttctcagttttacgccgcatataaaatcaacagcaagtcaacaaccgttacgagaccgagctcttgcggtcacgggaggccccgcccggcctcgccgcggccgccgcccgcacggacagcgcgagcacgtccagatccgacagctccgtcgtcctcctgaccttcccctccctcacggggacccgccgcgccgcgtgcctctctctctcctcgtcgtcttcctccacctcatcgtcttcgccgtcctcgtcagccccttcctcctcctcctcctcctcgtcttccccgttctcctcgcgcgatcttttgccgccgatcgccacgccgaacagcatcggcttcacgtcgccctcccccgcttcctcctccccgccgccgtggtcgtggtcgtaccgcgacacgaggcgccgcacgccgtcgcagacccgccgcgcgcgtgccagctcccgcgccagcctcgcgttctctcgccgcagccgggcgttctcctcctccagctcggccaccgcgccgctcacccccgccgcgatccccgccgccccgcgcggcggcgacgacgacaccgcgggctccccgccggagctcgtcggcggggacgagatcggtatcgccgtcggtatgccccccgccggcgccgcccccgcgcctccggtcccagaccccttccgcctctgtatcccaccgagcaggtgcttctcccctctcctgaagcagtcgttggcgaactcccacctatccgccaccaccttcttgaatccctgcaccaacacacgcaaatctgtcggaaaactcgtcgatctaccgaaaccaaactgagattagagagggggagagagagtgttcagcggagggagacgcacgtaggtgttgagctggcgcacgaaggaggagaagttgctgtgcttgaagtgcttggggaggaggtcgcgggcgaactcggcggggcgccacaccacgaaggccgtgccggagtcgttccacgagatggtctcatcggtgctcgggtcctccaccatcgcgtacgtcttcgtcaagaacggcggcgtccccgccgccggcgacgccatgaagaacctgtgggccgggagtagcgctcacacgagaccggggaggagacggagaagaagatccagagagcgcaatttgcttccagagaatggaaagcgcgtctagaatgggggatttgggaacggggataggttagggatagggcgagaagcatccagcggattctagaaggttcccggcctttctgagccgacacgtggtaacgtttctagaaaatattgagtgggcttcggatcttagaggtttgaggacaagaccagcccagaactaagctttacacttattttccaccagattttccttgcgtatttctcagatttctagatgggaaaaccatgatcattttgcaattcaatatttcgattacatataagttgggaaattccttttcagaggaacttgacgatgggaaaaaacatgactactctctccgttacaaagtcaaaccgcttaagtttaaacaagtttgtagaaaaaagtattgttataaaaatatatgtaattattgatttgataaaactaatttaataatataaatattactatatttatctataaacttagtcaaaacgttttataacagggtgtacattgtaattcaacattccgatcacatataagttggaagttcttttaattagaggaatcacacattaggttggatgtacttgcaatttgacgaaaaagcattatcaggcaactgcaa

SEQ ID NO: 68212 - DNA, 39092 bp, Oryza sativa
  unsure (1)..(39092): unsure at all n locations
gaggcgaggaggaggtcccccggggaggccggcggcgcagtgacgtccccgacgcagtgcgcggggaggccgaggtgcgcgaggcgcatgcagagggcgcgcatcatgaggccctcccgcccgacgccgtgcacgaacacgcggcccccgcgcgcggccgccgcggcgagctcggcgacgaggacggggcgcgcggcggggtccccggagaagacggccgcgatctgggcgcagatggcggctgcgtcgccgccgccgctcatcgtggacttctgttatcttatcccaaagctgatgacgagcctccgtttgagtgggagtgtggtacagcttatggtcagcaagatcgtctgataatggatagcggagtgctgggaaacctgcgtccgcaaattggattttttttttacttttacattttttattaaaatatttaaaaactttaacaacttaacaaaattcaaaacattttaaacgacattggatgaagataaactttatataaaagttgtagatcccatcgagatctataaagtcaactttatagtttattactcttccatataaaatcatttagagcatcaaataagcattattagtttttttttagaaattgaaaccaacgaaaagggtctgaacataaataaaaattttacatttagatcccttaacgtctttagaaaaggcgatttttaaaaaacatccttccagaagacgtgaggcgtctatatttgtattccctccatcccaaaatataataacttttagccctcaagatttgtcccaaaatataacaacttctctatcaacattctcttcccaaccaatcaaaactctccaccgttcatttttttccacctaactccactacttaaccaatcagaatcttccaccattcatttctacctactttcttaataattatgtctaactctaaaaatgattataatatgggacggagggagtagtttgtaaatattttttaataaataaaaaatatcccgtaaattggatggtgcgtgcggcctggtcgactgcgctacagtttagcccacattggttgggccggaatggaagtacgtgcgagtgctgcgagccatattatttgggccggaactgtacgcgttgttgcatctttgcaaagtcgtgttcggtgacgttggcaaaaacccacaattcacaggagaactgctgcttcacagaaaggtactgtaacaattatgcaacatagcaccggtgcacgcatataaacgcatatacgaggccctctctgtcgaaccttgtctgatcatcgcatagcaacagatagacacacgattcgaacgcccacacgttctaggctgtctactatgctaccaccatgtatgcctgcaggttctcgtggaaacctcgtaaccgtcctgtgcggctactgttctcaacagtagatcagcacgcagcgaaacatgggggggagatctgtattctgacacgcccaacgaagcagcccgccccccgcatcatgcccgtacgtacgtgcactgcagccaccacttactgtaatactgtgtgtcacagtgtcaaccatgcatggcccccatatgcccgcgaggccgcgacgcgcgcgctcatcctcctctactttcatcgtacgcgaatacgcgatccacccccgcatgcatcgtccccacaccgagcgcgcggagccagccgccgagccgagctgtcccgcatgcagcgtcgcgtcgcgcggccggcaccgccgcgcgcgcgcgcgcatggtcccatgcccatgcatgggcgacgcagcgcagaaacgcggggggagcccagatcggaggaccatcggcgagccccggccgcagatccaatgccaacgcctaataactggatctaatctagtaccccgcggctgtcccccgtcgctgctacagcatatgaccaactcgctcatacgcccttctcctttcctcaacctcatcatcatcatcatcatcatcatctcgtcgtcattatctctctctcaagggaaaaataagcatatgcagtaatattatgatacggaatgcagagcataggagaccatatcttccagaggatctaattaaaccgggtgtagtataattttagtatttagtagagatcgtgtttgacggaggggatcttgtggagggattaaactaactaaccaaagttggaagcttgcaatgaatctaggagggatcttgggctagggtcgtggtctccgctgtcgacgccaagatgtactgcaagcaacaaaaggaaaagcacgagggtgcagggattaagatggagcaatcaagcaaagcgagcgcagctgcatttggctaatgcattggcagctgcaacgataacgataacgattattataactgctaactgcacgggctactaattgcacatggaatcgagcgtctgctacttagtatatgcaagataatgagatcatggagtgcgtaaagaccaattagcaacaagagtgatgagggtcataatgaacagctcgtgatcctcctacgatcggccgttgttgctgcaacttgaacgcaaaaccgctccaattattcaaggcgctaacacaatcattaggccgtggtcagaagggacagccttgcacccacgcaggcaccaccaccatgcctcctccgtgtgctcattcatgcccaattggtaattgtccaatcctgttctcctgtctgcaaatctaccgcctggtcatttttttctgaatttttgacagagccatgcctgcctgtctaagatttgccgttctgacaagatgctggattttactggagcagcgaaaagacggcggcagcaggagtgtgtgcgactgcaaacgaatcagctacagtagttggtcagtctcatgctgttctttgaatcccaacattacctgaaaaaacgtacacttgttactgcttctgttgtgttgttggtcaaggatgctggcttcaagctagctagactctgttgttgaccaccgccccttggtcagttaattctgaacttccaatcataggactaatggagaaacttgttcgcgacagcagaaatgcttgctaactcagcgactaatctgacctggaattcatctagaagcagtgtaatagcacgtgaagagttattgaacatgttatacggtcaagatgcttgttcttgcttggtccaagctccacatcttgattccgatttcccaatatgctattgtttcctagcattgtgctcctgatattaagctagactataaacgtgatgatcctgtactttagtaaaggattttgcagtgatgcattgcaccattgtttcctattctgtcacaagttactcatcacctgaagtcaaacaatgcactgtaagtaatgagctcatcaagcaaaaacatgatcttcagtaaacaatgacattgcatatcacctttgctttcttttcttcctcctccctagcatacacactacaaggaaggagctcattgtgtttggggtccatcttaatttatccatgaagctgcattttgctcagtgagctgtctgcattttgcaacctccaagatcccatctcccacgcatgaacagaagatgcacccaatgccaaatcgaaaagagcaagatggtgtattatcctatcttgtaccagcatgtctcccactgctgctacagcacaagacagctctcatatgacgcatcctctgaggattccatggacagtgcgcagcggctagcatcacatttcagatccagagcacattgcactgaagatttgtgttaaaaagggataatgaagctagatcacagtacattatactagcattagggtctgttttttttagacctacactatgcactgcacatcactgtcttgtgccggttttgaatgaatggcttcttgtcatttgtaaactgaatttcttgttgctaaaaaatcactgaagagagtttgatgtactagtactatttacagatcaccatgctgcaaaatgagctgttgctcagtgcaatgcaatatttcaaattgcttcaattatgcctgaacgagcgcaataatgcgagcgtggcagaatgttcaggttcggacagagtagtaaggctcaataattcgatggctgttgtaaattctcttctactgtttcgacagtgctgtagtaggagtgaaacctgctaacctccgaatctgcagccgtggccttttcggcttttccaacatgtttctgactcgcagcactgccgctgatctgagaaagtgtgtcaggtaagaaatgacacaagcagagagaggggaaagaaatcagcagtgacgaaacagctcacagcatgagagacagcgtgcttactttgaagctgatgaagctactaagcaatttgactgattgtttatcactagtcagctttaagctaagttaagcttctgttgaacacacttgttttataacgatggcctgatccaatgatgacaagaagtcaaaagccactagtacactataaaatactagtactaacagaaatgcttactatacaaaaccggacaacctgacagaagatgtatttctagatagtacagtatttgacatggtcagaatggtaggcttaatgtaaatagtctgcttaacgtaatcctaatatgacgacatgtaaaaactgcatttgcaaatctcgatatcgagtagaactgaagtataatccaggtgaaatgaacttacagatgactcatgagaactactactgaacctctaccaaacagagcttgcacgaaacagtgctatggatctgtcataatctaatcagtatcagaacacaggaaatagaaaaataactgcaattggcattagacttcaccttccatgatccatactgagtaacctaatgttttgacacacagggtctccccatcttggtcaatcactcaaaattctagaagcaatcatcgatccaagtgaggcatccgagtatacaaatgcttactattgctccaatgttctagtgagttgccgtgcagcaaaaaaaagtttcagtgagttgaatccgaagtagtcctgacgaatagcatcaaggccacatgtaccagaaccctttccagccctaaaatagccgggaattcgccttcctgacaaatcaagaaatgcacctacagaaactcccaaatttcaacagaaaaataggttcatattcagaaagtcctgacaaagagaagcctagaatggaatgcagaagtataatacttggaagcaaatcagaaagattgagaaaggatgtatcaacaaaatttaggcattctggaacagatcagcacccttctagagagagagaaaaatctgatgcacattcatcctagaatgctaagtccggactcaacagattcaggaccattagatttatgagatgcacagctaacatgggaaataaatcaaatgatcaaccacctcaggtcccattagaggaacaataatagctcttgagatgctccacaaggtccacagcaaacaacttgtgaccccaaacagaagcacaaattgcccacatctgaagttggacaaaatccagatcaggaagcagaagatgtgaaaaactggatgccaggttttaaacaaatgaatgattttttttttttgtatttgaatggaaaatatgtaactgcagttccgtcgacctcccagataacgaaaaatgggaggataatttacactcagatgagactaaaatttctatcatttcaatgagcaattgagtggggggagtaagaacaaatctgatctacactgaaagatttctacaaaaggtacaagctaccgggcctgccacgaacaaccactgatgtagagatctcaaaggaccactggtttgattatgtacaacgctggtccatgtacaattcagcaggagcaccaagcatgtgatgtcttgtaccaagtaaccacacgctgggccagcatagctgggtgcacgggtgcttttcttgaggccatgtgaggtgccaatgctgcgtttacttccatccaatgctcaaactattcactgatgcactggtaaaccgaaattctggaaatacctaatcctgccatcccatcctgcagtaactatcacttgaccccaggagtttgatgttccttggaaacagttccttaagagcttgaactgtgactcgtccaaatttacactggctgtggtagatggtagcatttcctctggccaagttgctgaacttttgcaagaggactcaatgaagaactcctggttcagattgaaaataccaggagcagcaggcgttgacacaatttttttaatggaagaatcctttccacagaggcttgaattgtatttgatagccttgctcattgaccagaaagtatctccttgtggtggtaaaatttgggacgacaacggaactgggcttcttggttttgtgccattccatggtattgcaatggctgcattgttggaccggaaatgctcagatgtctgtgtggtttttgcttgtttgcatgcacactcatactggttttcatggctccaaacataaacgttggagtcttcactggcagaaattatgtgctgcccttctggagtgaatgttgctgacaactggcaagaaccacttcggagtcctgatagattagcaaaaaaaaaaaaaattatccatccgaatacccaggaaatgactagatagagcagaaataataaacgagtatttgggtgtaccactataattctgaatcacattggtcccatcaagtattctgatcttcgaatcggcagatgtcaccattagtttacttgggttgcttgggcaaaactgcaatgggaatgaggaaaaaaagagtcggaaggatttctagtgaaaaaggactgatgaatttattgattacagcatgcctcttccttgcccaagatgttacctgaaagcctgtgattcttttgagagatgatttcttctttccattgagagcaatttgtgtttctagcttcagcagattgtctgatccaatgcaaaacagatgaaataagcataagtataaacacgtattctgcctatcaaaaatatattttaaagctaataatcatttggcaatttagtgtttagtactaaccagatatttcatagaagcgacaatttccagtaatagtaccaaccaccactccctgcaagatattcgaaaagaaaggacatcagtatcacaaattactgacgcagcaagttagtcaaaacagctaagatggccgctgataatcatacctttccaccaggccggtaacaaactgctgttactatgtctctaatatccacccagtccacaacactgcttctagtaatgtcccaaacacgaattttgccatcaattgatccactaatgaagagattctcgtcagctagattaaattggacacaagtcactgtaaaacaagaaaaaaaagttagctcaaatttatagatgaaagtgaagacctttgaggcagctaagtaggatcacataaacctaccaaagttgctatgtggataaactctgatgcagtttgcatatccaatttcccacatgcgaacagttttgtctgttgatgctgacagtagatgctgtaaagtagcaaatattaattatcagaaccaaaaagtacagcataaggaaaaacgcaaaggaacaattccaatacatggacaaaagagcatttcattaactaaccttatcgctcgaccatgacaaatcaagcacatcaccagagtgcccacggaactcatgcactggttcctctgagatctggaaaaccatcgttggaaccacaatacaagcagaatcggattttttcaggccattgatcttcgatttcttctcgctctcggcattcacaggagcaagcccatacttgcgccgcgcttttaggtagacgcaagaaggatcatccagtggaattttgcagtcctcggactgcatgacagcccaaaccctgacaactccatcttctccaccggttgcaagaagctgcccatcaggactaaacttcatcgtcaggatggcaccatcatgtgctttgatcacttgcccctgatacacggcggacaattccttcgaccgcttccggtacgagtgaaccttgattctttcatacctcccagccccaatttgctcactatctgaagaactggtgctggcttcatctgctgctccactatccacaacacaagcactgacgcccagcctccggagccacccatttctcctcctgtcgatcgtcttcggagcaccagaaggcttgccattgcggctcatgagcctctggatgaacgacagcgagctgaagctcctgctcgccttgccggatccactcacggagttgtcatccgacgcgccgtcgtcgtagctcgtcgtctcctccgtcgaccagctcgacatggagcactcgttctcgtccgactgcgacgaccacctcccgatctccgcctccgccgccacctcaccctcctcctccacatcgcccacgacgtccgcgaaatccgcctggcggaggctcgggctgcgctccaggcccatgcttcgcatgaaccgctccctccgctgccgcacgctgtcgagcccacccgaccacggcaatgccgccgccggcgacggcggcagcagctcctcccgcgtgtcaaagaacgcctcttcctccacctccatcctgctactgctactactactactacacctcgctaccaattggcacccctccatggatcgttgtggcgagcacggccgctgcaagaagaagaagaagagagaagcggcaagagggaaacacatctcagagccatgtccggggagtcgtttgcttatatatataacagtaagctaacaagaggagggcgatgaattgcatcagcggcaactgggtgacgacgagaaagaaagcgcggacgcggggggagcacgggagagggaaactaaactagcagggattgattgatcgattgattaaacaagaggaaattagcaccaaatccccaactattcaattcccccccgaatctctcaaatcccgcacctcgcatggcccaatcgccccgagcaatgcatctggccatggcgatccgaccaaccgcgcgcccattattaaagcggggagacaacagcagagccaagaaacgttgccaaaacgaaaaaaaaaaattaggaataaaaattttggcccgagaagaggaagcgctgaattcaccagatcatatctcggaaggatttggcaacgttgcggataaacaataaagaagaaggagatatctttttttcctcggcaaggggaaactcacctgggcgagatggaattcgcgcgcgcgcacgctcgctctggaatccaagaaaaggcttcggttttcgccccctcagggatgctgccgccgggagccccgcgcgtgttcttggctggtggtcgcggcgcgcaagaacagccgcggcagcatcatcgcgcgaacggggagcagctctattattaaagaagggattggattcgtcgagttggctagaaatcaaagagaaagctggaagaaaaaaatggagatgggagcgatttattaggacgtcgtggagagacggccttggggggggggggtcctcgtcaccatcaccatcgccagatttggaagcggcaagataattagaattttaattctggtaattcacttctgctaaaaaaattataccagaaaaaatactagtactggtagtggggaataaagaacaagtagtaaagaagaagaacaattatgtactgcctgcacaattaccacctccttttgcctaattgctgcatcaaaattgcatctttttagttcttgatgctgcaaaattttgcttgtcacttctgattaattattccacagtccctctcactccagacgattctgccactggtccagtgctgctgctcatgcgtgcctgcccagctgccctttttttttctcatttttcctatatttttttctctctttcatgttagtggagtactactagtagtataattttctaccacctctctttctttctttttcttcgttttggttgtcccccaataggtgaactgtgcagtgcctgcatgagcaataaatctcccagctctaggtccctagtctatagatcccctaggcctactgcaaacgggagcgtcgctgatgcatcactccgatttgctcgtgtaattaacccgcctcatattgcatccggctgcgcttctccggatcttttccttgctctgctccggtgagaacttgatgctgcagtacagtggttgcatacttgcatcgtcgcatgtaaggaggagtacttgttaccactggaatggtgccagtaaatggtaacaaggagtacttgtttggcatttggcaaaatcaattcgcaaccaaacagtgacgcaacgcaacggccggagaccggagcagtgcttgcatcgcatggaacgagcaaaaaatcctccaaatattcgttgtcacagacagagaatgcgcagtgcagtgccggtggaaaattttacgtcccttgttttgaaggcaacctctgcaattacttactgttcactaatgatgtactgtcctggatggatgtgttcagagtggctacagcttgatgcacctaacacgtactagtgaacagtacactactcttggtcccctggcatgatccaacagtgtaatttcctttacctagtcacagaaaaaaaagcacacgcaaattaaattcgggtcttttaatttggccgttccttttcacttggtctaggtcaagcggtcagctaagggctgcttgttctgaatctgggttgagaagagatcaacttccgtgaacagatcaaaaagactctccacctaatgactttacagcggatgacaaatcataaatgctactccaaggaattgatgcatgcatgaactaaaccaacccaagtgacctgaagattttcgccttacaagagggtcaatgcgttaagcactcgagcagaagagaagtgacgatgacagaaagcactaatcagtcttgtttaagcaagacacagctgatggagatagagatgatgagtagatttgtagacgtatccatctctagctaaccccaacaaccccaattgttacatggatgatttgtggttgggcaaaagccaagatgacaacggacaactcgacgacggcaacaaccggaggtgtacacgtatgcgtctcctgctttattttggacgacgtatgtatgtacgtgtctggctatctagctaagctgtgtgtaaattcaggtgcactgatcattatattagacgaaagcacaagtggatcattagtcgattccactgaaacaaacattcaaactaagggagtactaatggctaactaggctttgcattattggtggtgctagcttggaggcctataagtatgtagagagatttgttttttcatgttccccgagatgaagcaaacatggcgtctttaaacaattcagctggcgacgtcccagcaggctatacttaatcatatataaactgagctaaattcgagttaaatactcttctccggggcatctgccactagcacttggctagcaatggtccaattttagtacgacatatagaatatgcaagttcagtctcactgtgataaaggaagaagatatgatacctacaacaatcccgcaacttcttcaaattcacacaaaaaaatgttttacaaattaggtatgatctcactaaatgcaacagtgtctagtttgtccgagtttgccggtcatgcatccccctcaaaagatatatatggccctttaaaggaggcaaacagtagtagtattcagacaattatatgataattattgcatagattattataaaatgatcactacaggcctaaacaatccaaagtttttttggataacctaatattgttcctgttatattctggaatccgttgtgccattagtatatcagggcatgatcagtgatggcatccggacttaatgtataatacgtgttccttacattagtatttatattttcttggcacttagtggcactatccttttaaattactttattggttgatgtggataattccttgatgtgtcaaccccgaggtagtaacatattatcactagcaccagtctatattgtcctactattgttgacagtgtcacaagaggaaaatttttctcaatgttgatattttgtcctcttgcagccggtgaccacccaactgaatgggcagacatataggaagaggtgtcatcaaatcaatcactcaacagcagggtcagcatgcagcagagaaacatatcgttccaaattaaccactggtttgcttcagattttagatacgagaggattgggttggactgcacctgatagcgttcggtcgagcgatcactaccgtttgaaaagaattgggtgaaaagctaacatggaaacatcaacatgcacaaaacaagatggagaaatcagtgggaatcagcttggatgtaacggttgattccactgttaaagttggcgctcggtgtatgtaattatatgtatgcatatatgcaaacagtgtgcagtttggcatctcaacatcacaagttttacctgttgctaatttattgtcatgccttcgtacaaaggtcacccgaatgttattagcatccaatttgactgttttatataaaaacaaaatgccacacagaaagtgtcaccggatacttacccatcaccgctccaaacatccaatggttgattgctaaacttctctttctttcagtggacgagtgatccatacatacagaaactgttcattgaaaccggtaaaaaaaccaactttatcataggaaataaaacgaagctagtagatgatgtgatggatggatgatggatctaccgctgtacataggactcgcaagatttggcaggaactttctaaagtgattgcacacaatgattgtcctcacatgtcaacttgcagggcacataaaagaaagtcatgggctacctagctcatgagctcatagccgacaccgcggagcaacggagggggggtgcaaagtgaaaagaaattccttcgtacacgcgctgttcatcacggcgatcgtcggtaaccacacgcacaaaatgacgcccgatcgatcgatcgatgcatgcatgtgttgtgctgcgatgcgatgcgagcaaatgagcaagattgatcgatcgatctgtgtgactttaaaggctaaaatcgtactgcctgctctgctctgctaccgatctatccaacgcaattgtcgcgtgaattaaggggaaaaggatcataggatgcctgctgtaaagagcccgtagatgccgtgctcaataggggaaaaagattatactactacacatcaaaggcatgtaccgatggaattctcgggtgtgattgctcgtacgttttcagaattgatcacccggtgtgccgtattcatagcggatggggtgatggtacatgcatgtgtagcgtattcttatgcacgatttcagctctgcagttgacttggttcgctagctagctagttggctggtcgatccgtagacgagaatgccgccgaattgaattgaattgaatcccaagagcaacgaatggggatcggaaagatgttgcacttgcacacaggttggcacacacgacaacgacggcccgcccgggctagtaatactgatgtggtcatctttgccgtgtcgccgccgaccaaattttcagagtcagcgcaagcgtaattagaccctgtggctttctacctgttattttccgtgagtcccagagcccatcgagtgctctcaattgagggatgtacgtactaccagcggcctagctagctagagatagtcgtgtcatctgactaggaagtttataccgtgtcggcgtaaaaaaccaaagtaatttcgggaggctctgtgctgaccacgtcgcctgcgcaggcgcgcggaaacgtgtcggttccaaagcatcgcaaaagcgatactagaacacacgtctccaggcagcccatgccgtgccgcgccgcgccgcgccccccgtcgcgatctcccaagcctcaagcgtttcgccggggcggccggcctagtacgcgacaagcggacaccgcgcggcgcggcgctgcggttggggggtggaaacccaacctggcgtggcgaccgctgcgtacgtgctatccggccaaaatagtcagcggcttaactggctgggtgaaacagagttaataaaaaaaagaagaaggggcacgcgctgcacagtagacagcacaggagtaaacggttttgtactgtgcggtgggggtgggggcggcggcggctgccttgccgtgtggtgggtttgcagttgcaggctttgcttgcagctttgtggtgtgccttgcctggcttggctttgcacactggcctcggtaccggagccacaagcctggggctaccggcaggcgatggggcgccatgctgccgcgcatcatgttgttccgttgcaaagcgaccggttttacaagcacagtacagtactcctcctactcgttccgatgcgcagtaggttttggattatcgaagcctgcagtaacacccagcgtcagatccgggattaacatgggcatttcattgtcatgctcttaatcctacatcaagagaaaggggtcatgactcaagaagagctggcctcatttcttcctacattttgacttcgcaagtgatcaagcaccagtctgactttgcagtatataatactataatagaagcaaagcattaataaactgaggtgctaattaaatacggtcataataaaataggctagtgggaacctggaaaatatatgatcacattgcatcccatgtataaataaacaactcctcaggccggccctcacacacatactccgtattaagcaagcctaatgtagaaatattctgtgctttgcgtccctagttgctccacgtactgcaagccatcccatcctcattaatttacaagacaaggagagagtgaagaggaagagatgcatgcacactgtacccatatataactgcatatgggttcggcactgtcgaccctcctgacagcaaatcccatgaactctcgatcaggagcttaattactgaaccacaatatatacgcgcatagatcgtaatgctgaattaaactaacccggtttagattgagtcctaggaactgcatcgccggctccgaggttgcatgcgatgtacctcgttatcgcagcacacgctacgtgcgctgcactgtacagagcacacagcatatgcgatcgagcagctgacttgcacgtatgctgtgcgcaatttgctaagctatagataaaattgcatgtatcccagttgtcaaaccgcatgctaacattcgcaagtgtcatcgtgtcagtgacgtgtaggtatctggccatcctattaagaaaagagatctactaactgatcgagttaacaaatagcaacatttaaccgcaccttcctgaatcccgatctgatcactctgtaaactgtcatgatcgagttgctattccagcatagaacacgcgggtatgcgaaaacagagccaggattagcttatgtccagatcacatcacgccgaacttttcatgccaatacggcggtctgacagaggaagcatgggcggacagaaacgagaaatccagccgatcgaatcgaatcgtagtccctgctcatgtagggggcctaacaaactcacacgtcgcatcacggtaagttaattaatccgagccaagaacccgacaaacgggacaccgccaaacggtagcagcctcgatcccggcgcgcagtttcctcccgaacactttgtcggtgcccaagtcgtcgacggattatttctcaaggaaagcgagcacgacacgtacgtgcacgcgcttcggctgcactcaattaggagtagtataactgtgttgtcgtagtaaccatccaacaaatttaatctagagccagagtagcatagtattagcgcacgaagctgcctggcacccaggcatgggcgtaaacaactcgcgtactctacagtctactgcaccacgcacgccgcaaggtgacaggtgacagagcgaaacgcatacaaaaacgccgcggataaaagtgtgtgaaggacagtgagtgagagatgaagacacatgcatgggcatgcaccgtacctacgctagtaatagtggtggtagtatactgcacagtaggtgtgtcgttttgcagtataaaaattgtccccatacgcactacgtggcgggacgcgcgcacgtacggactcggcgagctcatgcaagcggttagatagaaactatagctacgagtgtagagtatgtatgtacgctccaaacatgtgccttttttttacttcttttgttttaaaataaacaaacttaatattaacaaatatataaaatagagcatgtctaataataaatttgtttattttgagatggaagaagtagatgatgagagcgcagactcagcagcgagcgatttctctcatcccatctcagtttttggatgcatttatccgcatgcattgatgcgatatatcgtcgatttgggcagcaagaccggatcgaccgtaccaaccgcgccggtagcggcaagtaggtcgtcgtcgtctcgtcggcatcctgcctgtacttgtcatctggcatctgccattgtcaaaatgttgtatgttcatccgttgtccaagcaccaagcgccatgggatcggagagtagctagtataccccacgtagtagcaagttggttccagctagctagctggctggctgcatgtatatagtcctatattatatagcgatataaacaaggtgcgtgcatgcacgcaccgatggatgcataaatacagtatgctggtgtagctgagcttcagatatggtcatgacataaaagacccagacgtgtgtgccggccgccgccgagctaattaagttcagtggagcgtccacgtccatgcccctggcgcgtaagtacgtaccaccagatagagagggacggccggccacggtgtgaggagttaattgggaatcatttggttggttgtttcatgctttgctttggtagtactccctcagtaccatatcaaatttagatggaggctacagaacgatctaccgttccaataaaatagataacatagatatcaaattgatatcatgacatcagctgttccattgaaatgattaactgttctatagtatttctgttaaatttatttttggcttatctcatttatctaaaataagtcttttttaaaataatcagtgcattggaatttgtgaaaatagaaaatagtgattgcactagaagtagataaaataaaaaatagttgcattgagattagataaagtagggtattctagtcttttgatgtttctttagtatgtgtggcagtgagggatcgatgaaaaataaacttattttgtgacagaggtagtagctacgtaatacctttgagatggagatgacaccagcttactgaaaaaacaaccgattatgacagttaatattgtcacgcattgtcaaatacagagatcaattaaaaaaccacttaaaagaagataagctatactgatagctcaagtaggcatgcagttgagagacaccacagtgtcccaacacccaactgggcctgatttgccctggttgtatttgattgttttctcgtgcgcgggccaggcacaaaaaaaccaccgtacgacggtacaagcaagacgaaggtcggccatcacctttgatgatgatcgatacatatgggccacacccaaaagaggacaccgcacgtcaatctcgaagctacgcgccagcagaccggcaatcatatggcatcgatcagtaccgatcgattgatcgtccatcgtccagggccatggatgcgtatatccatcctaccctatatatggagttttggccctgcccttaactcggtagagaacaaatcgccgttacatgccaacagtgtcgaacagttcaggcactgtgcatgtggtgtcgcatgtagacatgcatcgtgtagtagttgtactcgtaaaaaaaaattctagcaaaatatatacttctttcgtcctaggataagtcatattaatttcatactaagtttgtttagtactccattttggaaagaagggatcaagggcgtatgtgctgggataacggtgatgaactaattttggtggttttgtcagcctctgcctccattactttggggtacagtggcgcgtacatatccttcaggctacatagttaacgcctatctgatcaacttaactgctactatagcttactcctatctaatcaacacctataaacaaatgcatgcacgtggcaactgcgcccctgcatgcgggcccaatactagttcagaacttgtctagggcttttggcctgttcgttggatgcaagctcgccagtgacatgtatctatcttgttcgatcgatgcctcgatgatcaatagttccacgatcatgatcttttcgcctttcaagtaaggatccaatgagaaagaacaatcacgtatggatagttttatgggcttctcggatggttattttcgctaagtaggccgtactataggactccatgggctgaaagttgcatctttcaattcggtctagacaaaaagaactccatcctgcagatggcggaataagtccacttgccgatcctcaactttaggtcgagtctgtatgacatccctaatccccaataccagaaatgtctactcctaaattgttcaaaaccgtgtcaagtagatcccatagcagtatgcatggatggtttcgctgacgtgacatcctagtcacaacaagagaataaaaaatatgtgggctccacatgtaagtgacccaaccacatgatattttcgtagccaatccaaatgggcaagctcttctgcgacgactctgccaccaccatcaccaaggctctccgccgctcccatgcccctgcgcgcccgttcctcacttggcccaccctgacctcgtgctgggccgctgtcatcacgctcgaggaccaacaacgtcgccccatccaccggatctgggagcatggaatcgcctggaaacccccctcccaactcttgctcccaccccctcgtcttccgccttgaccacactgaggaggtcgacgctgatgacaattgcctcttcaccgctgccaacaagcccggtgagcgtgacctcaggcacaacatcgcccgcctcttcgctgatgtctatgccgcccaaatcacacgccaaaaccagcagccacctccccaacacactcatttggtcggtgcaagaacaatggcgacggtgacgaaaaggtgctagagctctaccccaactgtgcccgtggcgagggccggccaatgcccgtgaccttgcactgccgggattctacatcgatttgtactgatggtgtcggcctcgccaccgtcgtcggccagacatcagacttgataagaaaagagaagaaagaagaggctaacatgtgggccctttttttctgtgtgttgactaggatgcccttttttctccctatagattctaaattgcatggttttgtatagtttaggggtgaagatttctgatattggagataagggatggtaaacaaactcgacataaagttgaggactgacaagtaaacttattccgcagatggccgagctcgtcttgccaatgtgtgggccgaacttggcctcacgtagctaaccatgaaggaataagtctattttatctttcttatcttttcacttcggatcgaatcgtctctctcaagtctcaactataaaactagatgtaacatctccaacaaaatttgattgtgaatagtgtataccatttacactaaaatttattattttcgtttcttgtacaagttgaatttatcttttttttttatgatttcttagatgacatccacctccgaacctacggactttaactaacgaggggatatcgtgaatagtgtataatgattattttccatggttcagtgtttttttttttacaatttgattgtgaatagtgtataccatttattatgtgttgatgacaaatgacatgacttcttggatgcttttttaataacaatgatcgctatactaactggtataatgaatatcgagttatctagtaactaatgagaaatagtaaatgcaaatacttaatatatattggatggttgtgatgaaacatggaaatgatccaatgactcctattttgtgggtgtgatgtaattctatgcatgttaagcttttagttccaattatataagatatatagacaggattcgatttgttacataagttcgggaaaagttgttttagaagatgatggcacgctatcctgtgtttctgtttacagaattcggatgggctttttagatgggcctacacttgtagtatcggttgggccgactttccttgcctttctgtgaggaaactcgcttctgctggcagctaggcaaagcttttgcctctaaccggtaaccggcacggaaactcgcccggcggccagcgcggagagccggagagccaaatcaggctcgtcttcgagggcaagcgggcaggcgttcagcgcaaccatgcatgcgcgtgcaggtggcctcgttagttcgggttgcgctaagggcaagttttatgtatatcatgtataaaatttagatatgtatgaaattagatatgatagtcatctctaccatataatccctaatatctctaacactatcacatgtttattgaagcttgtgtaggggctgccccttgcatgagaggtgactatttctttctcatccttcttctcttctccaccttactatttgggccctgtttggaatattagcccaaggctaattttgagagctaatgtttagtcatgaattggtaggctaaacattagcctagggtggtatgtttggatctatgggctaattcaaggctaaaaggtggagagagagtagaaagagaggagagagagagagagcttccccacacaaaattagccccattagcaccccttggagaggctaatgttttgaggggggctaattcactttagcctcaaattagcccacctgtttggatcattgagggctaattcagggctaaaaggtgggggctaataattagcccatggaaccaaacatggccttagtcttatgtggcatcttggggcttgtgcttggatgtccatagtacgtgccctaagagcaggtacaatagcatgctataagccagctataaatatattttaaagaggtaaaggaagatagataagagcagcgggttacagatctgtagccagctgcagcatggactccaaaacataatgtgtgtatgataggtggaaccagtattaataatatagtaatcaattattatatgaattggctattacattagctataaatgatttggagagtagtgggctatactattaaacttgctctaaggcaaccaaatgttgatggtagcgtctactagggctagtttagccacgatgggctggctaagcacgcttgctaccttaagcatgataattgaggatttgagggatccaaacttagttcatccaatctttcgttggtttctgaggaaaattgctagtcattgtacccaaatagtttcacaggagtaactacaaggtttttcgctagaattatattctttttgggaaagatggagtagttagtaacttgaagagttcttagcactgtagcatagctcctcgatgggggcatcacatccatacctactgaacggtaagtcggtagcccaatccaactactcggccggtcgctcgcccccacacgatccggcgatcggtgccccccccccccccccccggctcgcgctccagacgcggacgtgccctagtggagagcggcggggcggagccatcacgctgcggggccctgcgcgcactaagctagcgtcgcgcgcacctgggctctctggctgtgctggccgcgcgcgggctggaggcgcgtcgagactccagagcgaaagcgacccccacggtgccgcgcgccgcgcttgacttcttcccgtagccgcgcgccctctggcgaacgaagagtcagaagaagccactagtagtacagtagtactccgctggtttcgctctcgcgcgcggccgcgccgcagagcgtacggtgatgcgccatgcctccacttccaccgagagctagcggcgggaggaaggtggcgcggtgcgtggtgcgatggagacggtgcgtgcgggggtgccggccggtgcaccagcttttgtcccgtttgacactcgcgaagtcagccggttcattcgtggtctccagcgtacgagcaactgtacggtctccgttgctgcgtgctgctgcatgcatggggtgaccggctcgatcttgcacctgtaacaaatcggcgacagggggcaatggatttgttaggtggtttaccgtcaatccaaaaatcagcgattgaataccactactacttactactagtatgatagtatcgcactactagctgggagggaattaaccacaatatagagcagttggacggtttgtacgatgagacgatgatgtgttttcgtcaaagaagacattcttgcgagtcgggtcatatacgcggatcgtggtctgatttgacctcaccggcagctgcgcaatttcttactacctccgtctcaaaataagtgcagtcgggaatatccgtgcccaatgtttaaccgtccgtcttatttaaaaaaattatgaaaatttttaaaatatttagtcacacataaagtactattcatgttttatcatctaatagcaataaaaatactaatcataaaaaaatttcaaataagacgaacggttaaacgttgaacgtgaatagtgtaaaactacacttattttaggacggagggaataatttgttactcttacgtcgcttgttaggactaccgatcggtagatcaaaaacgggactggatgcggaagtggagatggtgaagatgtgaggtcaggacggtgacagttgaagacgcggtccgatccggtgttgaaatttggagcattctgtcgggcgatgactcgttggcttctagcgaccaaccgaatggtggagtgctgagattaattaaaacaaggaatatgttcttctctagattgcgaatccacggtgacttgaatggtaaacaaacaaaatacgcaccattagccactctcgtggacatttgattcgtcatatacttttacaattgacagttccattaatgaagtctgaatatagtgcgcacaatttctcctgtaaattcagaacgtttgcatcttactttttccaaggaaaaaaagaggaatatttctcctgcatcctctccatgtttggaacaactcctttttttttttaaaaaaaactctagttatattcatgaagtctgaatatagtgcgcacaattttcacttatcttctgtaaattcagaacgtttgcatcttactttttccaaggaaaaaaaaggagaggaatgtttgtcctgcatcttctccatgtttgagacagttccttcgaaaaaaactcccacatgctactcaagtacttaatttgaaaggaaaatactctaatagtgaatatgtttacagaaatggttggtgctgctttgatcttttctacccgttttcatcagatcatcagacttctcctaactaccgctaaaactgctgattgctgaaaagttggtttcagaaatgaggtcgctcaaagctatatagttgattgagccatcaccattttgtccttgttaaccagcttcggtgcccctctaccgctctggtcataagcccatcatcatactttcactaattaatcccctcacctttgcaaccgcacgcacgcatgtgagttcattcttgagcctgttcaataacttcaactactcgttcagattcagattaggctgattggtgcaactagacaccgagtcatgacctctactttctactgctactttccagtttccactaggaacattccgcatgtctaaaagcatagtttctctcttttgttttcgcagaggatgcaatccgacttatcgcgcaaatccacccaggcacggcaaataaggtctttttccaaacattctcctttcccaatgatcggacgtcattgtgccttgctgctgcttccctgttgttttgtgcggtaaacgcagcttcctgaactcaactgaaagctcctaatctcctatacgaaacagtggcgcttatgtatcttcagatcgaccaacttgcccttcggcgctcgaccatcacgtcggaccaaacgccgattttatagccgggaaatccattgtcatcttcccagttcgctcgtcctcccactactagcttgctccagaacatccaatattcctcctatcgccacaacccacgcaatctcccaaccagttagagacaagatcaaaagggaaagcaagacaaaacggtagggggagaggacgcatgccgcatgcgatcgaatgtcaaaaataaataaatattgtttaagagacgcttgtaaagatatgaggatggtggctgcgcctgcgcgatgcaagtgacaggataataaaattttggaggccgtcggattgaaagctgcagttggcctgcctggaaccgaaaggcgagggggaggcatggatcatggaattccatattccattcccgcggatcggacagagatgttggattcttgcgatgggagcatcgatccactgaggctcagagatcaggccagccatcgtcaggtgcagggtgctgtggagtggaagcgtgcagtccacgactaattgccgcgcggacttgacatcagatgggacccgtccccatgttgttcgtattacagtatactcttggtttgttcctggattgatttgtcgctgaagcttgtttttgacagtggtaaagcatagtgagatgaggaccaagcacagggcatccatgcattacttcagtactgacgggtacagcaaagtcgtctagtaaaagtcgttgcctagagcatctctaatagattggctattttcagctctccaaatgctcatttggccagttatctaaaaaattggagagttaaatttgccttttactccaactgtctctccattcacattctccaatttaacatcgggtcccacatatcagtctctcattcctcctccttcctctcctttcttctcccgttgatggcgcagaggacggcagcaatcgtggccagtgacggcgcggagggcagcggtcgcggctggcgacggcgcggaggaaggcagcggttgtggccggcgacggcacagagggctgcggtggcagccgacgatggcgtggagggctgcggtggcagccggcgatggcgcggaggagggcggcggtcgtggccggtgacggcgcggagggcggtggtcgcgcctggccggcccccatctgccgccatttgggctcatcgccgccatacaccgccgctcgggctctgtccccatccgccaccaccacctgccgccgccgccgccactcaggttcatcgccaccatccgggctcgttgccgccatcctctaccgctcgggctccgtccccatccgtagcagtcgtcgccggtggtagtgcgcagatggcgtgggagccggctcgagtaggtagtacgggtgagagaaaaagcatctctaacgtggggcccatgaatggctaggcaatttgggctagccaaatatggccattgaggggaggagtttggccggtcatttggctcagccattctagtagagaggttgttggagtgatattttttactaaaatggctaaattttaacttgaagagtctgttggagatactctaagtggaattgagaacatggcacgcttggatttgcatcaaacatgtgactgcaatataagggcctctttagttcccaaacataatttttcacgctgtcacatcgaatatttagatacatgaataaagtattaaatgtacaaaaaataacaattacacagttcgtcaggaaattacgagacaaatcttttaagcctaattacgccatgatttgacaatgtggtgctacagtaaatatttgctaatgatggattaattaggcttaataaattcatcacacagtttcctagcggaatttgtaatttgttttgttattaaactacgtttaatactttaaatgtatgtgtgtccgtatatccgatgtgacatgcaggggcaaagttttttttgacaactaaacaagccctaaggttttgttcggcatcaaggtttgagagctaattctttatgcacgtaacacggagcgacacattagcatatgattaattaaatattagctaaaaacttaaaaaatgattcatcggattttttaaagcatcgtccagttaggtgtttgcgttgaaatgtgtcccgtgtcggagcaatgccaagcacccacttacaacccatagcaattcacaaaaacgtgcatctataggaatgttgaaagttcccatttatcggatgttaaggtaaacaatactccttccatccaaaaatatagctacattttggaaccgatagagtagggggtatcgattctaactgaatgattagacagattatagacagaagaaatcacttctctcttataaacgagtacattacaatttcggtcaaggttttttaacaatagtttaattttggactacctctaatataatgttttcaattatacgagctatgtttacctagtttgcactttggaccacccactctcaaattctctcttctcctctagttctccattgtatcagcgctaccgccgatgacccctccacccgctgctcgatcctaccagcggccgtggttgcactcgatcctacccgctgctcgatcctaccattgtaattttgcatggagctaggtttttagaaagagaatttaatttgctatgtacgacttttgtctttgtttgatatataaatacgatttttttagataatgggttaaaccggactctacacccaaagaatatacacagcctaaatatataaatacgattaaatttgtatattaccagtgtcgatcaatctttatcgtggtaatatgaacttggcaagataaaatgtgcacgcatttcatttgtttgtttaacgtggtaacctttaagcctcgagcaaacgtagcggctcattttcaccttctctcaaaagaataaattagctggccagtatagacaaagataatgctaaattggacaataattagccagacaggcagacaacccaagtccaagctaggtacacacgctgatggttcctgttgtatcagtcatcacacaaactccaacctgtggagttagatgacatgcgattggactgtctactttgcacttgcccccctccccaattgacacctcccaactattggagttggagatgctcaagcataactatttcaaaacactgttatatccacgtacccatccgttcttaaaaaaaaatcaaactctagaataaattaatctaaacacattttagagtttgattttttctgagacggagggagtaaaacgttgatactcccaccagccagctcaccttcgtaccatattaagttcatttttaagtctcttatatttgtttcaaaataagtttatttttaagtaatcattgcattgtagtgaaagtatacaataattgtacaatgagtaaataaagtgaggaataattttttttaataatggaataaaactgctcaagatctacatccagttattacaaagttcacaaaaaacaaactcacacagtgagtatgtagctaaagtaacaaaatcaaaaataaaaccaaactaataaaaaccaagcaagataaaaaccccacaactactgaattctattggtgaatctccacccgaagttagcaaagagctgcatgatcgttgactcaagtttacgacaagcatattttattagcttgatatgagcatcatgcatttgtagttgagctcattccggagtcaatatgttgcattgaaaagaacctgcacattagattttgaaggtgatctatcaaaaaccatttcatttctactaagtcagagagcccaacatagaacggaagctccaacaagaataagtttcttgatctttttattaacacccacaagccaattcctaaagatatgagatatattaggattacattgggatttgataaaataggagtgttctattttttttgttttgtattggtaggtgtgggatgaatgaaaaatgaatttattttgatggtaggtagcagtaccatcttgaactgtacaatacaaaccgaatgaatccatggtaataaagttgatatgaatctctgtaaaaactcatgtgggcatcgcgtccggcctctcgtgcagcggttgttgcggagcagcgtatggacatggacatgagggaacccccagccatcagcagcgagtagcccactaaaccgcggcgcagcagctgcaacgcagttgatgggacgcaagaaagccgccctagtacaggctaccgtgccatgcagaaacgccttctctagagcgcgagaggaggagacagcgagagcgaggaagaggacaggtccattaatctgcaaagtggaaatcagggccctctgtgctctgttccttgtcacccggaatgcccctacaacctcctagctacacctactgtcccatgttcgtgatcattttagcatgttactttcatgacctttttttttcgaaaaccactttcatgattataaatttgaacacaagtacttagtattggtcactactcacagtgatcaaactgtcattgatcatgtgttcatacaggtcgtcctgatcaagtttgttgaagacttgcaatagaaaagaaacgcagctgcagacttgcagtacttgttggactttgagaggagtctgaaaatgggactggctaattaagctggacttcctaggtcagccaagtggtaagcgagcaccagcggctcagcgcaagtgtcattatcaattggaacacccctggggccatacggatttcagagcaattttcaacagatttagtaatgattgcttggcctaaccaattccatgcttaggcaagtgaggatggaaactgctacatttaatgacgaaaatgatagctctagctagcaggcagaggagagccggtcctaaatcctaatgaaaggcggtgagtaatcggctgcaactttattcctattctcttcatactttttaccaccttttgactaaacttacacaagtaggcacttaaggtatcgaggaagatgattactccgggaaaaaaaaggtggtatttatttttcctcttcttctgccttctaagaaaagtaccagcagcgtggaaaatagactagaaactcctgtacttgtttctgcaccaccacttcacattgttccattgtttggcttaaactgagaccccctctgaaaaaagagaggacaaaatcatatacggctttccagaaaaatgttctaccaacacccgttttccgctaccattaagggccacttgcatcgtcaattgttggactgatctagtcagctccaggcgaaaatccgcgacattcttttcccacgcgccgacgcgctagctgctgtccacatcgcatcgcatcgcatcgcaaaaacccctggaaatccgttccggcgtcgtgtgcgccagcaggaggaaaactccaagcgaggagcgcggccgcacgcgcgtgcgcgagagagaacaaatccgtcggatttcacctttgcgaaagcgaacaaaaagaggaaggaagcagcccggggagaatgggacagaagaagagcgcgcggaagcgagcgagcatggaaacctcgtttcccttttcctgcttgggcagcagaataattaacgtagctgggaaaccattttttttcaccctttctggtcatcgctcgcgcgctgccgctgcgaacacagttggtgattgagtgggggcacgcgacggcgacggcgatcaagcgagaagagagaaccaggacacaccatcatgctgccgagcgtactcatcaatcatcatgcgtgcgtcccgcgctgcccccctctccgcccggccagccggcccagccaccgtcaccgcagccggcccggccggggccgatcgccaagaggcgcggcgcgcgcgtccgccgtccggggcgcactagcgagtgtgggtcggctggggccgctggggcaaggccaagcggcagagagagggcggcagctagctaagctagcgacgcgagcgcgcggcgtgcctcccgttgtcggagcggagggccccggtggagcagcacccgcgggcaacgtggcagcgcgcggtggggcagggaatccactaccgcgggtggtggtggatcaccggtactgtacttgtgtgcccgtgccgtgcgactcctcgagacgcctctgtgtgcctggctgcctcgcacgccttttcttctttctgcctgtacaggcgagagaacgagctgtgtacgctcaccggccggccggccagccggagcgaaccaacatcattcgcgatgcgtgggtgggatgatgagtctcctacaagtatgcaccaacctgggaatcgactggtcgagcgagccgagtagactggctgcatgcatgctcgtgacatgatgaccccgacacgcaggtggtgtggactagaagcttaaggctgcgtttagatctaaagtttggatctaaactttagtcattttctatcacatcgatctaccatacacatacaacttttcaatcacatcatctccaatttcaaccaaaatctaaactttatgctgaactaaacacagcctaataatacacgtatctcggctcgctggctaagtacgtatgagtatcaccaattgagcctattttggactagaagcttaataatacatgtatcttggctcgctggctaagtacgtatgagtatcaccaattgagcctattttgggactagaaacctaagagcatcgaggtcgctatatagccaggtgcgctaaagaaaaatgaccatacgtagagagtggtgagcactgagcagtgccaacgtagtataacggtgtaacttgtatatctggcggcagctaagaccgagtacacacacgacgaaaccgaaatggaaacagaaacgtgctaatgacagggatgcaagggggttcggtaaacaaattggcgaattttggcaggttcttgtctatacatatgtacgcatgcataatgactcctaggcgctacacatttcctacactacttgagaactaatctttaccgggttggccaaaaaacacattagtctcggttcctattctaaccggtaattaacaactttttttgttctggtttaaaactaccacggaacttagatgatctttagtcccggttagtaacaccaatcgggactaaagatcatttttagtcccgttcacaaacatgtgagtacaccattatctttagtcccggttggcggactaatgatccatatttagtccggttggttataccaaccgggaccaagattaaaaaaaaatcgcggcttccccgaaccgcacgctgcctgctctcacagactcgcagtctcgatcgtatctcctcccctctcctctcctcccccttccttcaatccccttcctctccccattttctctcctcccccttcctccccttcccggcttcccctcacctacgggcggcgcacgaggctgcggccgcgcaggcggatgtggccgcggtgggccgacggaaggggccgcggcggcgggctgcggacgctgcagcggcggcggctgggcgccggctgagcggcggcccggtggaagtcgggaggccaggaggccgtgcacggctggcggatttgtggattttttttttgatttgtagatgttgtaaatttttttagttcgtggataattttgtgaatgatttgtggattgtggatgggtatgtattgtggatgattttgttgtgcatgatctgtaacaatggaaaaaaagagaaaaaaaactttagtcccggttcttttaacctatagtcctggattggacgtgctggtttacgacccaagattaaaggtgttgtaaaccgggagtaaagagcctttttccacagtgctagtacgtcttatagcagctccagtatgcaaagaaattgaactgtgagccaaaaatattgaacacaacacacattggagtcgattgttgtgtgtcaaatagcaaaatcaacaacaaacatgaatcaatgctagacaaataaatactatttcttgcaaatgggattgaacgtacatatccaaatcgagtcacgcaatttacaatttcctctctacttcatttactgtatgtgggtcccataaatctatgcaaatgctgcagccaccaaacaaagttacattcgccattcatcaactgtagtagtcgaacacacactggggttgctcttagagcatctccaacagcctctccgaatacccattcaaccagcttgccagttgaatagagaatcaattttgttttcactccaacaacctctccatttttgtagtggaacccacacgccagctcctctccctccttcctcacttctctccacagcttggagagttcaagtccccacccactaccggcacaccggcgataattgaagggggaggcagtcaatggcaacgatggaggcggggcagtcgcaccggagagggagcaattcggcaaggatggcgagctcgggttccatcccggtcagctgtcgccgttcaggacgacagggctgtggacggcggtgttgtgcaaccgcggaagacggccacagcggtccggggccgcactggagggatgacggcgcaacgcatggtgtcatagcggagggaccacagcggtggtgcgcgcttttggagccgacagcgctcgatctaaggacgacgacgtggaagaaaacaaggcgcagcagaaggacagtgccagccatgcacttgatctggggagggggagggagtacgggaaagaagaaagagaaaaatgtgtggggcccacaattagctaggcaacttgggctagccaacttaatttggccaacgcatggaggagtttggccccggctggccatccggttggcaagtctattggagtgcatttttttctatccaaaattgcgaaaatttaacttggaggtgagatagccactctgttggagatgctcttatcttatagattcataataacccataattactaaaataggctccacctactatgcataaggaaatagagagatttgtgcaatgtatatgacatatccaactctataatgagacccacacccatgaccatcaaaatgaattcatggcatacttgtaaaataaatactgttttttatttaagatacctggtctcaagggaagagccctttactatacttgagacctgtgttcgcaatgtatagagcctttgctaccgtgaaaagattctcttagtgccccttctaattcccacattgcagatgctcttaggacaatcttaacccatgaagcatccaagaatttttcatacttattatgtcatatagacactacgtatagaaactatggctcaattggtggtttcttcaacatagattttcatccaatgatgtcttctctctctctccatccacatatccccttattttctttcttggtttctatgtagatccagtttcttgcatgagaaatggattattcatcttttttcctctctccacattaactctcttgccatatcagaaatttttttaagtggcagtgtatttaatgctatggaaactagctaaggtggaggtttgggactgtctaagagtaggccatgcctctttgctagagattgtccacgcatgcacgtaccaggatgaattggcacgagtgtttcaacatgtgcatcgaacttccatataacgtgcgctgtgcatacaattactttggtaggcttgtacaacatgtttattactttctccatccaaaaataaatcaatttttatacatggatcttaacatagtcttttacatagtgtaattattttataactaattaactgtagctcttctatataacttatgcacactagagagttcatgatttctacatgtttatatgatacagctacatggttactaaaatttaaagaatttaatctaatattcgatatacaatataagaactttatatctatatgtttatgtgtttatgtcagaagccacaataaagtgttttatgctttgattactatttgtggccttaatcgtagtgtaactatattcaacaatactattcattttcgttttcatatctaaggtattcgttcctttttttaatatatctgaaccatttgaatccttatatgaaagcgaccacatgcgctttgcctccttctcaccatttgctattgttgaagcacctagatgtcaatatgttcctctcccatcccttacccacaaggctacaatccatacatcaagaaaaagttgctcctagttgaattatatcttctttgtttaattaagctcaactcctaaagtctagaagtaatcttgccaaattacaaccctatctttagacacatgtgagatgagcgaccatacatgacctcaaaatattaggggccccttgtgtgcttcattatatgccaatgcgttctgatatgtttatagcgatctcttcggtctctttttttttatctttatgctgcactaatttggtcggaataatttttttctcagcttcaacgagtgttcaatgataattggttatctctaagaacgtacttcatgatgatgacgtggatgtgtgttgcaaacaatatatttctatttttttcacttaataagaaaaactaatttgatagtgattctttttctacttaagccaaatcgtcattagatggataagtaaggtctcatcttgtattttgcatcgggccaagatagatagggatggctgctaaattgaggtaagtttgccctttttcaattgtttatatacatccagttctacatacaaatgtacactagtaattaagttagcaaaaatctgttattctacccgtgatgttaaaaacccgttattctatatttctacccatgatgtaattctgactgcgctctctttccacaagtttttttctgaccctgcccctgttgctgctcccaccgttcatttccaaggacaatgtccaacggatcccactccgattgaaatctctgagtctcatatgggcccatatatcccatctcccggttactgttcaagtttaacacgacgatggtagtacaaccaccttcggtgtgggcatatgcactgcaatcagagaagaattacacgagccacaactgtacactgaaaacaaagaggctggtgccctgtcgcacaacaagaaaaggcacagccgctgaggtgggggagaagtagaagaagaagaaagaaagaaaaaaaatggaaaacggaaaaaaggtgacaccgcacagtgacgcccccatggaattataaaaagatggccgcggttggccgcacgtgccgcgccgtcctacgcacgcgcgacgcgagagcccccacaaaccgccattcccagggcttccaccggtggctttcctcctcttttcttcggaatccctgaccgaacgagcatccatccatccattcactcggtcgcatacccctgataataatactcgcgtgtgccctgtgcttgagcaagaagaacatcatcatcatcagcggccgagcttaatttgacagaaatatagtatatagcgcttcaaagttttggagtagtagctcatctcgtctctgccgagtttctggtagagctggaggagcggaggagtagtagcgaaatatatataataaaagaatccactagcagcttggctatttcagcaaaacgtatgtgggtagagagagagagagagaggagggtgcagagatagggaggaggcataattccactcactgccccaaccacaggacattctcttctctctctcccttctgctcaagaaatccaccagctgctgcatcaggaggtggagctcgctcgtcgtcttcgtcttcgttgcgcttcgtctcctcaggtgcccggaggagcaagaattgttgggggggcagcgaggtagacgcagttggagagccctcttgcatggatgcagcccactggcaccaggtaaaaatcgctttgcaaagatcgatcgatcgattgattctgcatctgtcagaatttcgctcttgtgcttcttcttcttcttcctgatcttgttgctgttcatcttcctttctgcgccttgttctcggtgcatatgcttttctttttttttcttctgattgtctgcctctcggaagatgttcttcgctttatatgccaacccttattctttgtgtagatctatgcttcagtattcatcatcatcagtagcacacacacgcttctctctccctcctccataggctttgaggggggggggggggtgaggccctttgtggctttaatccctctcccttttgatccttgaaagcagcacacacacacacaccatcgcctttcttctttctaatccccccctttcctcatcttcttttctcatagcttttctccttcttttcttctgtctccttgccgcttgcatcaaaagagtagccatgtccccggtgatgtgtagtagcagcagcagcaggagcagctgtggtactactactgcgcgcaaccctacaacagcacaaacaaagttgtgttttgtgtggtggtgtgtttctctttcatcttttctttccttcctttcgcttatcaccttttcctttcctctcccccctttaccagtttcacctttcctcccccctctaatctgcctttgtatccttttgcttggttcttagttgcaccataaagattctaaacaccctgcttgctgccatggctagctctctctctgtcactgcataaccacatgccatttgtgctcgcttgttcttgcgagcttgttgctgtagtagtagttggtgtgaagttagcaaggtgtttgtttgatctttgatcgtttgtgttctaatggagtgctgcaccatgtgtgtaccatcaggggctagggctggtgaagcccatggaggagatgctgatggcagcgaacgcggccgccggcgcgaatccgaatccggcggcgacggcgccgtcgtcggtgactgggggcgcactgaggggcggcggcggcggcggcgcgccgccggtggcaggtggcgcgggggcgggtagcacggagcggcgggcgcggccgcagaaggagaaggcgctcaactgcccgcggtgcaactcgacgaacaccaagttctgctactacaacaactacagcctccagcagccgcgctacttctgcaagacgtgccggcgctactggacggagggcggctcgctccgcaacgtccccgtcggcggcggctcgcgcaagaacaagcgctcgtcgtcgtcggcggcatcggcgtcgcccgcgtccgcctccacggcgaattccgtcgtcacgagcgcgtccatgtccatgtccatggccagcacgggcggcggggcgtccaagaacccgaagctggtccacgagggcgcgcaggacttgaacctggcgttcccgcaccacggcgggctgcaggcgccgggggagttcccggcgttcccgagcctggagagcagcagcgtgtgcaaccccggtggcccaatggggaccaacggccggggcggcggcgcgctctccgcgatggagctgctccgaagcaccggctgctacatgccgctgcaggtgccgatgcagatgccagcggagtacgccacgccggggttcgcgctcggtgagttccgcgcgccgccgccgccgccacagtcgtcccagagcttgctcgggttctcgttggacgcgcacggctcggtgggcgggccatccgccgcggggttcggctccagcgcggggttgcaaggcgtgccggagagcacgggcaggttgctgttcccgttcgaggacttgaagccgacggtcagctctggcactggcggtggaggcgcaagcggcggcggcgccggcgtagacggcggccatcagtttgatcacggcaaggagcagcaggccggtggcggaggcggcggcccaggcgggcacgacacgccggggttctggaacggcatgatcggcggcggcagtggcacttcttggtaatgcggcggcggcggccatgcatgcatgcatggctcatgcaaaagcctccgcgctgtggtggcgtgggttcaaattggagataggcagtagagacgacgagggttttaataagaggttggcattggcgataatccatcactgattcactgttactccgtataaggtgttttgatctctcttcttcttctttcccggtgttgcatcatcatcttggtgttctttcttctcccttttgctgtctttcatgtgattgttgatcggctttggtgctcaacacaacaaccgagctcacatgattcctcaaaaggatcatgatgcatgatcgatctctttctgaattctgatcttccagttctctccattgatcactgttactactagtcatcgcttgatcgatgtgtggttagagagctgcatgcgtcagtgcagtactagactagtagagcatgggaagcttctttttaggctggcttcgagtccgatggcgtgtacgtacgtggtacacaggcatgcatgtggtgtgtagctcattggttttgcaggggcattgtgaagcgaaggatgaagggaaggactcggttggggaggaagaaagaaaaatggacccccatcaccatgcatgtatgtcaaacttagctacagtatgtttggtaacggcaatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68213 - DNA, 1669 bp, Oryza sativa
ccgctgggtcatatcgacctcccggtcaccttcggggttccgccaacttctgcacggagcgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcacgcttgcttgtatggagcagcgcgcggaccaccttgccgcggcgtacaagcccgcgggtggcgacgagaggctcagcacctccgtcccggccgccccaaggcagcggatggtcacgtgcgatgaggtctcggtcaaggaggttgccctgggcgacggcccgtccaagaccacacgaatcggtggtcttttggacgacaaataggaagacgcgctcgtctccttactgcgggcaaacaccgacgtcttcgcctggagaccggcggacatgcccgaggtccccagggaggtgattgagcaccgtctcgccgtgcagctgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctagttatcatcagattcgcatggctagggaggatgaggaaaaaactgcattcattacccctataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcaaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcacccccccagcatgcttagggatgtgcagtgcgtcaccggctgcatggccgccctaagtcggttcatatcgaggctgggagagaaggcactacccctatttaagctcctcaaacgctccgggccgtttacctggacggaggaggctgagcgggccttcactcagttgaaggcgtacctcagttctcccccagtcctggtcgccccggagccagatgagccgttgctactctacctggcggcaaccccgcaggtggtcagcgcggcgttggtcgtggagcgcgacaaggacaaccctcactccgcgcatccccaccctgtgtcgactcgacccgggagagagcagggaggagaggcccccgagccgaacggcggcccaggccctcgacggccggagctggccctccgcctgcttgtccgacggtgccaggtgcccccgacccccaggatggcccc

SEQ ID NO: 68214 - DNA, 7093 bp, Oryza sativa
gataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccaaggccagctcgggcccctcgcagctgcctcacaccgcctactgggtgatgcagttcgacggctccctgtctctttagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgtttggcgactcccagttggtcgttaaccaggtctgtaaggagtaccagtgctctgacccgcagatggacgcttacgtgcgccaggtgcggcgtatggagcgccatttcgacgggatagagcttcggcacgtgcccagacgggataacacggtcgccgacgaactctcaaggctcgcttcctcgcgagcccagaccccaccgggcgcctttgaagaaaggcttgcccagccgtcggcgcgacccgaccccctaggagagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatatccatgaaggcgagtgcggagcccactccgtctcacgcaccttggttggcaaggcctttcgccagggtttctattggccgacggctctcaacgatgcggtcgacctggtccggcggtgcagggcgtgccagtttcatgccaggcaaacccatcagccgacccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaaaatcgataagcactccgcacttaaattcatcaggggcatcactgctcggtttggggtgcctaatcgtatcattacagataacggcacccagttcactagtgagctcttcggtgactactgcgaagacatgggcatcaagctctgcttcgcctcccccgcccaccccagaagcaatggccaagtggagcgcgccaatgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaagacggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtaatcggcgtcccccagccgggctccgttcggctggccacgggcgacggcacagagctgcctaacccgtggaacatcgaacaccttcgtcgcttctacccctagtgggggtcgggtgtcatgtctcgagctcgggccaaccccgcacccccccccccccgggcgtgcagggttggccgggggctaccacatgcatatacttaccttttttctcttccgtatttcaataaaagcattttcgatttcctgaggactgtgtctgtgccatcgtttccttttgaagaatcttggcttgaattagcacgctcgtgctcgaccctgccctcggcggcccgggccggctaaaatcgccaaacggggcccagaaccgagccgtgccccggggcgtggtgaactccgggggggaatcagcaaaggcccacaatcgggtcatccataaccctcggtcaccgcgctcccggcctggccagtctcgacacgaggatctccccaggcactagccccgacccgcgccgtttgaggctgggacctgggcacgagcccttgttcaagctaagacacagaaggaccgcggcacagaccatcctcgtctcatacacgcaacaaacagaactgacgcagaaatttcctctttacttgattgcagattaagtcagtctatacaagaagggggcccgaaggcctcggaagaagaaggaaaagttattaagattggcgggggcctgggggctcactccgacgcgcccgggtcgccggcctcgtcgtcgctgtcgtccgcaccgtcgtcaccgccctcctcatcggagtcgagcgcgaacgcgagccgaggggccgtaccctcgaagctgtggacgatgtggtcggcggcgtcccggacctgcgcacgcgcgccgtcctcggttccgggagggaactcttccagcgctgcccacggggagaagtcagggtccctggcctggtagcttgccagtacgagctccaccgccccccgggcgaggtccctcgaggatgacctgatcgtctcctcgagctcctcggggagccgctcgagggccccggccatctctgagaggcgctgggcgaggcccccctgattggcggcgtacttcgtgtaccgcccgccccagaggcctgcctgccgcccggcgcattctagacgggagacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgctgctgtgcgctctcgcgtccagctccttcgcccgtgcctcgagctcagcggcccgctgatccagtacggccctctcggcgcgggtgccttccagattgcggcgcgcctgctcctcccgcgctgcctcgcgaaggaacaggctgtccgccagccgctgcgccgcggcctcggcctcctcgagagcttgcccccgctcggtgagcgcgtcctcgcggaggcggagtgcggactcctcttcggcgcaggcggcctcgtgcgccgccagtgttgcctcccaggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcccgggcaacggcggcgtcaaggactccctgggcggcgtcgagcttctcctctagctccgccgcccggctcccgtattggaggcggaggtcgtcccgcgcctcgtcgagcacggcggtggcgatgagggcagtctcctgctcctcctccacctccctggcgatctccgccaggtccctacgacgggcctcgagctgtgaggcgtgccggcggtgtgcctacggcccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaggggctccacgctcagtggggcagcggaagacagaggggagagccgcctcggggtgggtgccgcgcggctcggcccgccgatcgacgtgccggactcgggggcgtcccccgaagctggctcgtcccaagcgtcgcccgaggggtcaggcccgagcggcgcgcccgcggcctcgtcgtgggtggcctcggaagtcgtcgtcgcctcgggcggagtcgggtcgggggtttggcaggccgcctggcgtgcgcgcgccgcctctgcctcccggacggactccccggcccggcggagtctggcctcctcccgagcggcctcctcagcctggcgaacccggacggcctcctgggcagcctcctcggcttcccggaggcggtccgcggcttctcgccggttagcttcccgcctccgggcctccgcggtcgccgtctcctcggcctcagcccggccggacttggaatggcggggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggcacgatcccccccatcttgcggggccgtttcttctttcgctccccctcgggctgcggcgtcggcacggcaccctccaggcgcctgctgctggcacgcaccgccccgccccctcggggaggagatggaggaggggtaccctcctgcttcctcttcccccaggcgtcggcagggcggttgccccccgggcccccgtcgcggggcccagaagcacgaccccctcccggggtagattgttcccccctgcgactcccgcccgcgccatcgtggcctcggggggcccgctcccccgatgccccgaccacctgcatgatggtcaggatcttggcgcgctctggatcgcagcagagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaagcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagacggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcaccgggcgtccctcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaagagttagagcacaagtggcgaaggtaaggggaagagtggcgagaggaaagaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggccgtggcggttgagatggggcagattgtgcgcgcattaactacgatcgccaaccgtgaaaagcgccatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgctcgagcgcttccctcgaggggggcgatcgccctggcgtaacgccgggggctactgtcggtgacatggggccgggggtatcgtgactagaggcttgggtagccgcggtcacccacgtggcctgaccccctcggggggggtcgggcccaaggatgacgtggccacccctccctctgtctccccgaggggtcggatcgctcccgtttcggccccgagggctggggcgcccccgtttcggccccgaaggctggggcgccccgaccccctgtggttttggcgccacgcgtgtgggttaggtgagcacagcggggctcacctaaccgcatttatagcagggttggacgagcgcaccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgataagagcttcttggctctcgtccctagccggagccggcgtgctaactcctgcagttggtatgtcagtcccggtcagatccattccaggcttcagcgcaagtacggcaaggaagtcgct

SEQ ID NO: 68215 - DNA, 12342 bp, Oryza sativa
tgaactctctctctcgctctccggcactctgtattccttcacgccacagatccaccagaacacaggagtagggtgttacgcttctcagcggcccgaacctgtctacgtcgcccgtgtcttgtgcactttctctctcgctgacgttcctcagatcgagggcgaagaacctcacttagcgcccccggccgaaccggcaaaggggggcctgcgcagtctcccggtgaggagccccacgctccgtcaatataaatacttgtaatacaggcagttggtttattattggttattactttgtacatcaacttaaggaaaattttgctagagaacatggccaaaactaacttttggaggaaaacactctataatcatagtattttgctagtggacaccgcgccaactaaaataataagagagaaatcgcgtcgcgtgaaatgtcaaaaatacccctaggcccacatgtcagctctcctatcttatatatgttgggggccacatggcagcgttttgaaccgccgacgccggcgataagctcgccgaccgccgctgcctctactcctcctcgcgctgagtcactgccatgtagaccccacatatacaagatagaagagctgatatatgggcccaagagcatttttaacatttcacgcgattgctttctcctcttcaactggaattattattttagttggcaatgtatcccctagtaaaataccacgatttatgaagtgtccctccccccccccaaaaaaaaaaaagttagttttgacggtgtcctaggattaaaaccacacaatagcaaatgttctgtagcaaaatttccctcgacttaaaagtagcagtacaaaacatcaagcccaacaaggcaacaggcctttgagacgggctcatatctccaccctatctccaggcctagtaaacccgaagtccgtatgaggcgaaagcaagtttagaccagaagactgtttcaagtatgggcttgtagcggttgctggcaattctaactcccacggcccaacttcgccccgctccttcgcaatcgcaagttcgcaactgcaccacgcggctaaacccgtggaggatgtctacccttgtgaatttgtgaacgaagccgcccccgcgctatagtttgcgacgtgtgaggcacaggcgacactcggagaccgttgtcccggcttttgcgatcacaatctagacgagccatttcgctatccatgtgtcgcttggactttttttcgtctgctttttacagaaaatttttgtttgtcacaatctagaggaaactatttttcctagccctccctgtttctcatggtttgtcaatgtgttttggaagcttgcgcataagaacccctggcctgacgggaacattggtccctatcgcaattgaagcgtccattttcgcatcattggacttcgatgtgcacaccgcgatctgtgtacacgcaatcaaacacatgcgctcttatttttccagcgacgagcatagggacaacgtactttcttgatgatcaagacatcaattttctttgaacagttttgcgtacgtcgaccatctagatgcatgccactctacgtgtacgtcggtaggatttgaaagggctgcagcccagggtttttatctttccgttttaagtaaaaaaacactcttagctgtttatccaaaaccgaaaaaaaccgacgactttcgatcaatgccgtttgaaaagcgtcttaaaccgagaagttttcacaaaccaatatctagcggtttcataaaaaccgaacagtttttgtttttttgaacccggctgtggccacaactcttttgaccatggtgtttgtttggttgcactatatagagctgcaatgcagccatctcctgcatagctgtcgcgcagctgaatagcccccgtactagttacatgttgcaatggaatgaaaagattaaaatgttatttggtttctttctattttttttcatgatcgatcatgtttatgagccttttagagtggttttctaaaagaggaaggagtggagttttctgggaaggatggatcattttaaataatactccctttgtttcatactataagtcactctgaattttttctagtcaaactttttaactttgactaaatttatagaaataattagcaacattttaaataccaaattagtttcattaaatctagcattgaatatattttgataacataaaacgtacacatgttttactgaaataaatgtcaaaacgacttataatgtgaaaccgagagagtataagatacatggactactgattgaatcgtcaatgagaaaaacatttcgttttataccaacagatttcgtccaaagtgcacagcaataccagaaaggcagaaacagatgtactcctaacaagaaaaggttttgtgatctttccatggagatccatgatgggcattctaaaggtgagaagggaggtggtgtgaaaatgtgaatagggacaagggatccattcatatgctccgtactactactcgcaactgttcgccgaaagcgagatacgatcatcatcctgtcatctctctcgcaatagcatttcatcctttcatggcctcgcgatggatacgagaccctgttgccttgccaacgcgtcgatacgatcatcactgtcaccgtcacacagactcgtccgtgtaaactcgatttgcaccagaacgatacatgaattctccgtccgctgaacggtggaagcgtagggtttcgtcacgaatgtgtggccggctggccgagctcgcagaagatcaacgtgcagccgtcgcgaggaccggcccggacgagtagacgacgacctctgcggaaagggcaaaagggcggggcgccacgctgccacacgaaaggcagtggcgcccggagacagtctcgcgagtggccaccggtctccttccgtttcgtcgagccctctggctgacgagacagggtgctgcaggctgcagcctgcagctgcaacggaacggggggacaggctgcagcctgcctgatgaggtgaactgaaaacaaactacccctgctagtaacgtctcagggctgtaataagatcctatgaatccaattagccctaaaaactaaattcaccatccttatagcaaggctaataatacagctgacctgctagctataaggttctttaagctttctctcagcctactcatataatagctagctcttcacagttaatacagtgctcactggtctctctcacagagtttcttggttcttgacttcttgtgtccaagccggctgtaaatttacagcctgcttctcctctctctcctctcttctttcctccaactcagcatttagccggcttatagcctactattatacttgctcttactccgtaaaaaaactttgtttttttaagtctatcttacacatttacgccagattttttttaatacaaagaagctcaagtgacgatttggagatgcacttgatactgcagtgttaataggtgtgtggtttgcaatcccgaggtcctgtgtttaatcctcaatttcaaacctaggaaaaaaaggaaaagtaattattaagtcaggtagagcttgccacttaataaaagagcgaaatacatggccagtctttaaacttatggggtggtgtcatgtaggtccgtgaacttgaaaattacacgtttagatccgtgaacttggtttaatgtaccaccccggtccaatcgccctttgaccatgtttgaccgccaacgtggcatgccacgtaggcaacacttttgtgctcagccccctccacatatatcttcgcacataacttgccataactagtgcattttaacccaaatctcccaaaatatccctaaatcggctagggtttcgacaatgaggttaacataaggaggctgagaggtagcggctgtggcggcctcggcggtgagattagtggtaggaggcatcgtaatgcagcgggttagtggtggcacagtgcggccggattagcggcgggagatagtgtaattgcaattgctaatcgggaccgtattttctatacatgcaagaagaaaaaatgaaagggaagaccaatttaaggattttttttaggggattctggtgtcacaatatagctaaaaggagatgacgtgttgtgatgtggagggggctgagagcaaaagtgtggcctacgtagcatgccacgttggcggtcaaacactgtcaaaggacatttggaccggggtggtacattgaaccaagttcacggatctaaacgtgcaattttcaagtttacggaccggccatgtatttcactccttaataaaaagaaaaaatagcattgccaaagtcaaggatcaaacccattaaggccttatttagttggggaaaatttttagatttggttgtcacatcggatatacggacacacattttaagtattagacatagtctaataacaaaacaaattacagattacaccagaaaattgcaagatgaatttattaagcctaattaataaattaattaggcttaataaatattgtttttattaggaatcactctccgacaacatacaatctatgtaattagtttttattgtctatatttaatactccatgcatgtatccaaatattcgatgtgactgggtaaaaaatttttgcgtgagaactaaacagggatttatttgaacttctgcttcctcgaatcatatttagggcatgtttagttcaaaaaaaattttacaatatcacatcgaatgtttggacacatgcatggagtattaaatatagaaaaaacaaattacacagttcgctagtaaattgcgagataaatcttttaagcctaattactccatgatttgacaatgtgatgctacagtaaacttttgctaatgacggattaattaggcttaataaattcgtctcatggtttactgacggattctgtaattaggtttttttattgtgccaaatatcttatgtgactcctgtataacacgtccaacctttacccctgaatttaaatacccctaaatatttttatggagggtgtaaggttgagccggttttacgcctcctacttctcaccagtcaggtcaccgcctcaccggcacagagaagcccggatacacggggtggtcacactcacggggcacctacccgagccaacccccgcacacacgccatctccagttctccacagtgtgggactagcagcagcacggcgcctttttgcgatttgactccgccgcgccgtgtcccctccgagaggaaaaatacaaggggtccgagcggaacaacggcgaaaagcgacgacgggactggacgagacgaggcgaagcggggcggctacgaaaacaatccagacaagcggccaagcccgacgcacgaagccgcgcagggttcgcgatggattggactgacggacgggacgtgatcccctcgccgcttgcgcgtgccctccccccgtagcgctagcgtcgtgtccgtgtcgtgtgtgcgaccgactggtggatggaagggagtggagcggtgggtgtggtcgtgccgtgccaaaacgccatgcgagaaaaacccccacgcaaccgaacaaaacatacacccccgccccattgaccggcccacccgcccgtgtgtccacaccgatccatccacaattccacattcttctcctgcgctgctgctgctgctttgactctcccttcttcccggctactccatacacttggcaaaacacctgaaccaatccaacccgcccgtttttcttcttttcttttctttgtttttttttaaaaatacaggaatacaggaagaggagcggagtggccgagtgggtagatggtgcaagggcggttctactagtattctcctacctcagtggtgtttggatcacggactaaagttttgatcaggacggttctactagagtctgattcctgtaacatcggatgtttagacgctaatttgaagtattaaatataaactaattacataaatgagagataattcgtgagataaattttttaaacctaattaatccataattagcatatgtttactgtagcaacacataagttaatcatggattaattagacttaatagattcatctcgcgaattagtccagagttatgtaatgggttttgttattagtctacgtttaatacttctagttagtgtccaaacatccgatgtgacaggactagtccctccaaccaaacggcccttcagtctagcaagtttttttaggccatgtttaaatcccaccataaaattttgtaccctgtcacatcgaatatttgaatacctgcatgaagtattaaatataggctaaaaaataactaatttcacatattgcgactaatttgcgagacgaatcttttaagcctaattgctctatgatttgataatgttgtgctacagtaaacaatgttaatgacagataaattaggcttaataaatttgtcttgtgatttactgacggattctataattagtttttttattagtatccagacaccccataagacactttatataatactctctccatttacttttgataaccatattttattttgacacacagattaaggataaacaattttacttatcattcatttaaaaagtgatccattaatatttacatttctctatgcccatgtaaccaatcttgtgtggaagaataaagagtcacacatcattaagatgttggattgaaatatgcctatcaaaaataaaatttccagatttggaaatatgactatcaaaagtagatggaggggtaactgatatgacacgccaaaactttaccaccctatccaaaacacctctttggcctggtttagtttctaactttttcttcaaacttctaaccttttcatcacatcaaaacttttctatatacataaactttcaattttttccttcaaacttacaattttaatgtggaactaaacacaccttttttttttttgttgggcttgtgacttgtggggtgtgcagaaagaaggctaggcagatccaggcagagtagctctttttgtttttgttgggacctaatagtactggcagtacagtagtaaaaaaatacaaaccctggtttccgtgtccaatgtttgaccatccgtcttatttaaaaaaattatgaaaaaaattaaaaagataagtcatgcataaaatattaatcatgttttatcatctaacaacaatgaaaatacgaattataaaataattttatataagacagacaattaaagttggacacggaaacccaggtttgcttttttttttttggacggctcgcgaaggaaggaaggaaggtggagccaggctagttaatagcgcgacatacccgagacgcacgcacgcactgctgctgctgctcgctctcgctttgcttcccctaatcttctcccgggccaggggggaagaggggcggaattcgggcacgagctttggagttggagatcacttcggcgacggcgtggtccccgccggcatgcagttcccgttctccggcgctggcccgggcgtcttcacgtcatcgccggcgctctccctcgcgctggtacgcgcgccttcttcgctgacgtgttggggggtttttgtttcttttttttttttggtggtgatacggtcgagtgattcggaaaggcgcgtcttttctttggttggttcggtttgtcgcaggcggacgcggtggcaggccggaacagcggcggcggtgggaagatggttaccgcggcccatggcggcgtcggcggaggaggaggaggaggacgcgcgaaggcgagggacgcgttggaggtggagaacgagatgagccggtccgggagcgaccacctcgacgtcgtctcttgcggcgacgcgggcggcggcggcggcgacgacgacgatgacgaggacgccgagcacggcaacccgcccaagcgcaagaagcggtaccaccgccacacgccgcagcagatccaagagctggaagcgtaagcgcgcccccacccacgaacaacgattcgttgcattctcctgtgcttggctgcttgctttggctcatgcatggatactggctcatcggtgcaggatgttcaaggaatgcccccacccagacgagaagcagcgcgccgagctgagcaagcggctcggcctcgaaccccggcaggtcaagttctggttccagaatcggcgaacgcagatgaaggtaagcgatcgaaacgaacagcaaaccatctttgcactccgatcgatggtgcagtgcagttcttgacactgtgtgtgtgtgtgtctctctctccctgtggtgattgaattggcaaagatgcaactggagcgacacgagaactcgctgctgaagcaggagaacgataagctgcggtccgagaacctgtcaatccgggaggccacgagcaacgcggtgtgcgttggctgcggcggcccggcgatgctcggggaggtgtccctggaggagcaccaccttcgcgtcgagaacgcgaggctcaaggacgagctcagccgagtgtgcgcgctcgccgccaagttccttggcaagtccatctctgtcatggcgccaccgcagatgcatcagcctcatcctgtgccaggctcgtcgctggagcttgcggttgggggtatcggttcgatgccatcagccacgatgcccatctcgacgatcactgattttgctggcgccatgtccagttcaatgggcacggtgatcacgcccatgaagtctgaggctgaaccatcggcaatggctggcattgacaagtccttgttcttggagctagcaatgagtgcaatggatgagctagtcaagatggctcagatgggggatccgctatggattccaggtgcctccgtaccttcctcgccggcaaaggagagtctaaacttcgaggagtacctaaacaccttcccaccttgcatcggggtgaagcctgaagggtatgtatcagaggcatctagagaatctggcattgtcatcattgacgatggcgccgcgcttgtggagaccctcatggatgaggttgtgcttgtgccaccttaccccctttcatgtttctgttgcttgtttgtttggactcacctgtagtttgaattcttgcgacagcgacggtggtccgatatgttctcatgcatgattgccaaggcatcaaccactgaggagatttctactggtgttgctgggagtagaaatggtgcattgcttcttgtgagtgatgaacattctgttgtggccatcccatgagtttcatgtggttaatcatactagcataacccctgaatggtaaatttcgatcattgcaacagatgcaggcagagctacaggtgctttctcctcttgtgcctattagagaggtgaagtttctcaggttctccaaacagctggctgatggtgtatgggctgtagtggacgtttcggctgatgaattgatgagggatcagggcattacttctgcatcctcgactgcaaacatgaactgccgaaggctgccttctggttgtgtgctgcaggacactccaaatgggtttgttaaggtactgagactgattatctttgttagctcctgctccttagatattcttaggtaaatgtcttaaaccgtgatatccttgactagttcacttcagggtagtatgtggttttacatctattaattcacactagtcagcatgctatcggttgacgtgaaactcatctaccttgcaaagtcgcagctcggtagtacccacgacgctgccactagaagtctgtcaaaaccagccatattagttgcaaagcttgttagctctactcatatgataatcatacatatggagagtgctttattagttcaggctctctgcaactaacatgacactcatggaaaagagtattcgtgtattctttcgtaatgtttcaaataatgtatgttagtttaatgtgtcatctggtgatcaccatgcaatattttgttcgtattcacaagtcatggcgtaggctcatgtctcctatagatatgttgtggttatgagtccataatccgaagtaaagtattgtattggtcagcggggaggggagtaaataaatgatttaggaatacttaagtggttctgagatccaacacttttccccaagtacgctcccttgcttttgtttagtcctgagttcagttctcctaggggattagatacttcttctactcctgggatggtgccccttgggtaacttcttgtccgcagtttaatcgatgcgtctcctcgttgaaatcttgactgcttcctctattgttttgtctcaatgtaaaagtcctcttcaccttgggttttgtaccagagttttatatagccttgatccaaattgctctggggcgcacacatgcacgaacgattctattcaaaattctaaattggacatctgaatgggacaaatatatctagtctacaatggtagaaacatgatttgatgagttataacgtctcattactatagattacactgtataagttaatctgatgtaaacccacaggttgaaagcaggaagtggttctttattttaagggttcaggaacacaatattttggaacactagtggtgtgccattcttggggcataccataagtcaaaataattaacgatgaagatactgtgatcagaaccatgctttataaaatgtaaacaaagtcaatctcagacagatcagctaatcctagatcaaactagagatactgtcgtctctcaagatttctacttttcttctgtaatttcatttatgtgcttttggtgcttttacagtatttagttcaaatatcagtattttctgaagtctataatctctctattgatcagtttctggatctgcctcctgctttcatggtacttctatggtttattctatgcaaaacagaatagacaaatgtgtaactattatccattagtcctatggcctatggttctcttacaaagtactagttacaatgctggggccccactatgggctaatatttcgaggtagcctctattttaaaacattgtgttgatgtcctttttatgttccattgattgggcaaaaagaaattaaaaaaaaacttagatggaaaaataatattaattgtaccattcagcttgtgtagtagttgcgtactccaggaaaactgcacctcaggcctcttttggtgtattacctctcaagacatttgcattttgtgcgtgcatttaagtctaacagcagatcttgaatggacgctgtaggtcacatgggttgaacatacagaatatgatgaggcatctgtgcacccgctctaccggcctcttctccggtctggtcttgcccttggtgcagggcgatggatcgcgacattacagcggcagtgcgaatgcttggcccttctcatgtcttctattgcattgccagagaacgactcatcaggtaaagaaattcaatactactgctaactttcaattggatccacccttctaataaagtgctacatttgcaacagctatccatcctgaaggtaaacggagcatgttgaagttggcaaggaggatgacggacaacttctgtgcaggggtgagcacatcatctacccgtgaatggagcaaactggttggattgacaggcaacattggggaggatgtgcatgtaatggcgcggaagagtgtggatgaacctggaacgccgccaggtgtggtgcttagtgctgctacatctgtgtggatgcctgtgatgcctgaacggctcttcaacttcttgcacaacaaggggctgcgtgctgaatgggatatcctcagcaatggtggccctatgcaggaggtgacaagcattgccaaggggcaacagaatggcaataccgtatgtctactgaaggctagtgtgagtattagctaacagtctgccacagttctgttcatagcttgctacttactaaacagcatcattaactgacttgtgggggagactgccatttcaaaattgttgcaaacctaaacacaacattttagaatttgttgggggcaccacatcactaaacactctaaacaatcacatgcttgtctgaaaccagtttaatgtgaaataatttagaatttgtgaaaagagtacccttgcttggccatcttaggtattttatattgctaaaagaaaggaaatgaagccaaggaagtactgcattagctggtggggaaaggataagaactatgtctattcacaactggaattttgtgagtcttaattctgtaacggttgtaccagtgatgatatagttgtacaaatacaaaactatatgtttagtcacacatttggcaattgcctaacaaatacaactctactataatatataagcatgtatagaaattccgctaggtcaatagagattaatggaggttagaaagatg

SEQ ID NO: 68216 - DNA, 6074 bp, Oryza sativa
tccggttcaatggttgtgtatgctcctgtagacatcccagcaatgcaccttgtcatgagtggtggggattcgtcatgcgtcgcccttcttccatcaggttttgccatcctgcctgctgggcctagcatcggcgcagatcacaagatgggcggttcattgctcaccgttgcattccagatacttgccaacagccagcccagtgctaagctcacggtggagtcagtcgagaccgtgagcaaccttatctcctgcaccatcaagaagatcaagacggcgctgcattgcgacgtgtgaacccaacaaggggggacttttggcctagtgggagcggctgtggcgatgagcctgagtcaagaacgaaccgcgacataggaagggacctttgctaggtggcaaggaccggacggggcaggtccttagcacagagcaatggtggtggttcgggtattgactcagcctctcccgcctccgttctctcctgtgactggtgcatgttgaagtgaacctgcattttggacgccatgtagcaggccatctttctttctttttcctttttctttttctttttctttttttagggagaagggagtcatctgtgttttttgttggctggctcagggtgttggtgtttctggtttctagcttttgttacagggagatgtgatacattttgtagaagctccgaattgtcgtgctggtatgtgaggttctgatcataggtctgtgtttgatagtctcgagctatcaacgcctggcaaatgcaaaccttgttatgctaaaatatgttttagatcaatctgattctgaaagctgtttacatgtcccactagtcgaagagcagctcggcagtcatgaaatgtgcaaatggaatcacaaagttctggctcactttgcaaaattcaggatgcaaaatgtcaccgtgtaacaattccattttgtacctaagctttccggaccggtatcgtgttgcacgcatcttcctttgatggtgcaatgcttcgtagcctatcattggtcgaggggccacctaagctcagttgtgtggtggcacagatgtacaactggaaggaccatatttctcatccatcccatagggaaagatgttctttaccaaaatgtaaagataagaagagaaatatcctagtctcagggcaaaatttctatgtcaccatctacaaacgtcaaataatgtactggactgttcataccaacaaatcgtttgtgccaatttgacttgcgacgggcaaggccatacaggctacatcacttgaactggatgcataatttagccccctttggccatgctggatcattcattcgacataaatatatagaagttttactcaagcgaggcgctatcttccattgcacataacatagatgttctactttaagcgagacatgattgtactcagcaagccagaatattgttaactaagatcattaggttaccgtgccaggacagttgcacgtacagctattaccatctgcaacaagttcatgatgcttttgctgtttctctcaccaacgcaaactttgccagaaggcctgataattgaagaaatgagccaacaccatcgcagattctcatgtgagcaaatccggtttcctaaggaaataaacatgatatttttattcaactgtagaaaagaacgataattggtttgcataggttgcaccttgataggctgtaaagttaccttcaacaattccagcttcagatattcagccatgtcgtagttcttgataacccggaagagagtagtgattatgtcagtgggagagtagcccaaatcatataattgcttcagagcagagcaagcctcatcaaactttccatcaagcacatttttcaccatattcttgacatgcaacggatgtggttgatcacgcacctggagccaatacagcattactattagctgaagaaataacgcacaaaatacagggcaaaagaagctatctgcaaaccttgaacacattttcttgattaacaaaacggaacccactaactgtagcttgcaagttgttcaaagcttgcctcatgtcaccatcagcagtaaagatgatagcttcaagtccctctggcacgtaaggaaccttggttgtacaagaaaataagagattagataaaattaaaccagcacccatatattgggagcaaatacaaattgtatgaatggtagggtggtaataggatataaacgattgttgtggttcaaaagattaatccaggcacttggaacaaattaactagatgatcaaacattcccagtatccagtatctacatcacagagagaaaaggaagaacttaaaagaaaggtagagggagttgcttggctgcaacattgcaggcaagaaaatgcctagtgctgaacattagaatgaactgaagagccattagaggatgactaacaagatttatgacctcttcactttaacagctagatgtgcccactcagctgggtattttcagtaaaccggtgaggacttaatgatatttgttaagacaaattaattaatcctaataataacagcagataattataggacaagaaacgcagaaacacacgtaaatgcacaatcatagcttcaaggttacagggaagaacaatatatatgtaggtgtaaacatagccatcagaaatgatgtttaactaaaaaggttaataacaattgcagtgtttcaaagaaaccatgaatcataaccagtgctatgagaaatctgtcgatttaagaaaacttaagcaactaggcaataaaatgtatagtcaagtcctcgcatttataagagctatcaatcattaccttctcagctgctaccacaatcatgagtcggccaagaatctcctgatctgaaagccttgagaaccgtacaatagcacaacggctttgaatgggttcaatgatcttagatgaagtgttgcatgcaagcgcaaaccttgtggtgttagaataaatctccattgttcgtctcagtgcttgctgtgctcccgatgtcatgctgcatgtagcaagtgcatgtgaggcaaactcagaaacaactagctatatccttgatatcagtagttatatgcttaaaaatcataatgaacaagtctttaattcataactacttcaacaatcatcagaagtcctggccggaaattgcccaggtggtggtggaagaagctgcactatggcgcttagcagggctttggtcatttaggtcgcaacacccatgacacaagattcagccctagcatccctttttttttgccttttttttcagttttcaccttgtaaatgttatacaactcctcagtcttaatgtaaaagatgcacaatccttgtgtattcacaaaaaaaaatcatctctacgagataatatagctttgctcttacagagatggagcagccactaggtttctccattttcacactgttggtatcactacaatcctactacatcttaacctctagcaatccgtggtgaaattggcatgtctggactaaataaggcacagtactagcaatggtgtcacatcatccgcactagggggtggcattacctgtcagcctcatccaagatgacgatcttgtgcctccccggctgcagcgtgaccttcttctgcgcaaacatcttgatcttgttccgcaccacatccaggcccctgcaaaagcacgaatcaaccgtcagtccgtcacacacccagtccacaccacgggcgcacgccgcacggctacagttcgccaagtcaaaaccacgccacggccgcaccaacctgtcgtccgaggcattgagctcgagcacggcctcgcggtagctaggtccgagcagctcgtgtgccagcgacaggatgctcgtagtcttcccggtgcccggaggcccctgtagaaaacgatagttaaaaaaaaaaaaaggttagaaacgattcgtcgtactgctgcttgggtgttagcgagagcgcgcgcaaggtgttcgaggaaatggcgcttacggagaggattaggtttggcatgttgccgtcgcgggcgatgacctggaggcgggcgacggcgtcggagttgccgacgacgtcggcgacgcgggtggggcggtacttctccacccacgggatgtcgtaggcgtcggcgagggcgggggcggaggagctggaggcggccatggcgcggggcggatgcgcgggagaggggaaaaaaccgcgccgcggtggagggaaaagaggggaaagctgccccgccagcggaggggagggttttttttttttttttcgggcgtgggccgccttgaggagcaaggggcatcatctgttgggcctgaagcccacgatgagcacggacggctgccgtcgagactcgagcggcgtcggccgtacggagtggccaccccggaaatttcactacttagtactatcaaaatatccaattcacagtccttaaagaaatgcccatttaatttgtaaggctcttggattttactatagaaactatgattttctattagttatcactcccatcattctattattagtctaccccacactagtaaattcatccaccaaactatcatcataaccgccacaccaaagccatgtgcttaacaacctccttcagatgctcctagcgaggagcaggctgttggaggagctcatcatcacggctcctatcatggagcaggccgttggagaaactcaccgttgcggtagcactttacttgcccatcacactagagcagccatgaaacagggacgaggagggcaacaccatcaaggaagatatggagatcatcgcccctcgtcgtcaagatgtaagatgatgggttagtcccgcatcagggatactggaacaacttctcgtggcaacgtcctgcgacaaagtagatgacgtcggagcaaatctcgagacaatactgaaaagtgtgcatagtcaagaaggtcactcatgaagacaaaaaggcagtccttgctggtgccagtagcgagtgtgagaaggtggttggtcattcctatgtgctgggttataccggttctctttactcatccaccaacgttgtggtttgtggcattgagctacatccgcaacaacaagccttgcggatggacttgtcaatggtgggggtagatgtatcggcaaacaacaaatgcggtacggaacggagtaattcattgttccgatggccaaatctaaaatccttgcgaattttgtggcaatttctaaaagtacttggatgtcgatcagtgaaatctctctctataacaggactaaaatgtgtcccaatatattactgtaatatactcctacgttttataccacttagtagaaaatatagtataacgtaatgtgttttacgttattctatcaaaaaatacaatatgcaccatggtgtaagttattccctcgaagggcgaaacattcggacaatattttttctagtgataaagtatttcttattaatgataaattgtaattagaatttttcgagcggacacacgttacttcaaatcaatggtatagttttcttggataaaatttccactaccaactactccacatataacgagcatcaaaacgtgaaaaaacaagttgaaaatttttttggtaaggagcaaaaaaacacactttagtttgcgaacaatggactgttatccgtcagtttttttttttcgaaaattaggtttagctgagttgccaactgcttgacatcactggtttctttctggtccaaccccacacggccattcggccatcactgaatagcggaaaaacgagggagcaaatagaaattctgtccagtcttccaacccaccccaattcctccttgcccccctccccctctctctccccagaggagcagcaaggtctctctcctcctcgatctgccgcagggggtcccctcgatggcgacgcctcgctccccgagcacccgcggcgacgcgctccttgactcggcgcccctgctcggcgggggcggcggcggcggcggcggccggcgccgagggggcgcgctccgccggccgtcgctccgcggcgcggcgcggctgctgcggcgcggggggcggcgggcgatgcgggagccgtcggtgctggtgcg

SEQ ID NO: 68217 - DNA, 4374 bp, Oryza sativa
atcgagtaccggatgcgccgggggcagcgtgacagggccccggcgtctgccgacgaggaaaggggaagtgacgggtcgtcttcatctagcgatgatgatgtcacggaggacgatcgccgtggtagctgcaccgattgcgtcaggtaaatggaaggatctggctagtaagcgtgtttcctagtccgtgttactcacgagcggagcagctcagatttacgatacagtaatagggaaatgtttcttctgtttgcccttacgcaagttcttaccacggtataatgagccttctattagtatgaagaaagaggggtgagtagaaaaggctagataagtattatactcagttttaacatgccaagttttatgcatggtttgctgttctatgatgtcctagaaatatttatgttgagcatatcaatcaggctaatgtcagtaagacaaagtggctctgtcatacataggatactgattacagtcatgaagctcactccagtcagtcatgcccagaatttctagcctagtattctcttctaagtgggtttcaattacttaagaggtcaaataatctagcgttgcttgttctcatgacatagcaacagtgttgtgctttgaaattggtatatgcgcaccataagaagctaagagtggatcctcctaaataagctataaattcaattaggatagtataagattgtacctgcaaaatcatttcgttcaacataaactagacaaaatgaataacctcattgatgttcttttgtagctgtatatgtgtgttatgcttcaatatgctaaaagaaatgtggtctaatttatgggataaggcatctaatggatccaacgttacctggaaaatgacatttgaatgagtggcacataacctgtttaggtttctttttaagacacaaattatacgctatttggtattcagtgaagagacccagtatctgattggaaaggtcaactgaagacttttgtgacctcaaaacctgattcttttttatgttttaatacacatttctgcagtctcattctattgactatttgactgttctatttttttaggcaacacataagtttataactgttattatatgagtttcttagtgatgaggatgattgaggaaacatgcttcttacgctgctagataatattcaactgcatagacaattgataaaaacatcttccaaataaaacattggtctgttccttcccttttgttttctctatattgaattatactgcagatgtctgtctctgttatgtcataacatggtttgctgtttcctcatattcataatgcggcttgcttctgtcttctactttaatttagtttctgaatgctatcgcactatctagatgtgctgctatggaaaattcattctctctattaactattgtatcatgtgattttatttaacaatattgatattgaacacatgacctctcctatatgtcttgtgccttattatttttttattgttaactctggcagtattgcaaagcacctggagtcagctaatacaatgttctccttcatatggtggataattggattttattggatatctgctgggggtgaggatgttatccgtgatgcacctcagctttactggtatgcatctttaaattaacagtcggcttttcataatgtcgtcatttcattatattcttttggcacggtaaacatgtttctgtatgactcactttgcaggctttgcatagtctttctggcatttgacgtgttctttgttgtattctgtgttgctctggcttgcatcattggtattgctgtatgttgctgcctaccttgcattatagctattctctatgcggtttctgatcaggtatggcttttcaagtagagataaattggttatgtacatgcagaagatgtacataattttatatgacattcatgcaatagataaccttttgcaagatcttattggaatcaggaaggagcgtcagaagatgatattcgccaaattccaagatacaaatttcggagaacagatgaacctgaaaaacaaactgctgatgagacaggaccttttggtggaataatgacagagtgtggcaccaatcaacctattgagaaagtactcgcacctgaagatgcggtaagtttttataaatttgtgatacatgtatctctgaccataacaatgcccgaggtgctaaaactcaaaaccttttccaattttattttagacagactcacatcgtatcgcccattcatcatgactgttgtactctgtctagtaaattcgatagtgtgaaggcaagggatactgaaacaatgattatgtgtttgccgtagctcatacatcataaaatattttcaacttttggtgaatgtatttgtttgtaaaaaatcgtaatgaaccatttattcaacatacaagttaaaataggaatgattcttacccaattaaccctgaccatgttttgaccaaaccgtttattccagccaatactgccatgtgccaagctatgcaaaatccagaggatgcacaggataattatcatgtccatgctgaatctctatgctatatgaaactttagattcattcttcacttgactactgcaggagtgttgcatttgcctttcggcatatgatgatggtgcagagctgcgtgaacttccttgtgggcaccatttccactgtgcctgcattgataaatggctgcatatcaacgcaacatgccccctgtgcaagttcaatatccggaaaagtggcagtagcagtggaagtgaagaagtatgattgtgtgaatatcctccggtcgagaacaccgatccatttcaacttcacacctgtctctgctaatgcaaccacaggacctgaccagtgtaaattttgtatccaaaatgtgtgattagcgtcatatatgtacttgaagtgactcaagactgctgttcatatccacatacatggttgtccaatgtgtcttttactgtccggaatacatgcttagttgccccgtgagttgtaattcttcgagtgatcctcacatttcctgcttgtgttagcatggtttgtgcttatgctcctgccttggtcattggttcagcacaaaaactgttgtaaatgggctatcggtcctgttgaattgtcaggtacaaacgaaatgcgtcctgcttatgattcatctcttgtactctcgaagtcctacagccagttcttccgaactgaagcattttaccgagctgggagtcataaaagatgtttttgatcggtctgttgttgaactgataaggtaataaaatatttgaaatctgagttggatgtgcgcatgtagccgttctgtaatcttgcatcagatgaggaccattatggtaccgttcatcaaatccggtccagcagctttcaatacacaaaggaagcagaaatttcgaggcctgtgtttagttccacgctaaaattgaaagtttgaagaaattagaacgatgtgacggaaaagttgaaagtttgtgtgtaggaaagttcgatgtaacaaaaatttgaacgtttgaagaaaaaaaagttgaaatctaaacagggccctggtacttgtttgtgtaaagacacagcaaaccttctccttccgtcccataaaaaacgaaacgaatctagaaccagatatgatatattctatatgatgaatctgaatatatgtatgtccagattcgtagtattataataatgtgttacatctagtaccaagttggttttttataagatggagagagtagttggcaaacgagtgaagtgaagtgcgcatgaattatctcgtcagcaaaatcccatcgccgccgcaaaaagatttcaaaagaaagacggccgtacccggtacgcgtctcgtgtcgtgtctgctgctttgaaatgttcactgcgccttgggccccacgccctgttcctgttctgtgtcctgttcaatgttcatgcgtgcggccgtgttcaacgcctcccaaaacctccccccattcattcccctttcttcctctctcagctgctttcgctgtgcactccgcactcgcagtcgcggccccgcagctttccctcccggcctgattccctcttccggtctccgcttccttcctcctccctcccccgcgagttcccgaaaccctcgtaggtaggggagccgccgcgcgcgagggcgaggctgcggagcagccatggactcggcggcgctactagaggtgtaccgccgcgatcgccgcgccctcctcggattcatcctctcttccgccggcggccgcgccgtcgacctctcccgcgtggacctcgacgccgtcagcgccgactacgccctcggctgcgtcgcctccggtgagccactgtcctcgactaagtgcttgctcgtctgtgttgaggcggaggcct

SEQ ID NO: 68218 - DNA, 1705 bp, Oryza sativa
accagatatcaacctttgagggttaagtgtcttctgcaatgacaaaaatcaggattccacttagtgttccacttagattcctagatgtatgcatattaacatgatgaggactgtctgagtgtcttatgtcaaagactttatcaataagcaccctatttgtgctcatcacaaggatttattcggacacaataaattattccattttcaattttgatgatgctttttttttcaacactataacactctctacaccttggtctgcaattcaccaacgcaatgctggaatctgaattttagtttatctcatgaagtactgcttgaaagtctttctgtaactgctatatgttttccattctacagatgggctctccatcagtgaattcatattttcttctttcaaggccagaacgctctggttcccctccaaacaaagcagcacctgacattgtccctcaagcacctgctgaagagaacccaactccaattagagaacatgttgatttttttagagcagctattaacattttgggaacagataatggtactaaggatgttagtctggcagatatatatcctaagcaagtaaataaaatggatattctttcactaggtctacctaaattaagcacaggtataaaattgtgcatgcttcattttgttgtgctcttatatatattttttcgatacagctccactgaatctttgtcagatataatgtccctgtaatcattatcattttctctaatcttgtttagtaagatcaactgcggattacctaatttgttttcttgaacttattgtaaacttcttttcactttttaagaattgtcagatgacgatataagagaaacagcttatgaggtccttcttgcctcactatttgtcaggtaattttcataggaatctttctgttggccgattttatatgtaagtggtgtcaaaattgcattatatattgttgtttaaactcagcttctttaatgatgtgtaaccaacagcggaaaaatactgttctccgaagagaagaaagaaaagaagcctaaattcttaaaaggtctaaggtctaaaacagaagtatcaaatccatctcctcagccagaaaatcattattcccaacttcttgatttgatccgtgtacaaatggaggcaaggtctctttcaccaagttctgtactgtttatttttcactagtttaacaaaaaaaagtttcattctatattcttatttttatctgtgacaatgatagcaaagtatttatgttcacatgcttgccaaatgtcaacgcacgagttgtactctcttattgtttcaactagattatttttcatatttttgttgttcgttaatcatttggagcctttttttttgtttgtcctgattacaaggcaagtgaatactgttaactgtggagcaaactcactatatcaaaatgcttttttttccccagatctctgaatctatggatacattgacaaggcgagctttaagacatatcagtttgaggatcgtgcaagggcaacttgacgtgccttgcatatcattacagctcttaagttctgttgggaaatctgatttccctacagaaagactgcgagtgcagtggcagagaagacaggcaagcaagtttatttattcgtgcctatagcatgggagtttgtcctaattattgtttataattttgatatccaggcaaatgttctcgaag

SEQ ID NO: 68219 - DNA, 1319 bp, Oryza sativa
ttcaggggtacatagtgataaatttgcaacaccttgcgttttcgttctcacaacgcagaaagttcagacctaatgttatagtcatcagggctatcatcctatttaaactactatatctccagccaaaccacggatatggtactaaggctccgttcaaacagtacatgattaattgaatattatctattataaatttgataaactgatttatttattaatctttagaaaaaggttctatatagaaatcttttcacaaaatatatcacttagcattttgacaaagtgttatcaaaaataaaaaaaagttatcgtttaaagttacggaaaagaactcagcctaaaagctagctacagcatgccagcagctgttggctgctgcctttgctgccgtaacgtaagctctaagcaccaccgctgcttgctcgccatggaccaagcaaggcccaatgccgaccactacgctagctagcctgctttgctaggcccacaagcaaagaaaccagcccactacctttttctcttatctcttttttttttcatcaatcaattattccgggacgttacatcggtatcatggcctcatgggaactattctccttaaatccttgagtattctaaaacttgagaaatattcaaccgtgtttgtttggatgcaccacaaaaggaatggtttttttagatccacaaaagaaatggtacaggactttggaagaattatagatagagattttctttcacaaggttatctctctcatgtcagaaatctacttagaaacctactgtattaatttattttgcgaaaaaaatattaggaccaaaaaagcacgggttacatcggaaaaattatgttactaagtttttttaaatagaaagttcaattttactctcccgaattatttcattggagtacttcactcctaagcaattttttgggttattttacaccccaaactatttaaaacggttcaactgaccccctatctgtatttctattttttccctctctatatatgtcgtattttatactaaatctaaaaggatcgacagatgcattataacttatctctcaatattttttgaattttttttatcattgtttacataggttggaaacactagaacatatttaaacatcgaggttttaagtttaaagaaagtagttatgaaaatattttagaactttaataatagtgccatctctgccttaagaagtttagcttaaaatacagcttgtataaaagagaaataaagaagagaaatactattaagtggtaaagtgaagcatcattaatagtttatgaggcaaaagggctgcagga

SEQ ID NO: 68220 - DNA, 16269 bp, Oryza sativa
tttaggtgacactatagaatactcaagctttgtgggttcggaggagttgaattgatgggtgcaattagcagttgacccgtccgtttacactgatggtaaggcatagctgtacttgacaactggattgtcatctgtttaaatttgagattaaacaaaaaaggtgaagtacttttaccgatggatcaactggaatccccataagaaattgctaatgggcatcttagtactaatgccttctttagagttttccacttgaatacttgataggatggccaaaactttgttgactttaatctgctgtatctctttagtttagacaagtctcccagaatcagtgctgacggttcagctttctcccctaggatccaactgacaaactagcttctttgggtacatgtcagcttgttgcagaaaccatttcagaagtttattactgtttataccgatacgctttaaaacttgaaagctatatttgatggtgagtatgaaaatgagaagcgcgttagttcagcattgccccggcccggcgaattagttcaacattgccattgcaaggaaccattccacggttgtttcgctttcgtttttttttctgaacttaatttccctatcattgtatcatgtggtgaggttaagctttcgtaaatcgtccatttgcaccgatgattactggaaaaacagaactcgatgtggacgcacgcacccagttgcctcttcttcctcgacactgcaaaacagctcgtattcgtatctcctcatttgcaactgaaatgcgcttccttttctttcctgccgtcctggcatttcctctttcccgtttcaccatatgtttctctacttgcatctagccatagctggatagtactactacagttggttcgatctttataaatcgctgcataatgggaacccactcaactcctgctaaactaggaagaccaatgcaaagaattgctctatggttcaatcggttttacgtacacgaagatgcataattgtggacaataaatggtactactactctgatcctcctaacgctgaactgtaaacattttcctctcagttccctggaaacgtgaactggtggtccacagaaagatatcttaattgtgtactcctttatgtgtaaatgtagccaaatgtaacttcagttgaaatgattaaaagaaaactacagttgtgttggcttcagcaacgtcagaggacatggtttgcagctcgcgacgacgtctacggtttccttgcttggccccgatcgagacacacggtaacggcgtatagtacaaaaacagcgtcgcgtgcgcacgagccaggctcgttcaacacggcctcagggaaagcaacacgcaggcaaagaaagcgtaggaatttcggtaaaactagctgggcggcccgcgcaattgcgcggctagcatcaatttaaaattatttatttttacatatgatttcatttaaaattaacattcttgtgattataataattttatagtttttaaaaggcacgccagtcgctacccctcactcactccgttgtcacatttttatttgcttactcgatctatcactatttctattcattctcttcagaactttaaaaattaggccttatagtttttagagttcattgtgttgttgggtttcgttttcataattttaaattaggccttatagtatttagagtttattgtcttgttgagtttcgttttcataatttttagaaatatcgttaaacatcgccaatttactactctacggcccatccgctgccacctcttttttttgtcactaagattttaaaaatcaaacataattttgtttgtgttcttttttactttccatacgtctcgccaaatcgttagtggctttaccactatactcctctatagcccgcccgctgcctcccctccttattgtcattgagatttcaaaaatcgaacatgattatcattggggtttatttttactcttcataagtcccgccaaccgtcgtgaccatgctgcttaacggcatgcccatcatcactcctcttaatcgtcattaggattctatttggggttttgtttagaggttttagatatcccatcaatcgccagcactctaatcctttgtaggcctacttcttcttcactctttattgtaatttgtcatcgttgtgttctagatggacatttttcttttgaaaattgcatatctttcattccaataatttttattcgtacttgaacttttataatcattttcctatttttgaaatttattttatttgttatttcaaattttaattaatctcatcatgtgttctagattgtctcttatttcaatagtctttattatttttattacaaattttagttatttataaattgtattatagttgggctcttatttttatatttctattttctgaattatttttttattttgaattttaattaatctcgtattgtgttctatatagactatttttttaatatttcttttttatttccaatttcaattgttttaaaattgtgttcccacttgaactctcttttttatgttttctaattttggatttttatttgattttttattttgaattttaattaatatcgtattggtgtcttatatggacttttctttcaatatcgcttattttaaatttcgaatttttgttattttcaaactgtattcctacgtggactcttcttttatttccttttctctaatttcggattttattttatttttattttaaattttaattaatgtcgtattggattctcatatgtactcttctttcaatattccttatttttaattccaaattttagctatttttaaattgtattcttacttggactctttcttttttttctaatttcggattttattttatttttattccgaattttgattaatctcgtattgggttcttatatagactcttctttccatattgcttatttttttaattccgaattttagctatttttaaattgtatttctatttggactcttctttttctttttctccaattaatgtgggaatttctaacccccacagcgaacgtggtacctcctttcaaagctgttttaataatataatagtatttctacttggactcttcttttctttttcttcgattaatgtggaaatttctaacccccacagcgaacgtggtgccttctttcaaagttgttttaataatataatagataatagatagatagatagatagatagatagatagatagatgtttctcgtttttctttcctcacgaaatggacagagtctggtatagcagttccgttgctttgctgctacgcctgtttgcaaaccggccatcgccgtcagcctcttcgtgcatccccagccgattttctcttaagctctactaccttccgtataacccaggctccaactgcaaatcgttgttgatgccgtaaccaataaatcatgcatgagtcaggacggagtactcgcgcttgcggtctgatacagatactacctacacacccgctcaatccaatcaatcatgcactcgtgctaaccgaagagagagtactaatgtgtacatcagctgtgtcgattttttgtgcaagatgattatgttcctcatggccaaattgtccccctttggccctttgtcgtgtacacgtttctgatttatgaaaagagaggaaatctcgtgggatacggacgtatgcaggggttggatgcagcgtggacttgcagcgtttaaacagccaatccctcgaaaagaaagtcaatcgatcgccgtattgacatgttcagctgctcacgcgcgcacggctacaagcagggtcgtcatgggctcatggcctcataggcgcggtcgctgctgcaacctgtagctgcaggtggagacgtggtccgtggaggcggggtcgccgcacgctggctcgaaacgaggacggcgcgtcggcgagaaggccaggagcggctggcggttgacggtgtcggtcggatgtgatgatatcgagaattcgggatgatggctggcacgacacggggattttgcagagaacttcggagcggagtgggcctgcggccacgtcggggctacgggatcttggactgcttgacaacgcccctcggccctcgcagccgaaatattttgggagtacctatacaacattcagaaataaaaattttagaacataactaagtatataattgtagtgtagttatattataactactatgtagcttctgtagctcgagtataactcttaaagaagtgtgatggagcaactggttaatcgaatgagaacgtaagctgcggatttggatttggtgcagttggtagtgtgactgcaacttatacagtccactgtcagcttttagatctggatccaagggccaaaatgcgttcgggtactgtagatcactgtagcaaaattgtttagtattttttacatctgccactgtagctaatggtctggtccattcatcaatgaaatagatggctcctattgcttgcagtagcttaacttgcagtccatatacaaactgcatgtgatcccaattcgtaagctgcaggtcttgaataaggaccccactatgcgcatgttaatttttttccatcttccctcacccgcacgaatctcaaagcatatctacggttttaaatacgaaagtttccaactaacttttttaagcagtaggatagcaaatccaaataacttttttaagaactcatccgagtgatttagtgttttatgaatatatatgtcggtgacatggggccgggggtatcgtgactagaggcttgggtagccgcggtcacccacgtggcctgaccccctcggggggggggggggggtcgggcccgaggatgacgtggccacccctccctctgtctccccgaggggtcggatcgctcccgtttcggccccgagggctagggcgcccccgtttcggccccgagggctggggcgccccgaccccctgtggttttggcgccacgcgtgtgggttaggtgagcacagcggggctcacctaaccgcatttatagcagggttggacgagcgcaccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgataagagcttcctggctctcatccctagccggagccggcgtgctaactcctgcagttggtatgtcagtcccggtcagatccattccaggcttcagcgcaagtacggcaaggaagtcgctggccattaaatgaaggttgaaatgggcgtccaccggaaaagcaggcgagcggggcaggaggtgtgtgctctgcttgtcagaggtcacttctggctgtagactagccctcattgtaaaaagcatatttcccttcttaggcagctagaggcccatgtggtgaccgctgaccagataaaaaggaggcccaggcctaggagagggaaaaaagagggaaaaagaaagaggaaggagggttgggactctggggaatgggttctagaggctgaactctctctctcgctctccggcactctgtattccttcacgccacagatccaccagaacacaggagtagggtgttacgcttctcagcggcccgaacctgtctacgtcgcccgtgtcttgtgcactttctctctcgctgacgttcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcctctcccgctcagcccaatggccgaacgggcagtggcgcacagcctctctccgaacgctagcggtgacgacggggagcagaacccgcgccgtcgggctcgcacccctccgtccccctctcgccgaaatcttgggcggggggaggcgctcggggaggtcggaggatccgcgacttcgccgcccgcgggcgacgggggaggacggcgagacggggcgcgtcgccgcctcgtctacggcgatggcggcacgccccagggcgcgctcctgcgtcacccgcccgtcgtccccgatccagagactccaacccgacgttggctggatgacgtggccgacttggtcatgacggcgcagcagcgcctaggcgccgttgggcggtcctccgccaccgaggcctctggcgcagccgccgccggctccatatcgtcgaggcggagggcgcggcgagcggcggccgttacccgccgttcgtccgccattccctcgtcaacgcctccgacctaagaagatgcgcgtggggggccggatgcccgcctcgatatcgagcgccggcgcgacgttcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccgaggttccggcccaccattgtcacaccccgaagttttcctcccaagccaaatttgtaatttataaatgaccctaagaaaataccggtgcaaatcaggagaaaaccctaagaaagtaatgcaaataataatcggatttgacatgtggaattttttccctgagttctacatgtcgaaattcattaacaggatttttagtggttttttcagagctctagaaataattttaaccagttaaaattgagcaagcaatattgtaattccagggaaaatcctttttcctttttcgttttcttttccctccctttttcctctttttttttcgaatgggccgccggcccattctcccctttcctttccccctcccccttgctgggccggccgcaggccgaggcccagccaggccgcccgcctccctcctctcccggggtcgccgacaggtggggcccacctgtcgggtctttccccttcctccggccgacgccgcgcccgcaaccgccgcacccgaaaccgccgccgcgtccacgtctccgcttcctccgggccacgtcggccacgcccgcgcgtgcgccgcgtctcccgcgcccactctcctctctctcccgctcgcgcccgcgcccgagatggccgggattcgattttcgaatcccgcctctctctcttcccccactcccccacgtcggccggcgattcccgcctctcccggccacgtccggtcctctctccccctatttaagcatcgccgtcgtcccctctcactttttccccattccgccgtactctctcgagcctcccatcgctctcgcgccgtgcgcccatccgcagccgccgtttccgctactccggccgccgctagccgccgttagggtcgccgccaggccgcgccatcgccgccgtcgggttcgcgtggccgagatccaccccgtccacctctcctccgtcgaggttcgtcgccggagtcctcgttccctcgcactcgggtgagcaccacctctaccgccgccttcgaccatggcttccggtcgctgtggctcatctccctctctctaatccctctctcctccttccttagggcaccccgaagctcgtccgctcgccgacgtcgtcctcccgtggcttgccgtcgccgttcgccatcgtcttcctccgcgccggccaccctcggtgaggcatcccctcccctcttttccccttcctctcctcttagtgccgcgccgccgcttcaagtcgcgcgctgtcgccttcgaccgccgccgcctcgcgtgccgccggtcgctgccgtcgtcggtcgcatgcgtcgccggcaacgcgttcgcgcgcgcgtcgtcgccgtcgccgcggtcggtcggccggccttgagccaagccgagccgcgtgccgccgccctttctttccctctcccgggtcgctgaccagtgggccccgcatgtcggcgccgctcctccccggtccgtggacccgatccgccgtggaccgccctctcccgggtcactgaccggtgggccccgcatgtcggcgccgcactccctccgtgctgacgtcagccctggaatatattgcgcaataaatagtttaaggtttttcttgtatagtaataaacacagtgaatcttctaaaaatcataactaattcatccgagctccgtttaagcccattcaagtctcagtaaatcaagaaaactgtgccgaatccattaaaaatggttttgttccctgtttcagtagtcttatagcctgtttgcaatgtttgctttgtatgtcgctagattccgtctcctccgacgctccggtgtacttcgagatagtcgccgaggttcctccagcagcagagcaaggcaagtcatgcttgtcacttgaacatgttgatcctatattgcaaatgctctattgttttctttcaaataatgcattgttttataatattactatgggatggttacctattgttacagccatgcttttcggataccatgctcctttgttagcttggggttataacatgattagagtttggactaggaattgcttagccatgcttagttcaactagttcacaacggggaaaatcatattaatgtttagactgttggttccaatggtgtagttggattagtgacaccgtttggtgttggttaattaaaataaaccacatggtgggctgtgggtgcatggttttgctggtcgcacccatggcagttaaggaccggttcgcgggatgccctggaagaacttatcgtacttaccacaagccagcgtgggcaacggctggacttgtagtgtatctttcccctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttaatttggatagtttaggtggatggttgggcctgtcgcaacatgggttagcgttggacagtggatagttgatgttaattaattattacaactgtttaaatctttcaatttctgtttataaatgctcgctttatgcaaatgaaccacttcagctcttctttgatgattccctgcatcatacccctattccggtatgacttgctgagtacagtgggtagtactcagtcttgctctacttttcccaacctcagagttcgagttcgggtcagatgaaggtttctccgaggagtaggctttgtccgtgccgtcgaggatgcctgtggagtggtgttcccgctgcagttcaagtcgaggcttagctcctgttgtctttctttctttccgctgcatttatgtaagacttttaagatgtttgtaagacgtggatctgaatgtcaacattgtcgtttgtgtaccccggctggtcctggacggggattttaatgcacattctgcttggaattctattcgggaatttttgggcgtgacaagttggtatcagagccgaccttgatcgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagattcttcaaaacgagtcagtctagggttttagtaaaactattgggatttattcgtcagtcagttgggatttgatgggtgaaatgcattaggtcctagctcagtaacatgggttccaaggtatttatgctttgtttgttattattaatatgtatctaatttctcattattttatcgttatgtgagtcggtcttatttattcgctctcatgcaaaataatctatgcataaaattttcgctcttattcgtttcccttatttgagtcttttattgctttatttaaatttggagtctgagcatgcattgatcctacttctttgtcttctctagatggccggccacccacccaaccaccgcggagaaggcatgatcgactttgtggcagagttggcacgcatgacactggtggtgggctaccccaacgcgccagagtacacgacgattccacagctcagtggcgagcttcctcaccgtgttcgcttggaggtccacggctacgtgggtacctgcctagctaacatggtggtcgaggcatctggaggcacagcagatcatgcctgtcaggaggcagcctacttgatgatggccagactacgggagcgccacaactacatcttccacgacacggcgtaccgcttccacccccgtcgagccaacggtgatgacgtcagctccttccgtccgacagctggcgagaacgacaccacctttggtcacatgtgtgctgtgatgaggggattggacaggatgcactcggacctgcacaaggcgaccaaggccttgaacgatgggaagctcatgaggatcgtcgctctgaaggacgagatagcgcgcctgaagagggagaacgctcagctaaagggtcttccagcgccaggaggagtccggatccgcactacgccccgcaagacgacgacggcacccgtgcgcatccagcttgcgcccaggaacccacctccatccgcagctcccgcagcacctccagttccgcccgcagctccggcagttcctgcagctccagctcccgcgtccgctctctccttcgctcccgcatcagccgccaggggtccagccagtggcaatggaggttggttgtctgctactcccagtggctcagagtcaggcagtggcgagacttatctgccaggctccgggagtcgctcagagggacctggtgacgagcaggaggacgccttcgactccaccgaccgcaggagccgttccgagcattaggctcgttttccattagtttatcgactgtctagcttctgcttgttaatttgtgtgtttaggttgcttgtttggggttagtcgacggtcgatatcatgtgcctatgatatggctgtcctaataaggatttttgcttgctctttaagtgttttaattcagatcagaacaattgcagttttaattcctttgtaataaagcttagttcctgagcatctgtttttcttcttttccccgtctacttttccctccagatggtctacaccaggaatggtagccgcgcaacaggcgagggcagcaacggcgaagaacgcgctgacggtgtgcaccccagcagtgattccggcaatggtccgccaccacttcccgagaatccgacccttgcccaagttatggcacatcagactcagatgatggcagccatgatgcagcagatgcagcagcagcaccagcagatgcaccagaggatgatgcagcacgtcgaacagcagcaccagcagtttggtccccctccccctcagtccaagttgcctgagttcctacgcgtcagaccacccaccttctccagcaccacaaaccccatggaggcgaatgactggctccatgccatagagaagaagctgaatctcctgtagtgcaatgatcaggagaaggtcgctttcgccacacaccagcttcagggtcccgcgtcagcttggtgggacaatcacatggccacccgcccaccaggtactgaagtcacatgggcagagttctgccgtagcttcaggaaggcgcaggtgccagacggggtcgtggcacaaaagaagagggaattccgggcactccatcagggcaacaggactgtgacagagtacctccacgagttcaatcgcctcgcgcgatatgcaccagaggatgtccgcaccgacgctgagaagcaggagaagttcatggcgggtctggatgatgagctgaccaaccaactgatatccggggactacgctgactttgagaggctggttgacaaggcaatccgccaggaggatcaacgcaacaagatggacaggaagaggaaggccgcacagttcagggcacctcagggaagtcaccagaggccgcgcttcgctcctgggcagcagggtggacctaccaccatgatcgttcgtcagcaccgcccgttcaaccctagcaactttccccagggcgccagtggcagtcagaaccaccatggaggtcagtccaaccgcggtgcagcttcacgcccaccaatggcaccggcacagtcaggccagcccgcgcaagccaagaaggagattggagcaaaaccagggtcctgcttcaactgtggcgagcttggccacttcgctgacaaatgcccgaagcctaggagtgccgggccaaggtttatccaggctcgtgtcaaccacgcatctgcggaggaggcacaagcagcaccagaggtcgtactgggtacgttccctgttaactcaatccctgcaacagtactttttgattctggtgcgacgcattctttcatttcaaagaaatttgtcgggatgcatgggtttataagagaagaacttagcacaccgatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagttcaagggagtcatcgattgtgcgaatcgcacagtcaccttgaccaacgagaagggggaaacggtagtgtacaaatcaccagactcaccaaagcaaggagtctccttgaatcagattgaagcggaaatcccagtggacaccgtggagaggaatttgaggaaattggaagacatacccatagtctccgagtatccagaagtgttccccgaagacctcactaccatgccacccaagagagagattgaattccggattgacttggcaccgggaaccgctccaatttacaagagaccgtacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattaccgcgcactcaacgaggtcacaatcaagaacaaatatcctttgacgcgaatcgatgatttgtttgatcaactgaaaggagctaaagtgttttctaagatagacctgcgatcaggctaccaccagttgagaattcgggaagaggatattccgaagacggccttcaccactcggtacgggctatatgagtgcacggttatgtccttcggacttactaacgcacccgcattcttcatgaatctgatgaacaaagtgttcatggaatttctggacaagtttgttgaggtgttcatcgacgacattcttatctattcaaagtccgaagaagaacatgaacaacatctccgtctggtactcgagaagttgagggagcaccagctatacgccaagttcagcaagtgtgacttctggttgacggaagtcaaatttctgggccatgtcattacagctcagggtgtggcagtcgacccatcgaacgtggagtcagttaccaaatggaccccaccgaagaccgtgtcgcagattcgaagttttcttggacttgcaggttattaccgtcgattcatcgaaaatttctccagaatcgcccgacccatgactcagttgcttaagaaggatgagaagtttaaatggacagccgagtgcgataagagcttcgaggagctcaagaagaaattagtatccgcaccagttttgattctgcccgacccgatgaaagacttccaagtctattgtgatgcatcccgtcacggacttggatgtgtcctaatgcaagagggcagagtggttgcgtatgcctcgcggcagttgcgtccacacgaagggaattatccaactcatgacttggaattggcaacagtggttcatgctttgaagatctggaggcactatctgattggcaaccgctgcgaagtatatacggaccataagagtctgaaatacatcttcactcaaccggacctaaatctccgacaacgaagatggttggaactaatcaaagactatgacatgagtattcactaccacccgggtaaagccaatgtggtggcagacgctttaagccggaaaagttactgcactgccctatgcatcgagggcatgtgtgaggaattgcgacaggagtttgagcatctcaacgtgggaattgttgaactcgggttcgtagccgctctggaggcacggcctacgctcgtggatcaagttagagcagctcaagcaaatgattctgaaatagcagagctgaaaaagaacatgagagtcggaaaagcccgggatttccacgaagatgagcatggcacaatctggttgggagaaagattgtgtgtacctgacgacaaggaactgaaggatctgatactcaccgaggctcatcagacccagtactccattcacccaggcagcactaaaatgtatcaagacctcaaagaaaggttttggtgggtcagcatgaggagagaaatagctgaattcgtcgcactctgcgatgtttgccaacgagtgaaggcagagcaccaaagaccagcaggtttactccaacctcttcaaatcccggaatggaaatgggaggagattggaatggactttataacaggactgccccggacatcatcgggtcacgattcgatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctacaggaagaactggggacccgtttaaatttcagcacggcctatcacccgcaaactgatggtcagaccgagcgagtcaatcaaatcttggaagatatgttgagagcttgtgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcaaacgtcaactgttcggaacagaagtattagcggaagcagaagagaaagtcagaattatcagggaaagattgaggattgctcagtctcgacagaagagctacgcggataaccgtcgaaaggagctcacttttgaggcaggagattacgtgtatcttcgtgtcactccgctccggggagtacaccggtttcagacgaaaggcaagttggcaccacgcttcgtgggaccatacaaaatcttggaacgaaggggagaagttgcttatcagttagaacttccatccaatatgatcggcatccgtgacgtgttccatgtgtcccaattaaagaagtgcttaagggtacctgaagaacaggctgattcggagcacattgatatccagggggacctaacatatgtggagaagccggttcgtatacttgataccagcgaaagaagaaccagaaataaggtcaccaggttttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaatttgtaatttataaatgaccctaagaaaataccggtgcaaatcaggagaaaaccctaagaaagtaatgcaaataataatcggatttgacatgtggaattttttcacctctcctccgtcgaggttcgtcgccggagtcctcgttccctcgcactcgggtgagcaccacctctaccgccgccttcggccatggcttccggtcgctgtggctcatctccctctctctaatccctctctcctccttccttagggcaccccga

SEQ ID NO: 68221 - DNA, 753 bp, Oryza sativa
cccgcggttatgggcggtcaaccagattcaccgtgattagtctcaccttagtgtaatcttttaatttggatagtttaggtggatggttgggcctgtcgcaacatgggttagcgttggacagtggatagttgatgttaattaattattacaactgtttaaatctttcaatttctgtttataaatgctcgctttatgcaaatgaaccacttcagctcttctttgatgattccctgcatcatacccctattccggtatgacttgctgagtacagtgggtagtactcagtcttgctctacttttcccaacctcagagttcgagttcgggtcagatgaaggtttctccgaggagtaggctttgtccgtgccgtcgaggatgcctgtggagtggtgttcccgctgcagttcaagtcgaggcttagctcctgttgtctttctttctttccgctgcatttatgtaagacttttaagatgtttgtaagacgtggatctgaatgtcaacattgtcgtttgtgtaccccggctggtcctggacggagattttaatgcacattctgcttggaattctattcgggaatttctaggtgtgacaaccatcatcgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgc

SEQ ID NO: 68222 - DNA, 4479 bp, Oryza sativa
  unsure (1)..(4479): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaatctcacatccacggtttgctatttgaatgctagttgcccattttttgtacttatgaatatattggaggtgtcataacagccaacctaggagttgtaaaaccactggaaataccaatacaagttagggaagaccaaaaaacagccctattggtggcaaagcactggaggacacccaaaatgcaggcgatctaggtacagaagagaggaggcatcacatcatgtttgagggctatacagttcatctctatctagcattcctttcagcttccaaagcggcgccttgcttgagttcttcatgcccttcaggctccattcccatggcgagatatgccatcccttgaaggtagtgtgcagtaggccactcaggagatatgtctgctgctttctttgcatccgcaaggccttcttgcagcttgccgagcaccatgtatacgaaacttcgtcgtgccagcatagtcggagacaccattacaccagtgtcaatgaactgcaaaatgtttaaaaacacagcttagcaacctgaaaatcaatcaggaacacagtttttttaaccataatcttaatttgaggaaaagtaattgttaatgtacaagcagcgaggctatcgaaaacagagtatagatacaggaaagtgaattagattcatggacaacatttgatactctaatacatacccttgagtagcactcaactgcagtcgcaaaatccttggattgaaaagcactgtctccatgtttcttgacaagaatactatcagatacttgttggccagtccaggaatggaaagatacctgttatatacaccaaatttttaaggtatgggtcagatatgaacgggagcagtgcgaaaacatggaaaaccttcacgttaaaaaaacttggaccagccaacatggtgagaagttaagttttgtatgggatatattacaggtcaactgatggatgtataatatatcttcaaaagatacataaatgttctattgtactttcagacctatagagcaataaaaataagcatggtcaaactagttaaaagtttagcctcgagctcaaaagaatggcacttaaaacatgagctaaccattaggtttcattggtcgaagagcatgggcatcaacatagaccatctactttcttcctatcctatgccacaaaatgtgtgggctttcaacatattttgtttcatctacacaattgaaatattccaagatgacaataatgtagtaataagttccggcagtttattcctttttagggaaatggcagcaatgagttagggaaggatctatggtaccaacaagaatatttcattatgataagcttaactgacaaaaagttaatacctcgaatgttgctctttcatcctcacaatatccatcattctccagcatctcatgaacctcatcaaggtctgctctggcataaactttcgctatagcagataacgaaattcgctctgtattttccttatcatgttgtatgcctagtaaagcatgtgaaggagcctgcacagacaattaaacatcgagtaagaaatattaagctggcaggcgcgacacattaataaggagaaagatgagttggcgcatacttcaaaaaaccatttatgctaacataatatcaaatgaaaagcaaaggtagcacgttgacagaagacaaaatagttatcaaacgattgtgtggagtttttttcctgcagctttttcaatattacacaatactgttactagtctagaaagtagcaagaaaaagaaacattacagaagcatctttctggaggtttccaagagcagacaccaccgatttcaggtttggccggtcacgaccttcatactgcaagcaacgggatgctaatcgtatcaactcagttccatcagagctggagacatggccttctaagcaagagtccatcaacaccaggtaattttttcctcttataaggtcaagcgcctacagcaaaaccaagcaaagtgaatacttatcttgggtaagcagaaaagcaggaaggatagataacttacatggcttggtgggatatgttttccacttaggagatcaagcaagatagtaccaaaactgtacaccacactctctggaattactctgcctgcagaaaatgtagtggttagtaaagaaatagagactgtgtctttgatggacaaagtcataagaaaacgaggtagattttgcaacacagaattctgttgcttcactatgagagaggtcgaatgctaaatactatcccttcatgaaaaacaagtccgtgcagcttacgttgttgcctaatgtctgtggttcataaccatggtaccatagctaaaaataaacaaggtgtgaatagctaaaaataaacaatggaaacccagcaataacatttgcatagaatgatttaccccactggggaaaataactagcaaagaacatggacatactcaacaagtgtctaagagttagctcatattacgctcatattacaagtccttacttcatgatcaaacattaacaaataaaattcatgaaatgcataactcacagaaaaaaacttgcttgtatgcacaacacataccagtcttaaggtactcaggaggcgtgaaagccaaattggtactatagctcttcccatccctgctgttcttcatcagaccgaagcacgacagtctggggttaccatcctatgatttatcatcaaaacattacatgccttattactggaagcccaagctaagaagttactaagtagcacaggtactgactcaccacatcaaagagaaccctgtatgcatgcagatcatggtagagagctctccctttgctactgcagtactccaatgcctgagccacatagaatgcagctcgtaccctcattgcccagctcaatggctttgtctcccctgccaaggataaccaccatgagcgcaaaatgtagataatccaaatgcaaagtgtctactcctactgaaaacgttaaatgcaacaggaggcaaaagctctccaatttaccataacccatactaagaaccttagatgcaattgagttggatatatattctagaaaggcaataaataatgaaaacatcttgatgccaactactagtgtagtactccaaacagaacactaataacaagcatttatagaagaataaatgcattaatttctagttaacccagaagaacaaatgtaggaccagacaaaagaaacagcaaaaagagtttgttgaaggaattacttcaaccgtctccaactgaaagcaacaattcaacattagattcaggtgacaaaaacacatccatccttaaataaggggcccaatcttatcatctttgatgcctacatttgtactaccaaatcggaaacaacatttgccaaagcccaatatgtagctgcagctagtatagaacaagaagaaaaaaaaggtgagcaccaaacacatacagtggaagagatgctttgccaaggtctcgtgcggcatgaactccgcgacgagcagccgctcgccattctcgcagcagcagccgatcaggttggccagccggacactccgcagctgcccgacagccctcgcctcctcctgcacacacacacacgcaagaacggagccattcaatcgaagcggcgaaggcaaggcaagcactgatgcagatggagcaaagctgcacgaaccaagaactggcgggagtcgggccaggcagagcggccgaagcgcttgatggccacggtgcggccggtgctgaagagggtgccgcggtagacgacgttgggcgccttctcgccgtgctccgacacgatgcgctcgggagagaacccgtcggtcgccacccgtagctcgtcgaggctgtactcggcgaacaccggcacgccgctgccgtcgtccgcggcggcgccattctctgcacgtcaacaaaaccacacagatagctcggatcagcaccaaaaaagcacgacgcgcgcgtcggaatcaaccacggattctcgcgaagaggtcgcaatgctctcgacgccaagagattaccccactgaatcaaacgcaaccaactccaaacactcgcaagagcaaccgaattcgtcaacccaaccgacaaaaaaaaacaaacaaaaaaaaacatcaaatcagcaacaggttgctagagcgagagagagagtgaaaaaaaaaatgggatcgttgatgagcgttcacacaaaaaccacccactggatcagacccatttcacagcgaattccagcaggatcaacagctccacgaccgcaaaccaaagcaggagaattagagacgcaaaccgagttccccccccccccaaaaaaaaaaaaaagatccccagaaaaaacgcagcaaaaccaggcccaaatgcagggcgccaccgcaac

SEQ ID NO: 68223 - DNA, 2807 bp, Oryza sativa
tgtttgggttgtggatccaaggaaggtggtgggctttccgctccctgctttctgctgttcttcctcctctccctttctccacctcctcccctttatatattgctcctgttttttaaatccttcctcttgatctaatagcctttagctgtgggttttttcttctccttttattaatgcttttgaatttgacttaaacatggtaaaatgataaaaaaagtctgtaagaaatcatataaaatgcatgtcttgtaaaccagtataatggtgggtccggtatattagagttaaactatgaatgtgcacggtatgttttagtttgaaaccgtttttgttatatgtgcatcatatttttttttagtagagtatttatagttcatttatagctctagaactgctacggtgctacccgtgtttcaatttttatctacacacgactgtttacgttgtcacactttgattgtgtttttttaaccgtgcgtaatgcttttgaataacgtggtttctagttactggtttgccataaccatacaatggtttctcaaattttgctttacatgtgtagaagacgaccaagtaatatgataatcaaattgctgaggataatccctagcccaaatttagatacaaaagtaatactagcttataatatattatcttgacagacgataattctgattaaaaacaactagtatttgtttaggataaatgaggatgattcttggcccaatgtataaattgtttgctttacatagcagaggtaactgcaacttatctatttgaaaaaaaaaaagcagtccaatgatatctgtatatcaatgattactccaaaacaaaacaaacagttagttaggtaactaaattattgataggataacaaatactccagctcatagtcacttcagtcactactcactaaccttttccagtttttcagctagtaacgctaattttctgtttcagatagagtactttcagaaagaattcagaatagctcgtatctgctgaagcaacggcaggatgctacgtagcccaagcgtgataaccttgtataccactgacatgtggccccgctcgtttgacgtggccccacgtgcctttggtgtcaagatgcttcagctcatgttggttgtttttgcagaaaatatttgcgttattagttttgccaggtaattaatttactaataatttataatagtcattgacagtgggaccacctaacttacaattgtcactggttcgtgggaccaccagcagtttggagccagtcttgaacgggaccaccatttactaatatcaaatttaacactaattaaattggttagttgttcatactactaactaaatttcataattgttttaaaaaaaatcgaattggttgtcaaaaattgtccttgttgcaagcggtcatatcatcaaagtggagatagctgaataggctccatctttccccatcacaatttggacatgttcatgtcaacagtttatatacactgttctgtgagtattatgtgagcaggtaatctatccactgtttttgtagtagtagtttttttttttgggtaaggtgagaaacggcggcgagttgggcacatgctgcacagataaagatgcattacgaggaaggtcgctgttaaacaaaagttctcgtccttaattaacagataaacatcacatgctgccctgttaagcaacgatcgatttgaccaggagtaccaagcaaagactttagggaccaacgactcttgcattcacagcgcacagaagaaaatggttccagttttttcaaatgcatgtgttactgaacaacggagtacataaaaacatcatgaacagtgaatattagagaatgtgttattctatggcattatcgccctaggctacaaattattttttaaggaaattaggctacaaaggttaccttaggtagtggacggacaggcttaaagcaggaaagtagatgcataaatgttgactaaacaaacaatgattaaagctcttccaaagggaatccatcctccatcgatctaattgtgatcatataagaaaatatagtaaatattaaacagactgaaaatagtatttattactacctccgttccaaaatgtaagctaaaaatgcttacattttggaacggaggtaataagttacaagcatgtgcttacattttgggacggagataataagttacaagcatgtgcttatattttgggacggaggtaataggttacaagcatgcacctactagttaattcaaatgtaaagccggtaaagagaaagttcctctgaaacgcatggttttaaaaacacataaatagaaaaaatgaactatataggatgtctcaccttgtgaattcatacgggaatgtcgcaaaatagtcatttaattgaatgaaatgcgctcgtagcgcagtggcagggtcgctggcacgcaccccattggcccgggttcgatccttgtcgagcgcccttaccaggggaaatatttacctcttcgttcttaaaaccattgacaccaagtcctttcttggtgtccaacctttttcttttgtcatttaattgaataatgtgcatgaaaaaaataagcataaaaaatcatgaggtaaagacctcggatttgttttcctaccaactccctttagaatggcccattttataagattttcaaaggaaatataaagcattaatctttcgttcctaatctccataggaattttttcgtaaggattcagggtcattttggttgatgccgaaatatgccatactaaataactgtcactttaagtagtacattggctagcatttggtt

SEQ ID NO: 68224 - DNA, 6352 bp, Oryza sativa
ttgaaaaaaaaaacattggtgctaccaaaagttaagttttgacattattaaaattttagcacggtaacaaaccaaacaagcccacaaatcctcctaacatcctctttttttttaagggagccatgtccagggtttacgattccgagatggccttccatttcgggctttggcggaatgacggctttcgtgaaatctggtgaaaagccggtagattccgaacaaattttataaaccaaaatttgaatacaaattctctgagtttaccgataagtttgcgaaaaccggtcggttttgacaaaattccgagtgaaatcatcgaaatttcaatcggtaactagaaaaagaggtaattaaattgaaagtgtttttctttttttttcattcgttattcttttcttttctactgtaaatttcagtaaatacacggaatacatcttttttttcgaaattttatgtcctaataggttctatgaatatcatattgtttataagattttattttatttttttgttttttatcaattcaaatttgatcatcgaaatctcaaacggcttctagtttcgagccttgtcaaaacctcgaaaattcgcagaattcgaccgatttccattggaattgtgaaccctggccctgtcacagcttggccctagttgggagaaaaccgggcatttagcttgcttgcctgtagaggggtaaatagcatgagtaaatatataggccaatttaactacatgatatgtatggtagatatctaaaaagctatcacgactgaaagacactataaaagcctgataatttgttggatgccactttcggctcaattggagagaaattttaaaaagacgagaatgcttatagggtcaaaagctttttagctgaagctacaatgaagatgaaaacatgctgtatactaacgatgtatttaggctgatgataaatttagagttgtatgatttctaaatctattatattattaaagtaatagaaaaaggagcctccacgttcgctctcatggcctagaaattctcacattaatcggagaaaaagaaaaggcagagtccatatagaaatacaatttagaaatagccgaaattcggaattaaaaaataaggaatattagaagaggatactagagtccatatagaaatacaattagaaaataactgaaattcagaattaaaaataaggaatattagaagtatagtatagagtccatatagaaatacaattaggaaataatagaaatttagaattaaaaataaggaatattagaagtagagtccatatagaaatacaattaagaaaaaaatagaaattcggaattaaaaaataaggaatattagaagtagagtatagagtccatataggaatttaaaactaactaaaatttggaataaacataataaaattaaaagtagattttttagagtccgtataaaaatacaatttacaaataactaaaattcgaaattaagaaaaacatggaaataagaatttaaagtcaatataggaatacaatttagaagtaactgaaattcgaaattaaaaattaaagaatattgaaagatgagtttagagtccacatagaaatacaattagaaataataaaaattcagaataaaaataaataatattggaagaagagcatagagtctatatagaaatacaatttacagaaaattcggaattaaaaaaaagaaatattaaaagacgagtctagagtccatatatgaatatatataatttacaaataactaaaatttgatattaaaaataattaataactaacacgtatataaaatacaatatgaatattacacattagtagttttgtaaagttattgcaaaatttaaaattatgatgtcattgtaatatatttaaataatataatgagaaaacatatatgctattatatgagagaaaatataatgatgctagccgcgcaatctgcgcgggcaccatgctagtttttataataatattatgtttgaagcatgtggtataaagggcgttctcgttttttttaagaatttatcgttctaattgagacaaaaatatccttcaacaaatcaccaattttttaactatcttttggttgtaacactttctcacgatgtctcaaattgtatagattttgggtgacccgcaacaaaatttgtcaaatataggagtatattgtgaagagcttcgtcttgcttgcacttgcagagagtttcaggcgtacgtacagtctgcaggtctgcattgcctccggcagcaacagaagccgaggaagcgaaagcagccatgggctgtcgcgtcgaggagccctacaaacaaaccgtgcgcccgcggcggcaggcggcggcagcggcagaggcccggccaacacgagcacgggccaccagccacagcaccagtacgtactactagtacaccaccaccaccctacccacccctgcacgaacggcgacacgcaccgcacggccgcacgcacgcaccgcgcgcggcggacaagcaaagcacaagcggcagcacagggccggccagcctcgtgagccctagccagtactagtactcctccagtagccagtagtagtatcatgtccgcccatgcacctccgcatctctgatcacctcgatctcaccatttgctcgagtgagccaggcagcagcgtcgcaccgcacactggacgtcggcacgctctgcaccacaagcagcaccagcagacagatcacacagatgggaaggccgacgtgcagattgtgttgtgtgagagagagctctttcttctccgtgcatgtgcctgaggagaaatcttttgcttgtcactgctgctgtgccacggccacgggagacgggaccgacgcgtatccggcttcaattccatcacgcactggtacgtgtggatggagtcgtcaatcaatatcaaatcaatcagttcgtgcgtgcgtgcttccatacatctcgtccgtcctgcctcacaggacaaacacactgcaatacggagtattcagctcacgaaaaaactgtggtttgctgctgtatgaagaacaaaattaaatacgcccacgtgtgtgtgaaatccgccgctgcagtagtgcagtactcccggccgcaccgcgtacagtacgtactacaggtacgctgcgtgtgtaagtatccatgaatatccgccattggatcctggcgctcgtacccaacgtaccagatgacacgtccctgtgctgctgcgaacatgtgattatgaagcaattccatttccacagtgattatgaaaataatcccattagaaacggaggagaagtccacatggcactgtggatttacgtctacggagtacttcagctagaggtgaggtgaggcggaaaaggagattcaccgaacgaaatgaatcaaccgaggaataacccggcttacgtgcgagcgttccttgcatgcgtgcactggattcggggattcggccgatccgcgagcacggcacgacttgtttcgtcgcgcgcgaggctggcggattcgcgggtcgattcgccggcgcgcacaggagtggagtggagagtaatgtgtcgatcgagtggcctcggaagttggggctacagatagaagagaggggtagcttgcagaaaaccaggacggatttatgcatgcagagcctccgtcacgtcgtcgatcggcaatgcaccattgatgcgaggtgaaggtcgggttggtggcaatcatggccctgtagcaatgggcgccgcagagatcagatggtcggagttgagtgacagatattctttctccgtcgatctctatccatgctgctgctgctgcctgcacgcatgcatacagtgttcgttcctactctcagctctcgtctcctcctgctcatgcatgatgcgcggctatatggctggagtagagtacctaggtatagcacggtgcacagctctagctttagctagcgacatgttggatcgaatctggcctgtttggtttgcagggacttactctctaagtctctttcatatcgaatgtttagaaactaatttaaagtattaaacatacactaattataaaacctatttcataaccttggactaatccgcgagatgaatcttttgagtctaattatgctatgattttgacaatgggatgctacattaaacttttgataattatagattaattaggcttaaaaaattcgtcttgcggattaactctcatttatggaattagtttttttattagtatatatttaatacttcaaattagcatccaaacatctgatgtgacatgggctaaaaagttttagccccatctaaacaccctagctcagctctgacatggaagatcttcccaacagttatcaacgccaacaacagatcgtattctgcgttgcgttgcgtgtgcatgctactcgatgggagtactatatactcctatattaaggctgtgttcagaggcaacatatcctatacacaccggccctcacgtgtacacacgtgcacatcaactaaaaaatgtcaccaaaaaatctagaaaaaatcatacacatactttcaattgtattacacctagggttaaaatcttaacgtcaaattcattatattttagccgtaacaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcttagaattttttgtaataatttttagttggtgtacacgacgcgagggcctgtgtgcataggatacgctcccgtgtttagattagaggtgtaaagttttaatgtgttatagcagatatacgaacgcatatttgaaatattaaatatagactaataacaaaacaaattacagaatccgtctgtaaactgcgagatgaatttattaagcctagttaatccgtcattagcaaatatttactgtatcaccacattatcatatcatggagcaattaggcttaaaagattcggctcgcaatttacatgcagtctgtataattaattattatttttatttatatttaatactctatacatatgtctaaacattcgatgcgacagtgtaaaaattttaccaggagatctacacagggcctaaccccagctactgatctgatcagctaaacgaagttgatctccaggctgcttagattagactgttttgtgtttgtatccctctaaagtgcggaggaagtgattccattccgtggatagctaggccttgcgcgcaagcgacgcgaagccgcgaacgaactgaagccaacctggattaagttgagggcagctagaaagcgtcaaggcctgcagcccatcggagaggccagcatacagatgcttatcagattacgccgcctttgtttatgttatgcagatgtgctaatcaattgctccccaaaacaacgaaagcgaaagggagcgagcgagatgagatgctgcatgctcatgcttaattatatactcctactcctaacaagagagggaccatgtaggtacgtacgtacagctgacagttgtttgtacctgctggttgctggattcctttgaggcttaatcaaccagcagggggtgattaaaaataatctgaagtgtccaaagagaaaggaaagaaacaaacatcagtagctgcatagtagcatgtatagcaaggggtagtagaaaggaggagagggagaggcagaaaggagagggaggcaggggaaagcgcggtgtccccgtggcgtcgcgggcgcggggggcacggcggcagcagaacgtgtgcagcgtcgtccccacggccacatgctgtcgtgtcgtgtcgcctcgcatatcgccttcggtcgttcgttcgtcccccacacctccacttttcgatcgacctgcggctggcgcaggatgcagtacgaagcagtccagtccttcctatcctacctcggcgttctactagtgtcgatcaagcatcgaaatggtatactaatactactgcacatgcccatgggccatggcttgatggctagatgatgacatttttatctgcgttgctctcatccacctcagttttttggcgtttttggtgatataataagggcgaaaagcaccttggtatgtataatcggtaatcccagacacctgtgtgtttctttgaactcgacttgtcaattactatgtatctggctcacacctagtggattaacaggtgatgagtgagtggtacatcaaatgatactgcgagacatgtgctgatctagaaaaatcgaaaaaaacggaaggaagaaattaagaagcgagctagacatgacggctcggtgatgatcagggccaaatagcgagc

SEQ ID NO: 68225 - DNA, 12929 bp, Oryza sativa
ttcgtactgtgcactgcatcggcatcgcctgctaccatttttgtcgtcgcgtgactggaaatagaagctggagggcaaaggctgcgcaaccgcgccgcgcggtgagaaagaacacctgtttggcaactgcgcggtgaaaaagaagaaaaagaagaagaagaagcccacatgtttctgttttgttttcttttacgtttgaacgacgctgcgtgtatgtgactggtgtgtgggctccaccacgtacgagctgttgctcgtcagtgggatgaccagccaatgcaacgcaaaagtagagagaggggtttgcgctgctacgacgtcgatctcgtgtatatcatgcaacgctcccctcctcttcttcgtgcaaggacgcaatagctagagccacttctccagagaacgagagagagagagagaaggcttaggttagaatggctcccgttctcctggtggtggtcggctcgtcggcggcggcgtgggccgacgtgcccgccggcagccgggtgcaggtcgtgcaggtagcctgcggcgcgaggcgtccggcgacgacgtcgatggcggtccgctgcgtcggccgcggtggcggcaagacgggtccggtccttggcaagccttccgacgacgacgacgacgacgtacgtgcatgtatggatctcctcctttcccctcctccttctttacaggttttcgcctgcacaaagacggtctatgaagtagtcgaagcgtgttcttttcgtgtcttttcttgtgttctgcttgtgctgttgtgcatgtcggctgtcgcgcgtttcctgcgtcagatcgaaccaagtatttgtttcttgggttcaggcgttaagcaggtgcgtttcttggggttctttcttgtttctccctgtgcatgacgcgttcctgagccagatcgaaccaagtatgtgtttcttgggttcaggcgttgagcaggtgcgtttcttggggttctttcttgtttctccctgtgcatgatgcgtttgctgcgtcagatcggaccaagtgtgtgtttcttgggctcaggcgttaagcaggtgcgattcttggggttctttctcgtttctgcttgtgcgtgttgcgttcttgcatcagaacgtacatcagacgtaccgtgcgcatgacattgttttgtttgcccctgtttgcgttcttgcacgagatcgtgctttgctatgctcttgtttctcgtttctgcttgctcgtgttgcgttcttgcaccaaatcgtgcatgtacgacgtacgcacgttgtttgcttcgctcctctattcctcttctcttgcctatcacgcaggaatctttgatcagttgatttcttgcacgtacacgtacttaccaccggtcagactcagatctgctcgtttaattttgacctgtttatcgacgatccatcacctccgtccttatttttccttgcaagttttgcctgtgcaaagtcggtctgaaaagcagaagcaggtgtgttcttttggagtatttctattttcagctttgctcgtccgcgtagcgtccctgcacgcaccagattcaaggaggtgtgtttcttggggatctttctttttgtttctgcaagtgtatggttcttgcaccaagtcgtgcatgtatgttgttttctttgctcctgttcatcgatatttgggcctttcgtttgctgcgaagcttgcagatttccttctctttttaccgaagctgtggttccttttttttttcagagaagaaattagaaatacaacggattccagttgttcttgtgagatattttttaggattttgtttgtgacgtcctattcgatcttctgatgcaccaaatctcttattaatttccaagctactgcttttgttactgttgaagcttcagtttttttccctttctgaaacggaagcttcagttttctggttgctttgaaactagtaataatagttttgatggctaatttggtctctgtttgcggcaaattgcagacgaagctggtcaagatcgccttcaggatggccgtggtgacggccgttttcttgaggagagttcaggcgaattccaactgcgccgacatgtctctgcaggtgtcgagcctgcaagaggagtgcgcccgtttcctggattcgttcgtggccggggaggagatcgcgggccacgacgcggtccgcatgctcgtcggctgccatgacaagctgaccgtggttctctccgcctacggcggcgccggccgggacgacgtcgacgagggacaggcgccgccggtcgtcgtcccgcccggaggacagatcgacacccacctcctcgacttgttcctcattgggacctccgagctaccaaccaactggtctgacagagtaaggacactgatcgatgatcgatctgttgtagtagtagcttttgttgttggttgagcattactacattacatgtatggattaacttactgaccgactgtctgtgtgcattgatcgatcgcttttgcttgtgaattgtgatagaccctcgttgcccagctgacgtgctctctgtaccgggcaattgaagcagtcaccaagttcatcgccaccacggagaagggggttcctctcgagcaagcagatgcagaggggaggtctcctccacctcctgaagaggaaggagggaaagcgtagatgttactcagtcagcagaaaggaggaaggagtactttttgggaggtcattagaactcagtcagcagtagtaatcatcctaagtacggagaagtagcatttagttcttctgatgttttggaaccttaccatgctgtttagtattcctaattaagtcctactgctactatcatgtagtaacgtgctatccgccgatggttatcaaataacatcatgtgaactttgcaacagctgcttctttttagtaagtaatagttcattcccttttgttaaatcttgatcttctttctctgtggctttgcttaaatttgctcgatttcgtttagaagaaatcagcccaactgattcttttcctaaatacgagagacagatgatcttatctctaagctattttcctggagacgaatcgaagcgaatcctagatcccacgatgatagttagggcacggcaacgatggtatttatagatagggcacgcacgaaacggaggagaccaaaccaaaccaaaccaaaccaaaccaaaccgaggtgaaattgaaccggcgctccctcgtcttccgtcgccatcgccgtcgcgtcgcacccaaggtatctgcttcaattcagccctgcttgctagctaccgcttcacgatctacacagatcgaactgaaacttgatgagatttgttcaatgttcatggctgacaggtgacgggtaatgggggcgtgctactactaccaacccctccggccgccgccgtgcccttccgttccttgcggccaaaaggcacagcggcaacctctctttcgcagcagccatcagagtctgcatgttgcatctaaggcggccgggctgaccagcagcagcagtagatcaaaagatgtgaagttgagggctatcttacatgaggacagtgttactggtgttagaccatggtttagcctgttcggaatgtccttttctgatctttatgatcacttccctgaatctgtctgggacatctgtgaggattcccctgccgaagcttttgagaagaaggtaatagaatttgttttctcctttacaaacttaagtgttcttaaccatcttcttgattcttgagtgcaaatttcattttcattatattgttactgtcagttttcttgtcaataactcaatactcatgtttcaagctaaagcaaagacttcccttttttttttaaaaaaaaagattaattgatcatgattgacaacaacacgggagatctctactgtatacaggtttaatttgtttttggccatatatagggtaattagggtacatttttctacttgcgcatctttactaattctaattctgaggatcaggagcataaggggtggatgcaatttcggagtgaaatgaacagcagatacaacaaagccgtggacataagttttgacgataggtttgctgattccattgtgtttgacaaaacactctacaagtatgcaattttgggttgcaaggtcaatgcggatgggattatgaatcaggtattctcagcatgtgcaatcactcatacttctcccttccgaaaatatactgtttagtcacccattaaatttatttacaccagatgccactgtcttcatgcctaatgatttagtattgaccaacgatttatgataatttgccaaaattgcttcctggatgtgctagtttagggcccgttgctataaatttctctcaagagcaaacaaaacacaagtttcttcgttaagaagaagagaaatgacataccatggtggtgaacaaaccaagcacttaaataacgatgttttttttttgaaaccctaaataacgatgttttgacaaccgcgtagataaaataatgcccctcaaccatggaagatcaatatattagtatacctctatatagtctcgtcaataggccttttatatatgagatatcttacgaaaacatctgttgttgtagggtgttatatctgccagtgaaagaaataaaattatccatgctcttgaaaggatagaaggtgacattgagattggaaagttcaagtggagagatggcgctgatattcatacaagcattgtggaagcacttgctgatatgattggggacaaagcgaaggatcttgcagtggaaagtaaatatgatagttgcctcatgatactggaaacatggtccaaaaactccattgatcatattatgactcaattgaaacaacttcaggtttgttttcttttatctttttagtttcatggtatactctaaaacgttgtttgggaagatatatatgcacttgattgtttaattatgaccctttttcctttgttcactcgctatattagattcatgttagttttagcatacattcgtagtatgtggttcaattaaagctgtatgatgattttctgttgcaggttgctctagttctgttagcaataaaaaatgatggggttatccttggtgagagagagattgagggcaccacatgcctggagagtcttcttctgcgcattgtcaaagtggtaattttccaacatggactcaagtatccttggcagcatagaaccttttcttttctcaaacacgcaagagaattgcgtatcatttcatcaaagaagcttaaaactgtctggtacgtagatgaacataataacaatacttacttatttgggagtcttgggactgcaccaaaaccatagagatgggaatgtgcaaccgaatgtacttcttaacataacaggccatatcacaatgaatctgtgtttgctgctcacataaatatttcattacctatttattgcccatttcgccttgtattgtatctaaaccagttttctgcccttttcattatatagctagactatgatgcttccaaacttcgttcctatcatggaagcatttcttgctcaaatgatggtgtcatgcttctgaggaccaggtttttgctgctactagtttatcatttttacgcccccaatttacatctccagctctcccaccctcttcaatattttgttcacttgcttctattaattatttatgtgaacaggggcatagttctgtatttttaatatgtacttctatactcttttgattgagccaattttatcttccatatatgtgtctctaaacaaagaaatgatatcataggcttgattaattattgcactttttgatgggagattaatctatctattaatttactaaagtaatagaaaaataagcctccacgttagctctcgcgacctagaaattctcatattaatcggagaaaaagaaaaacgtaatacatatacaaatactcctacaatttaaaatagctaaaaattcaaaactaaaaatataaggaatattggaagaggagactagagtcaataccaacatacagtttggaactaatgaaaattagaaattaaaaataagaaaaattaaaagtacaggttagagtatataggagtacaatttagaaataactaaaatccgatattaaaaataattaataactatcatgtatatacgaaatatgaatactacatattggtagtttggtaaagttagtacaaaatttaaaattatgttgtcattttaatatattttaattaaaaaatatatactattttatgatagaaaatatatggatgcttgccacgcaatctgcatgcagggctaccatgctagttattattatactaatggtagtaatcgtccttttttttggtgttgcgttctccacttttaatccgatgttacttcataggaactttgactattctaggggtttttgaaacgcaactatttctaggtgttataaatatttaactatgttgtgcttgttatgcttcataaacttgcccgccaagtgcaatctaagaagttacgcacttctaaattttaatatatagcaagtcatcatgactaatttctaaaaagagggaaaatgtcacattgtttggttcgtaatgtttgctttaaaatttttaaaaaggaaaacctatttttttaaatacttctaataccccatgagccctataatttttttgctcatcttttaccatctaaactatgcagctatccagaaaatcagatgttttccaagctttcttccatggcctcgtttgcagaatcaatcaacaattgcatccccaaccatctaaggcaactgcttgagaaggttttgtccaggaggaatatactgttactcacaccaaatggtgaaacaacgatatatgacacagtcctatccaagtttggttccattgaacagacaaggcatcatggagatgttgctatctcaaaatgtctaaatattggatttcgaaatgtacgtgaatcacctcagacatgtgaaatcgaggtaaaaatgatcttaaatttttgccgggtaaaaatgatcttaaattagcatattcgtaaagcgtgtcatcctacatcatggtatagattggttctaacaaagtgtgttttcttgggataggacgctaagcactatttattttctagcactaaatctgtggtcgaaattctcgatctatccatacaacttgttctaaggatcttgtttggcatggaaaaggcccaaaattccctcccaagaggatatcatgatgttatgaggtttacacatttcctgacaacgaaggtgagagttttgcttttttttttataggtaactccggtatttcattttatttttgccgtatgccttaattagctcgagttcatttgaatcaggcttatcattctttctcacaaaagaaagctaaacatgagtactccattatgatttggaggaataataacgtattagtctcagcctttccatgctctagcaaatggttaatatgttaatggtatttgcaatgagcagggaatcgatttgggcacagcttatgccttggtccatctgtgcttggataaaaagctccaaccttcggagctcattctagacaaacacgagctaaagcagatcgattttcactgtgagcgtgctcattacctcctggaatacaaagggagcatctttggtgattccaccgatctggatgcctgcaagaagatgctgaaatggtgttgcaaacttcgcattgatcctgctgcgaccatctcttcttgattcccacgattcaatgcactcaatagagaattagggatattgtgctatctcgaactcatgtttaattagcaacgaatttggtagtcatcacgtttaattagcaaatgtattctcatatatcaagattgagttagggtcctattatagtctaatggacttgaaagtgcatgaacctgtattcgttgttatggcattagattatgaatgtgcaagttgccagtcacatgataatcttgatccctgtgaagatcatccaatacagcaataattaagtgcacaaaagtaacttaaaatctctgcgccccatcatttcgcttattcgtggaatttaaaaataatctgtgaaaaacttttatatacatattcttagcgatctaaaagcaaaggctaaaaaataaacttcgatgaaaaaaaacccaaaatcaactacaaatttaaggttgaaaaattcaaattttagctgataagcataaacaaaaagatgaggttgctacaacatgtactatttttaaaaagctgaaacacaaccaaatcacctcgtgaaacatttttctataacgtatgaaacaacagttttaaaaaaaaatgggcgtcatttcaccctatataaaaacaatgtttcaacaaatagtgaacgaatgttttaattcactgcaacatttgatccatacatagtaaaacatcacgagtatactttactaaaacattgttggtggaacaaaaaaaataaaacggatttccttaatagaaatgttttcgcaatatacgggtgctttgttgcaacgacgcgtgtggtggggcgcgtggaaggggggggggggacaacgtgggaggcggcgggcacccgacttttttgccgctgattgggcacccgatcgcttgcattttccaaataatatagcttgatcagtttttagagagataacagagaaaatagctacaaattgcaaaaattgaaattaactataaaatcacagcttgattaaaaacctataaaggcagaggttacaacgggcggcacggcccaggcccggccgtgcctgggccgagggtagtcgggccggcacagcccgacctacacaccgggccgtgccgtgccagcccacgggccatacacacggcccaggcacggcccaagatggctcgggccgtgccgggccggcccaaaggcacgacggcccatcgtgcttttccacagaataaatctaatttttctccctcctcttgggctgtgacatatatatagctaaaaaaaagtctattcccccctcttctttgagctgacatataaattgctgaataagtctatttttaggccctatattttggaccgtgacattaatatgtctatttttagtcctatactttgtgtaccgggcctggcctgccggcccatcgtgccgagtcagcccagcgtaccggtggggaggtccaggcacgggcccaacccaagtcgggccgtaccgtgcttgggccgggccgtggtccgggcctcgggccttatggccatccatacctccgtgaaacaaattgaagaggaagctcatcaagatagtaatcaggcttagatgacggcccgtctgctggagagagttcatgcgaggccgctcgggtgcaccgacagcgacaagctggagatgtctctgcagctgacgagcgtgcgcgagcagtgcgcccgtctcctggaggcggtggaggcaggggagatcgccggccacgccgccgcggcccgcctcttcggcagctaccactccaagctgcgcgtgcttctcgccgtccacggcggcggccacctcgacgccgccgccgctcgccgtcccgccgcccggtggacagatcgatcgccgcctcctcgccaagttcggcatctacgccttcgagctgccaaccaactgggttgacaaggtgatgatccattaattaacttttgcttggtggtggagcaaattttctttatgaattctttttttttgaaacgaacttttttctttatgaattcactaattaccttactaacaagtgcgcaaattgctttgattgtgatgatagtccctcattgcgtccatgatgcgcaccctggagtacgcgatggatgaagcaaaggatttcatgagcgtcacagatgagcaggatgaggcagaggaaggggacgatggtgatgatggaaaggcgtagctgtcagcaagttcttaaccaactggaaggcaattagggctcagtcaagagtagtactagttcttttaagtgtttttggcgcgcattacacctaatctagcttaagatgcttctgctgctgctactactactactatgttatctatctagtactagtactacctgctactactaccatgtaacgcctatgggctatcttgtgaactttgcagcagctatcttgtcttaactatggcttgatctttttcacctgtcttgcttattaaacctgctcaatttcgtctagaaatcagccggttgattttgttcctaaataagttatgatctccccctgtctcgcgtaaattcgctcaaatttgtttagaaatcagcccgactgattttgttcccaagtaaacgagagacggatatatatgatcatgatcttatctaccccttgctattttcctggagatgaatcgatgcgaatcctaggttggttggtcacggcagtatttatagatactgcacgaaacggaggagaccaccaaccaaaccgaaccgaaatagaagcggtttaggtgaattggaagcggccgcgccggcgatctctcgtcttccgccgccgccgccgcggcgtggtaccaaaggtagtatcttctttaattccgccatgcttgctagtagctactagatctacatacatactgagattgaagtgaaacctgagattgttcttgaattgcaactcgagattgttcaattttgatgacctgtttgttgacagttcgaccgtaatgagggcgtgctgctactatcaacctctccggccaccgtgcccttccattcctcttggccataagccccagcagcatcatctctttctcagcagcagatcaaaagatgtcaagttgaggtctatcttagatgaggacaggcttactggtgctagaccatggtatagcctgttcggaatgttcttgagtacggattaattatcttgtcattatattgctaatcatgtttcaaggtacagtaatgacttcttctttgattgatcttgactgacaacagtacggtagatctgtcctgtatataggtttagggcttgttcactttaatgttattttcaaccttaccaagttttggtgaagttgccaaaaaattggctacatttagtttgttgccaaattttagtaactatataagaaattctgctaaaattttggcaagttatcaaaattttggcaactatgtcaaaatttaatttggtaaggtttattttggcatcaaagtgaacatgcccttaattgtttttgcccatataaagggaaattaggatacttttttctagttatatatatgcactaataattctagctctaaagatcaggagcataaggggtggatgcaacttcggaacgcaatgaacaacagatacatcagagccttggacacaaattttgacgagagctttgttgattccattgtgtttgacaaaacactatacaagtatgcaattttgggttgcaaggtcaatgcagatggaattatgaacgaggtattctcaccatgttcaatcactcatacttcctttcgagaatatcctgttcagtcaaccattacatatcttaacaccagttgcctttgaatccagcatcttcataccttatccttcaagctaatattttagtattcatcaaggatttatgacaatttgccaaaactgcgtcctgtatgttctagtttagggttatttactacattttctctaaagagcaaacaaaagcacttccgttaagaagagagaaatactataacatggcggcgaacaaaccaggaacctagataaaaacatctcgacatcccctcagataaaactaaatgaaatcaactgcaactaatgccgttatatgaaatttttctatatgaaaccagacttctagataaaaaaatctctatatgaaatttcttataaaaaacatccaatggtgtagggtattatatcttccagtgaaagaaataaaattatccatgctcttgaaaggatagaagatgacattgagattggaaagttcaagtggagagatggtgcagatgttcatacaagtattgtggaagcacttgctgatatgattggggaccaagcaaagggtcttgccgtagaaagcaaatgtgacagttgcctcatgatactggaaacatggtccaagaactccattgatcatattatgactcaattgaaacaacttcaggttccttttctgctttttttttgtaagttctcaagatatattcttactattcagcattttttatagttttgatggtatattgtgttgttcgggaagatatatactcaagcatttcattgtttaattatgacccttttcctttgttcactctttaacatcggattattgttaattctagcatacattaattcgtagtatgtggttcagttaaagttgcatgaaaattctctgttgcaggctgctctcgttttgttagcaataaaaaatgatgggtttgttcttcctggtgagaaagaaattgagggcaccagtcttcttatgcgcattgtcaaagcggtaattttctatattctaccactgaaccaaaacatacttatgaacatagccagccatatcacaataaatctgtatttgcttaatggtttactatccatataatattacattacccattgccttgtgctgtatctaataccagttttctgtccttttaattatacagctagacagtgatgcttcaaaacttcgtaactgtcttggaggcatttgctctaccgatggtgtcatatttatgaggctcaggtttttgctgatacttgtccactatttttagtttttttttcaccctcaatctcctgatcatctagccctccatgtctccaccctcttctgtatttttctcttggcttattgactatttgtgtaaaacggaatgtgtttttgtattttgaatatgtacttgtatacgcttttgattgagccaattttatcttgcataatattgtgtgtataaacaaag

SEQ ID NO: 68226 - DNA, 15587 bp, Oryza sativa
tttttataatttaagagcttttcaaacataaacatgttaaattatcatccaacataattcacataatgtttcaatgtatatcttcatactaaattcccgcagcaatgggcggggtttcacctagtttaacaaatagcaagtcatcatgactatttttcagaaagtggcagaatggtccatttttcggttagcagttttgctttaaaatttttgggaaggataacctgaaatacttcaatatatcttgccccgtaagtctgataaatgctaagtttttttccccatctaaatgatgcagttctcctgaagattacacactttccaagctttcttacattgcctggtttgcaaattcaatcaattatcgtattcccaaccttctaaggcaactgcttgagaaggttttgtccctgagaaacgctgaaacagccatatatgagacaaccctaggaaagttgagttctatcgaacagatgaggcgtcatggagatgttgctatctcaaaatgtctaaatcttagatttggaaaagcatgcggatcagtgcagacttgtgaaatcgaggtaaaaatggtcctatattctttcttacagtgcgtcatggtatagtttttggttctaacaaagtgcgttttccttgataggatgctaagcaccatttattttctagcactaaatcagtggttgaaattctcgacctatctatacaacttgttaaaagcatctcgtttgatatggaaaaggcccaaaattgcctccccagaggctatgatgatattatgaggtttgcgcatttcctgacaacaaaggtgagtaactcctgtatttcgttaaatcaggttttgtcgttctttcccctcttgaaaaagaaaaatcttttctcaatgaaagaaagatcacgctcttatcattcaaaaagaaaattcttttctcaatgaaagaaagatcacgctcttatcagtcaacaagtataggataaaaaggtgtttatatgatcactccagaatgatttggataatctcagctttttcatgctttggcaaatggttaatatgttaatggtatttgcaataagcagggaatcgattcggtaacagcttatgccttggtccatctgtgcttggataaacagctccaaccttcggagctcactctagaaaaacgcgagctaaagcagatcgattttcactgtgagcgtgctcattatctcctggaatacaaagggggcatctttggtgattccactgatctggatgcctgcaagcagatgctgaaatggtgtagcaaacttcggattgatcctgctgcaaccatctgttcttgattcccatgattcaatgcactcatagagaattagggatattgtgctatcttgaactgccaaaacaactactacgtaggaatttggtagtcatgtttacattagcaacttggtagtcatgtttaaattagcaactaggaattctcttatgacttgaagtgcatcagcctgtgtattctttgttatggcgttagattctgtaacatgcaatttgccagtcacatgatagccttgaacttaatttctagttgtacggtttgttctggcgatcaagcagcccacagtatgtcaagcatccaagcacatgataacctttgatcccttcgtaagttatcgtctgctgcagcaataattaagcaaatgaaagcaacttgtagcttaatttcctctgtttcacaatgtaagactttctagcattgtccatatttatttagatgttaataaatctagatatatgtatgtgtttagattcattaacaactatatgtatgtggacgatgctagaaagtcttgcattgtgaaatgtatgtggacaatgctagaaagttttgcattgtgaaattgagggagtactactctaaattacagggacagcatgtgagtgaccattttgacgatggccgtctccgacgagccggccttgccggtgcactccgccgccgccttcttcagctcgcgcgcccgcgccctcatctcgccgccgtcgctctccgccatgagccgccggatggcctcctccaccgcccccctctcgagctcgccgccgaccacctcgaacccggccttccacacgtgctccacgtacctcgcgttccccatctggtcgccgaagcttggccggcacagcatcggcaccccctcggcgaggctctccgtcgtcgagttccacccgttgtgagtccagaacccgcccacggcgcggtggcgcagcacctcctcctgcggcgcccacgccaccaccaccccgcgccgccgcgtcgccgcctcgaacccctccggcagcagccgcgttggctcgcccggcgccgcgcgccggccgcggacgaggcctggccggaccacccagaggaatggcacgccgctgccggcgatcccccacgccgtctcgacgagctcccgcgcgcccatgctcgccaggctaccgaagctcacgtacagcaccgactccgccgtctgcgcgtccagccacgcgaggcagctccggtcctgatgcagcaagctgccatcggcggcgggggagaacctgtggagcggcccgatgtcgaacaccggcacggcgaggtctcgccggagcttggccagctcgtgcgcctcgagcgcgtcgaacgtgttgagtatgagccccgacgagagcttcaccgccgccacggcgcgggccagcagctcgcacatcagctcgtggccgtcccttccgatgtgcatcaggtcgcgcacgcggtacggcggcagctcgctcaccggcatgtcgagctgcgactctgcaaccaaaccatgtcggattaatcgatcgatgagaagcaaatcagttgatagatcgattggattatggcatgccttgcaccgggaggtagcctctgtcgcagaggagtgggtaggcgaggaagctggcaaagcaggcggcgctgccggtgcggagcacgagggtgggcacggcgagccgcctggccacctcgaccatgcgcaggaggtgcgcgtcggcgacgaggcacgcgacagcgtccctggaatactcggccaggacggcggcgaggcggtcccggaacgcggcctcgcacgcggcgttgagcgcgcggatgtgcttgacgacgtcgccgacggagacgggcggcgggcggccggacatgccgtcggggacggcgacgaagcggtgctccgggtggcgcgcggcgtccggggcgttgaagtgggtgtggaagacggtgacggcgaagccgcgggcgcggaggacgccggcgagccggagcatggggttgatgtggccctggtacgggagcgggaacaggaggacgtggcgccggcgtccgccatggccggccgcggccgcgccgccctccactgctggcgaaggtggtggcgtcatggtttggctgggtgcaacttgcaagcaaatgcaaggacgtttcagtgatctaagggacctctgtgccgttgtgcgtatggacgtgccgggttttgtacccatctcttctttgctagtactaattacttctatttttttggctttttctttcatagatgatatcatatatcaatagaaagacatcgagattatgccaacaagttctgaaattcacttcagtcacctacaacaacactaaaccaacagccgttaaatatgcaaatgaggtcattttaggtctatgagtattcgatgaaaagctcttatagttatctttccaaattttctgacctcatatccatatttcatccgagtcaacggaaatcgtacaaataaggtgccacatcgtctagaatggtttttcaggcttgtaactaggtggagcacaaccctagacatccttaggctgtcctcccacctccgtaaatagctaggtatatattctttcagagatttgggggttttgttagatcgaaagttagctaatgctacttcgattgtaattccatgtattggctagaccgcctaattacttgtcttcaaaaccccacctttgtgactaattcatattgtttgtttatatttttgttagttatctgttgcttacgggaacaaatgccttatggttggtcgcacttcgtcaggattatgactcacgagcaaccttgaaattagtgtaacgattgctgaggcacatcgtccctggacagttatagtcgggtggccaacttcttccccatgcatgcaattgacttatcccctcttattgaaagatcgaaatacctgagaacacatcaaatcgtttcacctatagttgattatgggacgcaacatttattagcaactaaaaataatttatgagtaaaactgttacatgtgttaaggaaaacattgaatcgtttgacctatagctgattaagggacgcaacatttattagtaactaaaaacattttagttatggatagattcttttatgtattcttaacaactttagtcaatgctgaaaaataaactaaagaaaacccatcaaaatctattcattaaatttaattcttagttttgagggttataggacggatcgcaggctcgcagcacctggtacacctctaacatgcaaccgttgtttttggatatttttgagtttcatttatggattttgccttgtactgggatatcttggagaatggaaacttattttttttaattaatagctgcccatttaattgatgccttgaaaagatatcttcttcaacagtttccctttagaaaatgttggtatattcccagattgttgtagaaagatttaaaataatttaaattttaatttggtaagcattggtgaaggctacaagaatcaagttgcctctagccctctacacgtgaagaaataataatcaaaaattaaatttaagacaaaaataaaaaataattatttacattcatttttttaaaaaataaagtagtataaaaaagcaccgggtccttgatgaacaggggaattaccgaattagggaggggtgataagacgaagcaaatgatcatgggcccatttgtcatgggccgagccgctggttggcccaccaagcaagcggcgctgctgcctctctcttccatcagaagcccacctcccatggagcccgtggcttcccgtctcatcagagaagactactcgtctgctccggcatcccggcgacgagagagagagagaggggagaaggctgcgcggcggagatggcggtggcggacgtggcgttcaaggcgctgacggcggggctcggggtggcgacgctctacctcgccggaaccttctccgtcaacgtctaccgcggcctctcgtggcactcggagcaatccgtaagcaaaaccctcgcccgcctcgaccaccaaacccttgacttctccccgccgctcgctggggagccgctgattcggggtccttctccgacgatctggtgctactcgctgcatctcccatgtcgaatctccccccttcctttgggcctaggacgagggtttgggtggatatccttcgacctttgttctgttgttttttttttgcatcgacccatgcctgccaaattggaacatgtttggccctttgacttgatgcgagcacatatatttttgcgtgatgctgctgtactgtgcaggagctatcggtgatttcgtgttgctatctaactgctgctgcttatttcactttgattaagttatcattggctaattagctttgtagacgccaagctagtgttgatgtgaattatagtagtgtaatgcagccacttcttgttttgttgtgttgtgcttggaaaggtagtcatggttttaggttacaaacctgttggatgctcaaatacaacaaaacgagtgatatagcattttcgtggtagttctgaattttgacatgtttaaatagaaatggttcataaaactattcatcggcttcaatgtggctgatgaggtactgcgtgcaaaaatgatggtaaaggttaatcattccatcagttttgtgaaaggattgttggcttttggtgaatctaagtcaaacgaaaaatggatcctacaacttttggcatgaatattgcatcccagaacaaccaaatcagttttcctcatcaagaaacttagtgcataagtccatttttatttcagtaaatcatccagtcaactgttgtctgataggaaatcgttgtgatgttaaacccaatggatgctagacttaatctgctgatgttaattcagataacatggaatctggttaatgatttcagataacgaggtaagcatggaatctgggtaatgattttgtggtttatatcactgcttcaattaatcatggtgtgtggttgaaatatgttttgaaatgaactatatggtatcagcttcttgttatctacagtttgaggcggtttcctctttatcttgcaatacgttgttgtggagcttctgagtcgcatgctgacatgttcatttgtgattttcagaagttagaaaaggagaaacgtgaagactgaaaagcatcagaagctagtctagaatgtcagacacaacaaaagaaaacctaaagataaacactcaccttgtgagatgagttgtctttagactagttatgtttcctgggattgtttttgcagacctttcaagatctccagaatgctattttgatttgatgtaagatgcaaagatctcatgattattattcctctttatgcttacgaaaatatttcgaccaacatatgggtgtcattgatgccattttatatgccacagtttccatttaaggttgtgtaggaaattttgtcattgttccttttctctcttgtttgtgtctcgccgttttatttaccgatctgatgaactccagcaggaatgatcatccgcccaaatcaactttccaggggtaacacgtccaaacaaatgcctgatatcctggtgatctcactgaaatcaaataaatcttgcttagttcgtgtacgagtcagaccatgagagtctcgttcatcaaaccatactcattcagatattaaactgggccaagtctcttcttcttcaatgaaaacagttgctcccagtcctctttgaggtttacctaaaaaaagtgtagaacacaagcaaccgtacccaaagctttctctgcagttcatatatagatggtacaattgtgttcttgcccttgctcatgaaagtgtacttacacaccaaatacactgtacgagaacccactggcaagtcagaaaatcagtaattcacgcaactcaaaactgtagatataacaaattgaagttcctctatcacgagttgtgtctgatacagttaagcgcctagcggttttttccctatgtagtgagcagcagataaacaaggcctttcagatactcaactatctcagatccaccaagttttgaagttccaaaaaccctatcgacaaaagttattggaacctgaaaaatataaatcacaattttcagcattcaaagaagcagcatgccaacaatactaccatatagccaggtacaaaaaaaaaacaatacaatcatacaaagagaaatgggaatacataatctacctcttcaatgtgataacctttcctggtagccctaacaatcatttccatttggaaaacatatcccttgctgacacacgaggagattaaatcttctaggacattccgtttatatagcctaggaaatcaggtcgcaatgttgcatcaatttaatagtagttatgtggagcttactctattgtaggaaaaggagacacacctgaatgatccagtcaaatcagaagctccaggctgtagtaatgtttgtgctagaacatttgctcccctgctagtcaacttgcgcatgagattccaaccatggacaccaccgttctgaacataacgggtgccagttacaacatcagcaccagtttccttttgcttcctggtgatgcaaagaggacaattaacccaaagggcaaaggttcttctaagttacttcttatcagtgtagtagccttggtaagagtccaactgtaatggactttgctctaaagtttcagatatttctaacatctgacacaaacaatctttcagcaacactaaagtatttaatacctatacggctataccaattccatttagagttgacaaaagcatattgatgaggaaaatgagctatagcagactatttttgcaaagaaaattctggattgaatacatcttcaaagataagatgcttacctaatgaagcttggcaagtacttcggctgttcagagtaggaaaaaaggcgtcaaccaaaaaggaagaaaacaccagcttaagcatgccaaatatcagatagaagaaaaactgaggaattacatacatggtgagataggtcagcatccatgataacaacgaagtccccagaggcatgctttagtccatgtaaatatgcagtacctgcaccatttccagttgttagttaactcaaatgtgaagactaaattcaccttagacttgaatggaggataggagctcaccaagtcctagcttcctcggtctagctcgcagcagctggtctcatgtcagatcaaacacatatcaggaagccatgataccaagacaaatcatatatatataaagacctagacaaaagggagcactatacaaaaatacttacaacacggttttcaccatatatttgctgcaactgctttacaatgtcttgagttccatcagggcttccatcatccacaactatgatttcaaagttgacatccctgatgaggaaatctaaagtttgagatactataactcgaaagagttcacaaaataaataaaactgccttgtcataaagagacacagggacagggctgcagaacacacgggcataatgagttgaatactgatggaacgctagcagtataaatcgatgatgaaatatatactgtagactgaacataagcatgctgtctggtggcattcttaaataatcactcaattcaaagagttggatggatttctatctgcccatttgacacaagcaacatgcacagtaacattcttcgcagcattctattagcacaattgagcaagttagctgcactcaggagcaccgatgaggggtgtctaggagagcatagctaaaatctgaaagtgatcaaatcatcacatcgtctcaattgcactggatcaataagtaatcgtcttctatactttccatatgttcttgtggaatcacaagaggcgcgaattgaatctaaaagaatggctaatccggatctgacaacaaccttctccgatccactgaagagcaacagatcaacagtagatggggggatagagatgggagagatggggggagttacggcaggtgcttgaagatgaggtagacgatgagggcgacgttgaggcgctcgttgtaggtgggcacgatgatgctgtactcgcgcctgccgccgcccgcgtcgtccgccatcgccggcgccccgactcgacctcgcaccagatctctccgccccccgctctctcccgcacgcgatccgacgcgggcgctcggtgacggtgaggccacttagctggggatgaggatgacgcgcgcgcgccgcagatgccgccggcgacgacgagcagggcggccggcgtgaagtctcgtcgaggagttgcttcgccaccgcaaggtccattgagatgtatagggccgcagcgtgggccgtatccagaccatggacgtgtttccatgggccgtgtctagcccatgacaagcaaacgctttgtatgcgcctgtagaagagaaacggtatggtttggcaaagaccaaccatgcaatccaatggagaatggacaggccaatcacaggaagcaccgcatttcgtgccaactccagtctagaccgtttcagtttacataagcaagcattcccattcaaacggtcatcatcgtcatctatatctatactaatataaaaagcacgagttcatcaaatacctatctttactgacctttaaatatattcatccaacgatttatatcaaaagttagatcaacctctgcaattagccatccccacgttcgattagcagcggttatagcgatatagcgatcgatcacgagaaagaagcagaaaagaaaaaaaaaacttctctcccgtgcgctagcccgtcgccgcctcccggagccgctcgctgcctccttgcacgcgcccgccggaccgccgggcgccgccgccaactccgagcgcgcacccgccgcagccgcgccccctaccccgccacctcctcgcgcgtgcccgacgctcgccctaccccgccgctgccgcctcctcgcggccgccggtgagtcaggttcgccgtcggctggcgccttctccaccaccgccgccgcctcctcgcgcgtggcctctggagttttgggatcgccgtcggccggctcctcctcgcgtgcgcccgccggggagctgtggtgggttacggcactacgcagtacagactccaggttaaggtgatgtcctctcttcctaaatcctcaaacaataaagattttgtgcttttattattttggggtcataaaattgtttacctagggtttgggcagggttgcttatgatacggggccccaaatgtttagtcagttggttctctcgtctcgctatgttatttgctcttgtttaggagataattttacttgctatgaattctgcttgctaagcatctcacaagtatcatatcagtcatgcttcctcaggaaatgtctaaaaacatggtggactgccgatcacacaaattaattctacaaagcaattatcagttaattacctaaggacttggctgactgccgattaccgattatagtgtaaacggtaagcatcagttgtggcagtgcacataattgaataaacaaaatgcccaatacccctaattaatctgaaagcaatccatcaatttaataaattaagttgtgggatgcagattgcaattagtgtttggccgtcaggcatctggcattaattagcattcggccatcaggcgtcttgcattctggttgcttgctttgcctatttgattgggttggatcaggtgtccaatgtgatttggtccgggggtcccacactaaaattatacatagcctataggttccacaatgttgttaaccaaagcactcgcccttcccatattcaagtggatccccattgatctaggttggcaaatcttactacactatttcgttacctcgtaagtattaagttcttttatggaacatatttttagatttaattccaatgataggcttgaagatattttgcacttttttacttattggagttgatgtgatggagctaacatcagctggaagtcaccttgaaaatggcacattttgtgtcttgcccattaactgtcaagtatggcacaattattagtgtgttttcccctttctgcggtgcagggagacgcatattacatatgtatccctcttctctggatcaaagagtgcagaggtccttcaattgcattctaaggggatagggttcataattgaattgtttagtgatgtttgcaatctcacaaactcaaatgtcgttagcctctcttgaagacaagaaccattagtctcataaattatcaggtttggattttagcagttttaggttagattataattccagattaaagtgaaaatgatgaaagttatacattaaagattttgagtgaaaacattaccagattttttttctccaatggaatgttaattgttaagtgcaatatatattcttaattaaagttgtgtgcatagatgacctgccaacaatactatcccgtattgttcagtctattgatgattgaactggatgtcaactccatgtcctcattgtcttgccaggcacagggaggcaacaatccaatacaggagagatgggatgggatcctagctcaagggagccctagcggcagctacggtcgggaggacctaagccctacaggcaagttctataatcaacccccttttgcttaccggcgataagtcaaccaacttccagtgatgcaggtactgatcctctcctccctccctctccctccctctttatcatgacattagctgattgatcaccagctttttattccgattgctccagtgaactttgttcacaaaatagtgtttttttcattttctgatgcttgtgcctatcgtgtgactcctccaccgacatgtacattgatatctgcccaactgattgatgaaatgatcgtttacatttttttttgttcaatcaatagtttctgatcagcttggagtggtccgtgccatgttgctgtgataatgctacaggttaatcctcctggctctctgtactgaaacaatttctccggatctctttcccttttgttttggaccttatacaacctgctgttggctaataatgacattcatgaataatagatcatgttaaagctgtttgcatggtctgctgttgtcaaatagttttatgcagtcacaactcttattaaatgatcaggttgacttcaagcattgggctaaaaactaagattatgtaagttaaataacatatatgccgtcatcttcaatttaagtgatattgtgtcaatcttctgatcaactgtttacatcttcggattatatagattcatgtcacatgtgtatgtcttcggaattatctatgtttatgttactgtgtatgtcttcagatttatatatatttaggttacctgtgtatatcttgagatatttcgtaattgcatattattacagatggcaaagatgtttaattctatttttttattggatatccctcagcgatatgccctgcccggccttgtcagctaatatgcaatatcagttttatgcccttgacatggcatacattcctccaggctgcactcacttacgcttttactgtagattgataggttaatgttccattgtcaaggtgaaccaatcagctaatgatggttcatatagttataatttgagtgcaactatgtatccactatgatgtagaattgtgggtatttatagatgcaatttaaaaggtatgccacttaggaatcgacactcaggcacatgcacctaggcttgatgggtaagtctggccaatttacatatggggaacacaaattaatttaatcagttattccaatttattcttctttgtttctatgcactgcaatgccaatttgagtgcgtatcttgtcatgctattcagcataatgtcttggcaggctatgcatatgttcatgcttatatatgcagcattcatataagtaaggattaattggattgcttgctttgtctaatgcagcctcaccatttaatttgtggcgagcaccttaattccatcttgccattatcgagggagtatatcatatgcacctaattctgtatatagagtatttattgactagggtcttggaaatttttgaattgctgtcagatgtaagttcctcagattgatgatttgattactttcacagctaataccattgatcacagctaaacaccacttatagaagtttaatggatttttatctaaaaaagggaaaaaaggaaattaataactgaaactgcatagtagtactatgatctctgaacaaagaaatttgctgagtttcctagcagctgctgggtgcattttcctcttgttatgtgtgcctaaccttgcatccattaaatttcaaaagtgcaaatagagaactattgcatgcattccttttatatcaaagattgggatgaaatttccagcttaatcctgacagccgcaatgtgtcttgagcaaaaggaagcaaggctgcaactgaaacacggtgaatagtaaataaaaatctcgcttttaggaaaaaaaaggtgagtcgtgcacaagtgctgtaatctggttttggcaaatttttatcaagatatacaactccgttgctttgtttacacaataaacctgaactctaggtgtagcagcttgaagcattaaaaaagaagatggcagcaaacagatgtttgctttattggatttaatacttggatattccactgtgcttcccaaattgagctgaataaatagcttgacgaattgttctcttaacatgtctcagttgtcctttgtatcaaatgagcagcataatccattcatggattgttcttttccactggtgatacagatagttacttctaatgtttcatggaaaagttcgagctacaaaaatttcttaagcaagcttacggattgtttctgatgagtttagcaactctatggaaacaagcataagtgcttctcatctgaccagttccaagagagaagtagccaagtaggtagaacaatcccaaaactgcaaacttcttttactgtatatatatatatactttcctttttagcattttctgtaaagtcccagttctgtattgcaattggcatggttgtgttcatcagaatattgaatgtcaaatcgaaaggaggcgccaacctatagctatcaacgacatggacaccatggttcagattcataaatttggggatcatggatgtctaggttcagaaatttttggattttaggcaacaaattttgtagaatttccaatttagaaaaacacattttgcattttgttataatgtaataaaataccaatttacgtttatttgatgaattatcaaagcaacgcttacaatacttttatttttatcggtgcatgtgagctacaatgtatttatatatatcgctgtgcatcaacaatggatgtgtcgttctccagtatacttcgcttagtatatatatcgatgtgccttgcacatgcacgctcactagttaagggtaaagattgacatgagtgtgggagaaaacaatcaaactgctggaagcaaaattttggcagaccatggtggggctgcgaagtttgtgtaaagttcaaagaaacctattagccttttgacaagctagtccggatcaccatgttgttcttcccacgacgatcacgcttaattatcctttggttttgttcagaccatgctgcaaaaacttggaacgatattgctccacaagcgatttatccacacctccttccccagccggctctttctttgtctttggagcctttcctctcctttgctccgaatgactatcttttctgttcttcctcttcgtcggggtgcctgcctgattatgtttacttgacagagtttgctgcaaaagaaaaggtcagtgttaaacaactactttgcttcatcgaaatcaataattttgtagtgccaaaaaaaccaaaagtccaatattacttacattcccatcagcagttggtggtgttgcatcttgtctatctccatccgacgtcttgtttggcttccgtgctctttttgcaggcctttgagcctttcttttatcttcaaccatactctccataatgccactgccaccatctccagctgccgaaagatcctctgcagaccctttaccagagttcgataacttagatgatctatcatgtgtttttctcttgtgccctttgttgaaagcccttgtgttattcgcctgagggccatcagttgcagaatgatctcctagaggtcttgccttatcttgtgcaccttcttgcaacttatcacgacgctccttccaaattttctggagtctcactttctcatattctcaagtgcaaatccacaattgacgacgttctgcacca

SEQ ID NO: 68227 - DNA, 5047 bp, Oryza sativa
cttatcagctgcaggtacagatgcaggtaaatgtgtctgcttctgtttcttttctgatgtatcttgttctgtttctgtatctgtatcaacatcagaaccctcattgccagatggttcagccttctcagatgacttgatcaaattttcaagaacctttcttgaaatatcaatttcagtttcaaaatcatcatcagcaggacgattggaagcttcctgatcaagttcatagctatcatcttctccaacaagattatcttcagactcctcatcactgcctttgtcagacacatttaccagctctgtagggacagcaaattcatgatattgcatcttccaaaataatagctcagaaagcacaaagaattgccaggattagcagatgagacacagagtattaaaacatttttaattatgaaacaaataagccagttgatcatcttaaacaacatgaaccactgttcgcctaccataccaaagaaatggcaggtacctttgtcaaaagccaaaggtccatgttagaatagctgaagcgtatcattgaagtaaataaagatattgcaggtcacagaacaaacgaaggccagaactaaaataatagatacaaaaggttgtatttaccatcatccttagcgctggattttgcagcagcaacagtgtatactttctttggaacagcccaatcaacagccacagttctctttgcaactacttttccgttaacattttttatagcctatttaagagaaaaaaaagcaatattaggacttccaaagattttttactcttactgaacagggtactgaccatacattttctgcatcctgcttacgtgtgaaagatacaaaagcaaagccttttgatgtcctgtagaagaatgaatgaaatagtcataatttcttgtaatttgtttaaactacagaagaagtaaaggattcaatgcaaaacatacccgttatcagacttctgtggaatggacacatcccatacaaatcctgctaaactgaacatatccatgatctcctttactgtaatctgcaataatgaaacaaacgcatataacctctgttatctgttttagataacaaagtttggaacaggtgaagttttgcatttcatgaagcaccttgaatggcagattccggactatcactctccattttctgatcttcgagccctgcatagcaataagcaagtttcaaacagctgcaggtaaatggggaaatggccaaacagagaaaatgatagtggttcgacaaagtactgttaaacaccatgcaacccttgtgcagaagacagacactcatcaaccaaaagtaaagattttaagtaatctcattctatctcctacccacctattagcacaacagctcaactagccatgcaagatagtggtgcattataagcagagctaaagctccagtatatctattgttccattcacagaataatattaggatctttcaaacggaaagttctttaggtagaagtccagaaggccctgcttttatagaaagcacaggtgactaaatctctagaggcttgtacatcttttacagatataaaagagaagttagtggtagttacggtagtattttaagatgaaaaatatagtagtgccttttgtaaacaatcaaatcattccgtcatctacttatgtgtatatgcatgtagtcatcgaatctaatgtgaatgaactatgtaggttggggatactgtttttttttctagtttaaaacttatattacatttagtttagatccaatgcaatgaacaggcaccatgtgtacttatgagacaatgtaactaaatatatttgaaactgtagtcaggagacctgtaatgtatgtggtattcaagacatttccaggaggcacagctgcaggaggttactgttaatttgagactccagaacttgaagttccaacttccaacccatttttaattagcacatacccatccgttttgaattatcgtactaagacatgataaccaccttaggttagaacataaggacaattacatacaagcatacagctttgaggagcaactaaatgtgagcacgcacactactgcactggtaaacaaaggtgaaagaaaaacataagtatttgaaatttgtttaatcacagaatagaaacaagacaatcaagctaaaataatgaagtaatggcagcatatcaaggtaaatataatgcaagaagatacctccccaccaagttgacgagcccaaacaactgctcccttgacctccttacggtgcaagtgaacaactgaatcccaggctgatgtcacactagcaaaaagtacagctgctgcatctgttgtgcatccatctcgttcaagccctgttgagaatgatggtcatattctataatttacaccaattcaagaacatgctagtggtattaaaggaaaataattgtgtacttggagcttggaaaagcaaacgatacagaaactaaggtaaagacgtgtcctgcaaaagtacagcatgaactggaaaacagaaaatatgagatataattcaagactactacaatcagccttaactttcatgtcaacaaaataatttgactcaaagaacttccaccagagcaatttcgacctagtgacatggtatacaattaaaaaaagaactgaaaaaggagtagattaggaagtcataccatggagctccatttcctctttaggaagtgaatagttgacagatacaactgtgccaatctctccagctagacgaaaaacttcacttgccatagcaaagtctcggagaccaccgaatatcacagtttttcaatccttcatcataatcaattgcatatgttatattgtcgcactgggttaaactggataaaaataaacaattacagcatatatccttgaaaaaactaagaatggtgaggtcatgaaaagcaaactagaacaggatggcaaaatttcagcataattacttcaattttttttaggtaatgctataatgccttgatggtatagaatatttgagtccacacctttgcttttctgagcttttcaccttatcagtattgaaaatactaacttcctttgatactgtaatatcctttttcaacaactgtagtggttctggttcagtaaaacatgatgcatcagaaaattaaagcgtcgagaaaatttaagaatggaaacagtgctggaatctgggtaattttcctttcaaacctgcatcttttttatgagaggtctccttatgttttgcagtagaagtatcatcttcttcatttgttgcatcagcatcctgggcttcatttgttgaatcggcatccttggcttcatttgttacatcggcatccttggcttgcatggcttacatgcaaaagcagccaggcgatcagaatctcaatcaattgaaattcagaagcaactaccaggaatagagatttaccgttttccttcttctgtaaacgctccttcagtggagcacgatgtgttgctagcttaactctaatttttctaccagcaacagaaaatccatccttttgctgaatagatcgctcagcatctttaacagttgcactgtattaatgtaaacaagtcaaatatatatatatatatatatatatatatatatatatatatatatatatatatatatatatatataaaacaggttacaggccagttttgtatgccttgtgcctagatcattttcagcagaaagatattccttcatgaatgatcacacatgacacatctgtatttgagaaaaaagaatcgagctatatcaaccaaactcttatggtttcgcttgttcattagtgcagtatataatatacggcgaaaactttgtgcagtactccttctaataagaactaactattggtttggtttatcttctgttagggacctgatagtctgatactacacagtaacacagacacaccaccactagagacactgaacaatgaatttacgcttagcattgagaaatttgctcactagaccagtacactcacgatcaaaagcagttgtgaattctggaaatatggtaaagggaaacgcattttcattgaaaacacctacaaaagcaaccactgatacttacaactgtacgaatccaaagcctcggctcgtctccgaccctgcattagaaacaaacattatcgcataagcgaagcccttaataataagcaccaccaaacaccaaacaactctggctaaacagccatggaattcctgaattctcttacctttcggcgcgaccatgaagcagcgcctcaccggcccgacctcgctgaacaccgcctcgagctacataacagcaatacatcacatcataccgcgtaccacaacactgatccccccgaaatagcacaatcctaaccccttttaagcttcgcagaggagaaaaggctaggggggcacacgcttacatcggcggacttgaaggtgtacggcaggttggagacgaacacggtggaggggctgtggcctccgccggcggccgcgtcgccttccgtggctgctcccccgccgccgcgctgcttccgcttacccatcgccgctcgccggtgtcgcgggggaggaggaggcgtgtgaagctctccagtaactcgacgagggcttttgtgggctagggtttaatgatgactagatgggctggaccgccgccacccagctagctccagatctctccgcacctcgctctcgcgatcagaagctcggtgaggcggtgaggccactagcttagctggggacgaggatgaagcgcgctcgccgcagctcccgccggcgacgacgagcaaggcggccggcgtgcgtgaagcctctacgtcagtacgttgcggtgcgttgattcgcaccggaactggaaggtccaggatggatgtgtcgggccgttctgtgggccgcttccagcccacggacgtgtttgcgttggaagcccatgacaaatacagccctacaggggagttcgagattctgagaactaacatgcaagaatgtaaaactggaaaacccggtttctaatcacttttagttagttttttggattctattattgtagatctta

SEQ ID NO: 68228 - DNA, 2863 bp, Oryza sativa
ttataaaagtttgacatcaatctcgtctaaagcgtcaattattattattatagaaccgaagggagtattcgaatagtgcatcggatcaagcagacgaactcagcttgtttgtggctggtacatggtcaagtctcattgtttccttatcagccacaacaaaaatgtgaattttgaaacgttgattttgagatttttttttttaaaaaaaatcagtattggcttctaaatcgctaatacacagctgtaaaagttttgcctataaattcttttggttgatttgtttgtttttctaaccgcttatcaaccattgagcaaacgatgagaggcttattctcatggaatttcccaacattacgtttcattcgattcaacagacacatcagacatcatgatattcttgtagtaactactttgatgtagttatagttccagaaacttgctcgtacattcttttcgctgatatggtttactaatccattcgataataacaggacccatattacaagtgcagtaagataaggaatccagactagcacatatacacaccaaaatagaagaacacccaaaataaaagggttggaactttattgctaattgctcataggaccattcatagctaagtccaccaagtcagtctgatttctgattcttttactcttttgaagggagtcagagaccaacagcagcatctcatttcagacatgtttacagatacttctgccatctgaaggttgcaaagtacttgttgctatcttttggaactggagataaatcgacaaggctaacagctactatgcattcttatgccaaagggatctgaaaggcagctgagaaagccatgaggattcagagcgtggtgatctagcggcatgagaagcgtttgtgccagtggaagcgtcctgccaaaactttagaacataaaggctttcttcttcagtgcatctcttcaagagaacgcgtgatgcatagcccttctcattcatcaaatgacagatatccagaggatcgttatcttcaagagcaatcatatacagccaccctctttcagatagcagctcacgcacagcaggaaggatccgatcaatcacttggcgcccgtttatacctccagcccaagatgaagcgatgccattggactcgatttcttcctcaggtgttggtacataaggagggttcacaacaacaacgtcaaccaaaccatgcaggcgtttctcaagacctgacacaatatcagtagcaatcacgtctgcatggacgccatgggcttcaagggttgcttgagttgtctccacagcatgttgattgatatcagtagcgaggtactgggttcctgagcctaactgcctgagcatgattgctagagatgtgataacatagccactgccacatcctatctccatgcataatcttggctttagcgtcaaaagttgtgctttgtcagaaagaagcgcatcgacaagtgcaaaggaatcatcacatggttcatacacctctggatggcttgcaacgagttgaatctgtgcggtgtttaatgtccttcctgataaagactgcaatagaaagtgtcaccatgcggatattaaaagcaacatacattactcaaataaattattccttactgaaaacatgtaattttactgagataacttgggctgaaggtgcttgtatcttaaaacagtaaacgacaaggaaacaaatcggacaacttgctatgacggaggacaatacaaaatacttttttttataaagcaacaagagcaattgctcattgtacaaatgtcacctagacctcatgattcctccgactgtgtttttcttggatattagttttctgttcaggacaataatgttgcatgtactagacaagctccattgctatgcttggattgatcaggaggggaaaaaatacagaagaaacatgtatgctcatcaatacatacaaagaaatttgtaggtagctaaactgaactgtggacagctcatttaaacgttgtggtaaagcacaagtttccaatagggccaggaatcaagcaattagtgttgacgtaaagctagcaatcagatatatcagaatgaaaagaaaatggttcagacttcagacaggggcacagggctaggcatcataaccaggttcatcgaacaaaaagaagaatcttttgccttcacagtctttcttcccatacgactgtgccggcttagctgataagcgttcatccccatatcctctgaaaagcttattgcctaattgaagccaacagaatctaaaggcggcagtgccgtatttcagcgatcttgttctttttcccatcccatctttcacaagaatccaaattcgatcgttacaaattatgattaactgcctacagaagattggccaaggattcagattccaaaaccaaatccaagctaagcttcgccaagggagattgctcatatggagattcaatgtcgcttacactcatcgcccgatcccaaagaggagaactgacacgggggaggggagggactgaaaaggagagctcaccttgcccctcctggggagccccttctcgtcgctgttggtggagagctccgacagcctcccctccaccgccgacaccgccgcgctgtcgccgcccgccatggagcaatcggagcagcaagaggaggagaaagccggagcggcggagagagagagagaggctgcggcggcgcgtgcagttgcctattggggaaaaagagaagagagagagatagagagagaagtggaagggccaagctggtcaggcttagccaactcgagtccgactcgctcgcgtcgcacccgcgcctctcggagtccgactctatccactcccgcgacgaaaaatctctccccaaaatc

SEQ ID NO: 68229 - DNA, 3434 bp, Oryza sativa
tggcagcggtcgctccggctgttcaagtacatgcagcgccagtcgtggtgccgccccgacgagcacatccacgccatcgtcatcggcgtgctcgggcgccagggccccgccctgctcgacaagtgcctcgaggtattccatgacctcccctccgagtcgcgcaccgcgctctcctacacctccctcatcgccgcctacgcgcgcaacgcgctgcacgaggaggcccgcgagctgctcgaccagatgaaggcctccggcgtcgcgcccaccgccgccacgtacaacaccgtgctcgccgcctgcgctcgcgccaccgatccgccggtcccgttcgacatgctgctcggcctcttcgctgaaatgcgccatgacccttccccctccgttcgtcccgacctcaccacctacaacaccctcctcgccgctgccgctgtacgcgctctctccgaccagtccgagatgctgctgcgcaccatgctcgaggccggtgtcttgccggacaccgcatcttaccgccacattgttgatgccttcgctggtgctggtaacctctcccgtgtggccgagctgtttgccgagatgtcagcaacggggcacactccagacccatctgcgtatcttgggctgatggaagctcacacgctggttggtgccactgctgaagcggtagctgtgctgcggcagatgcaggctgatggctgtccgccgacagctgcgacataccgtgtcttgcttgatctgtatggcagacaggggaggtttgatggcgtgcgcgagctcttccgcgagatgagaacaactgtacctccagacacagccacatacaatgtcctgttccgcgtttttggggacggtggcttcttcaaggaggtggtggagctcttccaagatatgcttcactctgaagtagagcctgatattgatacatgtgaaaacgtcatggttgcgtgtggtcgtggtggactccatgaggatgcaagggaagttcttgactatatcacaacagaaggaatggtgcctactgcaaaggcctacactggcctagttgaagcgcttggccatgcagctatgtatgaggtcagatgttgtatcatatattgatgaattgactcttaagataccccttttgtgataaaatgtttcatgatgttatatttgattccaggaggcttatgttgcattcaacatgatgactgaaattggaagcttgccaactatagagacctacaatgctcttgcaaatgcatttgcaaaggtggccttttccaggaggctgaggccatcttttctcgaatgaccaacaatgctgctattcagaaagacaaggattcattcgatgctctcattgaagcgtattgccagggtgcacagttagatgatgcagttaaggcatacatggagatgcggaagtccaggtttaatccagatgaacgctcccttgagggggtactcaatgcctactgcatagcaggtgttatagatgagagcaaagagcagtttgaagaacttcagtccatggtgactgttcctagcattattgcttattgcatgatgttgtcactctatgccaggaatgacaggtaactatcaaagaaaccttcatgctgttttaattaaaacttatgtggttctgattgtaaatgtaaagcattgagagtgataaatagggaataactttaatcaactaaactggctggttttggggctgtagaaaaatatatttggactagctatgtggggcccaaatgtcagccacaaggaatgtttaaaggagtaaagatttgattaatcacataaatgaccataaaaatatatttagatttgattaatcactatatggaatttgaaatataaattttatatatgaccataaaaaaacttcctctaagtaacatggggctaggtctaggggcaatcgcatgtctgttttgtgaaattccataaaatttgaatggcggtttgatagattaggaattctaccccctttgttggtccagttaacttgatatgccatatgcggcatgtaatgctgtaagtctgtaacacacttgttgctccaatcttgcaattttactctcatttcatacgctgcagaactttattactctaccgattcatatttctagagaccacttgtttctttatggttcttgaggggtttgaattcatatttgtaccttaaaatttgagaaagatctgggctgtgatatctttccttttttcctttgttctctcttcctgttatttatcctgcttaaatcatttagagttttgaccagcatcattcaggtagcattgataggcacaaggccaaaacttgaatactttgatctaaaagcacttaatattagaacaacacaaggtactataaatgatgtggacatcaaaatttctagaatccttaaaatgtaatgaaactacaacataaccgatgtacaatttcaggtggacagatgcttatgatctgttggaagaaatgaaaacaaaccgtgctagtagtacacatcaagtgattgcttccatgatcaaaggggagtatgacgatgactccaattggcaaatggtcgaatatgttcttgacaacagtaacttggaaggctgtgactacagtttacgattctttaatgcactccttgatgtcctttggtggtttggccagaagggtcgagctgcaagggttttggatcaagcattaaaatatgggctcttccctgagttatttcgtgataccaagctggtctggtctgcagatgtgcataggtaatattatttatcactctcatctggttctgtgagtgatccagtttttttattcgtcaagcggtgcttaaggttgtttgcatttgcaggatgtcagtaggtggatcattagtggctgtgtcagtgtggctcaataaactttatgatagactaaaaggcgatgaagatcttcctcagttagcctcagttgttgtattgtaagcttttagcttaagatttaccatgttctatagttatatcatgatatgttctagcactgttctggaatcgagttcgtgattcccatgattatttcttgtcttttcacttgcataaagaaatgcaatacgtagctacttatacatttttccgtttgctctaattgactgacagttctctgattgccaggaggggacaaatggagaaaagcacagttacaaggggattgccgattgcaaaagttgtgtactcttttctgaatgatacactatcatcatccttccattatccaaaatggaacaagggacgaatcatatgtttgaagtcccagttgaaaaagctccaggcagccatagattcttccaatggtgctgcaatttctggttttgttcccatgacaaactctcatttgccatcccctggttccaaattgtacactagggagtcccaagctgataatggttctgcccatttga

SEQ ID NO: 68230 - DNA, 12049 bp, Oryza sativa
  unsure (1)..(12049): unsure at all n locations
agaagagtatgtaatcaagcctgtgcgagcgagtattttgtagtaaactgtaatgatataatcaagttctccaggcctccagctaagtgagtcgaaaaatagtactccagcctgttttttttttaccttatagtctttttaaaaaaacttattttaggatgtatttttttcgtagcgacaacatcattggcgtcgtggtctaacatgacggcattaatgtcattgacacctccccccttgcctcctaaccccactagtgaaagctaagtctaatctatactttatataaaattataaccaactaattccaaagcttaacatgcaaccatgccacatcatcacccaccaacaataattacatattcaacctcatgcaagcatgaaagagcatctacaatctatttaattctacaaattaacatgcaagcatattcaatcaccatctctcacatcatttccctaatagttttacaaatatctttatcatttttatattatttaatatatatacttatcaacatgttctacattaaagtgtaaattttatttgtttcatggtaaatattgataagcccaaagatttgatttttttttctttttactcctagctgaattataacgaaaaataatattaaaatttacttagtaatttccgaagcaaagcgcggggaatcccctagtataaagtatatcgacgtcgaggacatatttgtgatttttttaaaaaatgatctatttataataaatatatttacatttagaccctcgatgtgtcatcggcatcgaaaacctatttgtaaatatatattttttaattgcaaatatgtcattcgtaatattttttacaaatagtaattggtgccaatgaccgaccccctttatattagttacttaacttttacttttgcgggtgatagggacaatgccaacgtcgttgacataatcatgttagatcatgacgctaatgatgttggcgccataaaaatagtctattcctgtaataagttatttcatgggtctatttataaaataagttttttaaaaaataatcaaaaggtaaaaaaaatccatgttctctagttatgtaattggatcatgagtagatatacatgtgtgctagcaatagcaagtttaactttttgactaaaaaccgtaaattttcaagcgaggtaaattttcaagcctcgcacgggataaaagtagatttcgagcgaaatttcaaatgatttttaagaggtcatacataaatcaataaaatccgacagaaatttaattgaaatttgccaaagtttcatgttaccaagtcagaatcagggtttactaaactattttgggtgagtttaccaccaccccataataagacggttatcccgataattacacattaccgtaaaaaaccgtactgctaccgtgagatttatcatactgcacgtgatatccgtgataagtgcgtaaccgtatggcttttgcaaatgcaggccacagctcttgatttctcgctggatcctggttttcaccaaatcacctgcatcgcgtgatcgcggccgctaccgtgcacagtaactctgaaccagagctacccccaccaaccggagtatcggactccggaagccggaagcgacggcgccgcccgatatggaggcggagtcggcggcggcgaggcaggcgaaggagtcgctggagctggcgttccagatgtctcagatcctcgacaccggcctcgaccgccacacgctgtcgctgctcatggcgctctgcgaccgcggcgccaaccccgaggccctcgccgccctcgtccgcgagctctcctccgcggctcctccgaccaccgccgccgccgcacccagccccgcgtccaacgccaccgcggcgccgtccgcaaaagccgcgtcgcttttcccctccggtcttcgcaaaccctagggttcgtgcccccttctctcagacgagatcacactatcacttgatcctacattacgttgtcttagaatgtaaactagcggatcgttctgctctgtagattcgttttagccgcaacaccttcctggcttgtatcctcaagagattatgcacaatttttctatcagaactccttaattttaggagatcgtgacatggatccgttcagagatatggggatatcggtatgacatgaatatttgattgcggagacacttgtggcattaagactgagaactcatatttgtttgggcacttgataattttgaattcaacttccactgacatggaacggcctcatgaattgccatcttgatgttgcattgttctagagaactcctgttagctagttgttctttgtcagttacaattatggtatagccatttgtcaacaacttataatttcatcagttatgtaggttggttgcattttgatcctacctatgttttctttgtcgccctgggttaaagtggttatatacccatcaagttagttcattatccttcaatagttttcctagataaaaaggtcatgcttgagaactgtaggttatgtggggtttggtcatgtcttttgaccaaacgaggcactgaaaacacagcctatgctccccaccaggcaccagcaatgtatgtgggttggctttgctgatgtaccaagtagtaacgttggattcaactgagatctctgtttatagtccgataattataggcttttgatgtttatactgtgcattgctcagagtaaaaaaaaaattgaatagaagcctttcaactgctatgatactttgaaactaacaaccttaatactaacttgagacaagttgcaaatggttcctaacactcgttttcccttagcctgaccagacttattgcagtgctttaaatctcagattacatcccactgtgatcactgccagcagtagcaatttttttacagtcatttcaacactacgctaccttagtttttggcaacatttcaatgctacctttggtttcacttatcaagcatgatagaaatatataatgttcttgtggtttcaagctttgttagtggcttcttatcaggttcagctagacttaaactggatttcattgcaaactgttttttcttggtatagttgccgtgagttaactgttacctgtacgcttaagcagttactgaagaccgagtggaaccgatgtgcttgattttaaggtagagcagactcgagatttgattgctgggagaaaggtattgacaatcttaagggagatgtaaaatctttctttagaatgtatttgtgatgttgtgactggcctgtttcctcaaagaaggtgtggttcatggaacgctgtgtgctttgcttgacttgtggaagataagtgttctaataatcatgggaatgttgcctttcccatttctaatagccaattgtatgtatcagcaagacatatggtcttttgttaattatcctctcttgaccttgaagtcctttgctttgccacatgcttatccaagaaagaatgtgtcatctccattggttgaactctcattttcagataacaatgaaagcaatgtgaatgttatctctgttccaccatctggttcaagttcaagtgcactgcagcttttcttttcttttttcttgaactgacactgcagcttttcatttctgctccatttggccccttttcaccaaattctactcttggttttatcctgtccagataaaaaggatagcatttcaattccgttcatgcaagtggtgaataaacttgatcaagcctttttagagaataaactttatgaagccatgtcacttctgcattcctgcctacaaagtcaggtctttatatggtcagggttggtggttgaatctttataaaaaaggtgaaaataactgaatcgaatcgaacaataatagatgtaaaaagtttttttaggccgacttgccttagactaggctagtctttgtattttgtgtggcctagtgggctggttcgcccacgcaatttcaggtcatttttatggaaaaaaaaacaatcatttaggtcggggccagcgaagatgagggcggaggcgaggtgcacagcggtggccggagatgtcgcagaagcggcagctggaggagagcagcggtagcagagcggaggcatgggggcccctggcccagccaaatctggggctgggagctcgtcgccgccccaccgctacggggagcccaagcatcagatggtccctgccctccgcgagtatatcccctccgttatctttgagaactcgattggaacccccatggttgtgtttgtgtggttggttgtctgatttggtgccggtgtgtggcttgccttcgtgcaggatgatcacggaggtgatgcagaaaagcagcattgaaaagttgttcatggctattgagcccctcatccgaagaatggtgaggcagcctatggaacctactttcttattttccatttctcacccatgtgtcatgaatttataggaagatatgactttttggtatatgatgtgcatgttttatctgtatccccttttgttctgttgggcttagggttatgtttgttgctaacgtggcttttatattgttcattcataattttatcgaaagtttcatctgtatctggtgcagctggcattcttagatctgttttgtacttttgaattacacaaaccctacttgtagtcttcaacttaatgtaaggaaccctgtaaatccgtaaattgaaacctaacaagtatttaatccctggaagactgttaattcctgacctccattttttggtttcatttgtttctatttagaagatagtattttcacccaaagccattgaaagtttatcctaggcaggattttcttcagccatgtgttatttggctgtccaatgatggccttcaggccttgatgttttatccgattgtaatttctaggtgaaagaagaaatcgagtcagcgtttgcaaatcatgccattatgatggcaaggtacgacattgtaacactgtcttaaactactatttgacaagtatcagccactgtatagattcattaagctaatgcagctttctttaagtttaacaacttgatttcttattttcccattagaactgtcatggacgttgttccacctacatcgaaaaatttccagctacagttcatgactaagctttcacttccaattttcactagctccaagattgaaggagagagctccttaagcataactattgctctagttgacactgttaccagagaagttgtagcatcaggcgatgagtccctgatgaaagttgaaatagtagttttagagggggattttgaaggtggagaaggcgatgactggcagctcaggagtttaacaataacattattagagcaagggaaggcaaatgaaccttgcttctggggacatttttgttggccttactaacggcatcagtacaatgggggaactatcattcacacataattccagttggacatgcagccgtaagtgtggttaaaagcattattttgttatgttgagaaatataaaaccatgaaacaatatatttcttagatttgaatgaataaattgtttttctgtggatggtcatggtaatctgagctcaaaagttttttcctcagcaagcagatgtcacatttctatccatatgtctgaatttgtcattgtttaattgtgttgtagcatgcttttgcagatgatagtgctattcagcaaaatatatggatatattggccctcttattctcaaaccatgcagatattgggcagtggtatgtcaacaaagatgtgggaggtcacagttgagcattcaaaaacttgtattctcactgacaaggtgcatttgtactatccacacagcctaatcaaacagctgtcgtgttcaatgttgttggagaagtgagagggctaatatctgagaagttcgtttgtgctgatgatcttatggaaaaggataaggtattcacattttctctctcaacctagttacttagagaagattcttgtgtatttccctccaccagttaaaatctggaccatttttttaaccctgacttttgttctttctaggctgaagcacatgcagctgtgaagcaagcgtatgaaaattggaagaatgtatattcacctataacaatgaaacagcacttccatcaaatcattcacagctcctcgatgtgagatctccatcattgctcgcaaatgaatataaccaattcccaacacaggtttctactgatggttttggtttgagccagtcaagcatacatcagctgacattggatccttgtcaactgggaactgcagaaagcaatgaaaatcaatatcagcccgatttacccccacttggtggccatggaccacccgtagtatcacagacaatggataaagttctctaatttggtttatgatgattgcgccagtcatccctcattcagtgaagattactatcgttgtgcagatccatctgtatcctttgacacacaaagaccttgagctgcactgaaaggcttcgttgcaacgatatctaagcccaaggccgggtgtagagaatggaggacattgtcttatgttctagggtggatattctacaccaataggattgttgctctgaaaagaacgaaacctgggaaatgacggttttcctacttgtttatccctgtggactgtggttgtttagttaaactgtgaaatatatactatctccatctcaaaatgtttgacgctgttgacttttttaaaaatcccaaaatgtttgacgccgttgacttttttaaaaatatttgacctttcgtcttattcaaaaaatttaagtaattgttaattctttttctatcatttgatttattgttaaatatacatttatatatacatatagttttacacatatcacaaaagtttttgaataaaacgaacggtcaaacatgtttaaaaaagtcaacggtgtcaaacatttaggaaaggagggagtagtatataagtggggaaaagggaaatcatgtacatatgactatgagcttggcagtctcgtaatctttttgggcacagagctggtacgctttgctggtttacgagctacatccaacatttttgtttttagcaagagcattcagcattgcctgtaaataatcggatgaagttttgtgaatttaatccgtaaacatttgtggatggtgtcgactaaaccatgttctctagctcacctgagtagcacttcaaggtcctgaaatcaaatagtatcagattgggttatttgagggttaagttacttgtttgataggttgagtttctaatttaaaaatgttgtatatatccggttggatgtaggtacccttctctaggtctccagctcaattgcggttatcatcagctagttatatgatgttggcaagaacaatgttcctgcaacattagttcccctttcactcttaacagtttgcattgtttttcgcactattctattggattgatgaaatgtcttgattagagacagacgttagagacagacgttgatgaaatgtcttgatcaaagtgagcatcgctgatcactccatgctgactggagtaaagaacagtaccaaaaaaaaaacagtgatttggtgttcgcaggtgccaacgtctttattccctggtcactgcctgccaaaccctgcaagcactccacgcattatattagcgtgtgattactgatttgctggcacttggcagaattatcccaaaacctaatcagtacttgcaaccattactttaaacttgattacattacatgattcggtggtcggttgattgattgataccttgcggccgaaatcctcattactactactgcatgttaggaactgaataaagaagaggaggttccctctagatcctttacttgcacctttggcctttcttttctccttaatctacccacatggagggatccatgtggcccccagtatcaagttcaggtctccttgtgggccccaacggactcatttactcctcactcattaccatccaaactcctcttttaaccactgtaaatttattactccttgctaataatcctaataatagtcacattgcttagatttgtagtagtagtagtaataatttaacagtgtggtttgactgagaaaaccgcgagattggtggcagcctccacgaaaggagggcgtttgatatgattatatatatgcaggaaaaaaacgagatatccctgccgtgcgtcgcggcaacaaaccgccggcaaaccaaacgggcgtgaaatcatttcggaaaccccccatccctcctcccctttttcctcgtaataaccggacgccgacgcggccccccgcctaggctgccgcagctgaaccacggcgcaagcgcaaccaccacgccgcgcgtacgcagcgcggcagtaaaagttgcggtagaaaacggcaaaaacgccaccaccgccatcacggctgcgggctaccaccaccacggcaccaccgcgtggtttgactcgtcgccgactcagatcgcctcgtcggtgacacacacccacacacggcgagaaagagtgagagaaagacgaagtggaggactccccccactctataaatttactggggtttggttggtgcgtgtgcagtgcagtgtgcgtgagtcatcgcggagtcgtcagtgtttcatcgtgtgcgccgcgccgctgcgtgcagtgcgttgcgttcctccactcccgcggcgaccgcttcaactcgcgcatctcgaggaggccggctcggctgctgcgcctcactctcactctcactcacactgcagtggtggtagtggtaggcaatggcggcgccggcgccgaagcaggaggaactgcagccgcacgcggtgaaggaccagctgccggccatctcntactgcctcaccagccctcccccatggcgtcagtgcccattccctctctcatcctctctctctgcattccaggagtggatcgatcgatctccatggttggctgcttgacggcgccttcggtttctttctgcagcggaggccatcctgctcggattccagcactacctcgtcatgctcggcaccacggtcatcatccccaccgcgctcgtcccccagatgggcggcggcaatgtacgtcccctcctcccgccgccgccgcggcgtcgcaccgctcacttgcttctgtgactcactcatttggctgccgatggatgcaggaggagaaggcgcgggtgatccagacgctgctgttcgtcgccggcatcaacacgctgatccagagcttcctcggcacgcgcctgcccgccgtcatcgggggctcctacaccttcgtcgcgcccaccatctccatcatcctcgccggccgctacaacggcattgccgatccccacgaggtcgccctcctcactcccccccgcacccacgcaaagtttgctcctcttctgtttgactccttgctgtattgacactgacaaatgtggcgtgctgggttcggcatggcgttgcagaaattcgtgcgcatcatgcggggaacgcagggcgcactcatagtggcctccacgctccaaatcatcatggggttcagtgggctctggcggattgtcgtcaggtgtgcatgtctcatcctcagggttcagattccaggtcgtttgatcagtgtaccttaactggccctatcattctgctaattcatgtttatattcttgtaatgttgcaggctgctgagcccactgtccgcagcaccattggttgcgcttgttggatttgggctctatgagcttggattcccaagtgtgagtattttgtactacaattgtacatgtacagtcgtctggatgtatttgcaacagtggtatgacagcataaatttactatgcaggttgccaaatgtgtggagattggccttccacaaatcatactgctggtggctctttcccaggtatacatcaagatggctattgtgtgaattctaacggtggatgaatccttatgaatgttgtgtaaatctttgtgcagtacatacctaagctggtgcctttgttggggactgcgttcgagcgtttcgccatcataatgtctgtggcccttgtctggctttacgccttcttcctgactgttggtggggcgtacaagaatgctgctccgaagacacaatttcactgtcgaactgatcgatctgggcttgtagggggtgctccatggtaataccatgcatctatttccatgccatcctaacgtcggaaaggcgttacattacatctgtttgcatttatatcctgcaattggcagtttggcactaaagaaaagattagctaatataaatagattttcgtctgcattttataggataagtgtaccttacccattccagtggggagcaccaacgtttgatgctggtgaagcttttgcaatgatggcagcttcttttgttgctcttgtggaggtactgtggatatatctatggtttttagggggaggtgcagtatgttagagggcattatgcatcaaccagctaatattccttactgtctaatgcagtctactggtgcattcattgctgtctcacggtacgccagtgcaacaccatgccctccttctgttatgagtcgcggcattggttggcaggtaccatctagactccttaatctgcaaatattttgtccgagttcttgacaattcaaatggcatgcaggcatcttacctactttatttgtttgtgtgttgcctagggggttggtattttgctgggtggcttatttggaacagctaatggatcatctgtatctgtgtaagtacattctagattactgttgcctatattttactgttttatacagtttcatattaatactagcatttgatgttggtctgagatactttgtaccgttctggaacagtgaaaatgctggtttgctaggtttgacacgtgttggcagcagacgtgtggtgcagatttctgctggatttatgattttcttctctattcttggtaagcctaatgctttgatgtaattatgtatttagatggttttgatcgtactcttctgtcaagtaaagatgtatttgtgagtttgtgagagtggaaaaggtgaagttctatatccaggctgttatccatgacctgatcaagtatttcctgtaatgttcagaggtggtttgttaatggttccaacgactgatagctggataaatagctaagcttaaaatcagttcatgaatagtttctcaaggagccgcagttagccagaagctgaatattacaggaaatactattgcacaatagcaaggctgacactgactcagatttaactaaagttaaagtcgtgattactgcataaaaacctatacttgtgatgttctctcaggctttcataatttcttttgcttatttaagcttatcatcttgtcatacaactttaaagcatccttgttatgctcctgcaatactgacaataagcatgtacttcatctggttgtactgattctgtgttgcgttcctagggaaatttggagcggtatttgcttcaattccaggcccaataattgcagctatatactgtcttctctttgcatatgtcggtatgtacaatgaagagaatcttaaatgataaatctagctttctttctatcatatttgaattatgaacacctgcaatatatttggtttctgtccacaggtatggcaggagtagggttccttcagttttgcaacctgaacagcttccgaacaaaattcatcgtgggattctccgtgtttatgggtttgtcggttccacagtatttcaacgagtacacctctgttgcaggctatggcccagtacacactcacgcaagatgggtaagacccagtaaatatactcaagtgttactactcctttcatgaacctaacaattgatggttatgtttgttcctgtttgctctttcccagttcaatgatatgatcaatgtggtattctcgtcaaaagcattcgtcggaggcgctgtagcatatttgttggacaataccctccagaggcatgacagcactgccaggaaggaccgggggcaccatttctgggacagattcaggtcgttcaggacagacccacgcagcgaggagttctactctctgcctttcaa

SEQ ID NO: 68231 - DNA, 25088 bp, Oryza sativa
ccagaaaatccggaccatttcaactcgaaacagcgagctgcagcctgcaggtgcagggggagtcgcgtacacgacctcgtcaagtaccaaccactcacatgcaattatatgcaaaacagaaaaaaaaaacactttctaactcttatttcgtgcacatacagcaagtacaaatattatactcccatttagcaaccgacgttaaacgtgacaatacacgagggatactaattctttatttgaaccgtgaaattcgccagcaaccaatagtagatctgatgcaacggaaccaaactaccaaaggaggacagtttaaattcaaaattccctgatggctccctgaaattcctctgttacaatttatttttttaatcccccaataattagctgcttataatataataatcaattaagaaattaattaatcctttgctccctgattgcctctctgcctcgctgtacattgcccacttcgccgcccgtttcggtttccctttcttcattcttcttcttctcatcccaaatctctcctcctcccatcccgccgcgcccgcgagagatcagcagctactcgactcgactcgactcgaatcgaatccgaggtgcgcgccactcgctcgctgcgattctcctcttcttcttctgctggtttcgatcggttgcttgcttcttctgcggttgctttgcttgggatctctgcttacgttgctgttgtttgggggtttggatctcgggctgtgcgtgtggtggtgcaggggggcggcggcgaggggtggtggtggtcggccatggcgcaccgggtggacaacgagtacgactacctcttcaagatcgtgctcatcggcgactccggcgtcggcaagtccaacatcctctcgcgattcacccgcaacgagttctgcctcgagtccaagtccaccattggcgtcgagttcgccacccgcacgctccaggtcccccttccctcgcgcgatccatcctcttctctcgcgactatggttcagaatagtagtgttggggatttcgcatgtcaccattgcgttcgatgcatttttgtttgattggcctgtcgtgatgtagggtttttctgtttgatatgagatgattacttcgcgtgtactgaacatgaattaagttcagttcaattctgtgaatctgacgaacgaaatggggggaaaaatatctactactattgattaatgatgcacacgttgagctctgactctttttgcatgtaccactcgtttaatagtagtatgtcattttgttgtgcttcatggggcccttggaatgatttgaagaaagtaactttattcttaactgcactggtatcaacataaatcagatccataggtacagagctacagaggtactaagtatcatttatcatgtccttatttaattgattaaggggatattaagaaaaaacttgaattacatgttgctaaagtcaatttggtagtcaatgtagaagatggtgagctttatgctgtgctagttgaacttatgttgctaacttatatgtggtgcataaatctctactttttctgttggaagttctacaactgctttggcgtatttcactcaactgtctttcaatattggaagtatctctgaaacatgcatttatattgcattgccttctgatttcgtataaatccaaactttgcagtttgtcatccattattttgtttataccttgacttgggtgtatggattatgcgtatcattatttgaacagtatatttcacattgcaccatatattttgaccaaagtttcacaatgggcaaggtccaaaccaaccttttttcacttaacaccatatatctttgcactagttggcactttggactagggttgagcacatcaaaggaagttgtcagagaaaagctagtttaaatcatcaattttagtgccacaatattaggataaatatctttagaaaaagttagcaaatcagaaaataacttttttcagcaaatcacactaaaacaatgacgtgaacatgtttaaaagtggcacaaaatgatctatacattggggcaaatgaataaatagaaaatagaactagttaattaccacacactgaaaagaaggaagaaaacataaaatgttttgccttttataattatccctatgtaaatcatatgaatttctctcatattcccttgttttgctcaccccttgtccaaactgaaaacttatgtaaagatgtatgatgttagtgaaaacattgatttaaccctagtccattatgaaaccttggtcaaaatatgtggcccattgtaaaatttactcttatttcaatagcatgttaaagtataccgttatctttgtaacgtcataaagcttgtattaagttcataacaccggcgtggtaactataattctgcaggaattttttatttgatttgctctgttgctggagcattgctgatgcatttacagagcttctgaagtctgagcagtgtatttatcattattcggtatacttgctcaattcaaactgcttgttaaaaaatgatagcaacttgcactgcatagattgtacaagtggatcctgtccagaaatattttaggagaagggtaacattttggggaggtcggaagggggtatgtaccattactcttttgttttcttttagtgttgtaggcctctgaatgtacctgacggttaacacacactgtttctatagatgagtcttttgattaatttgttgcatttcagagaacttctgaattttgggagctgttttgcctgtataaggctctgatatagtgaacttgtaatagaccttaacaatctaatttcaccatactatagcgacttctttcatggcaaatactcaagttaaatttatccatgatattggtattttggctcaccatattaggtatgttggtctttcttatttagtgtggtatcatgtatacagatagaagggcagaccatcaaagctcagatatgggatactgctgggcaggagaggtaccgtgcaatcacaagtgcttactaccggggagctgtgggggcacttctagtctatgacataacaaagaagcagacgtttgaaaacatccagaggtggcttcgtgaacttcgtgatcatgcggactccaacattgtcattatgatggtaggcaacaaatcagaccttaaccacctgagatcagttccagaggaagatggtcaggcactagcagagaaggaaggtctatcattcctcgagacctcagctctggaagcccttaatgttgagaaggcatttcagactatccttaaagatattcatcaaatcatcagcaagaaggcacttgctgcccaagaggcagcaggcagtggacctcccactcaaggaaccaccatcaatgttactgattctgctgttaacacaaagagaggatgctgttcttcctaggtgcaaccgaagatttggtgatgctgcaaaaggaaattcccatggatcttacagcactaggtgttatgtaggtcgcttgactccttttggcctgtaattctggtggggttgtaatcacaatttaaatcgctagaaagaaatattccttttaaggtagataccatgtgtagttgcaaaattttggtagagactgttgctgggcaagactttctacagtttcatatctatatcatgttttctatcagtatgcttgtgttatatatcttgttatagtctaaattgttggagctgagaaatactatgatgttttccatgttggtgtaatatccagcatcttcctgctagaaactaaaaacatttatttttgcctttttggtggtattatccattccaacttatgaactgaacagctaatatatctccattctcacttgtactgcattttgcctttctgctgatcctgtttctttcttctcacttgttgcttgaagtatactgcatctgcggtccctgctcacgtgtatcacatccttcgattagttggtgtaacatcaggatttcagttcatttgattcagcgttttttacattattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatagaatcagttctatgctatctgctttagcataatctgcttttccattggaccgggaacagcatactttggcatcgttgtcagtgctggcctggccatgcatagaccatttgtgtcatgagagacatttgttctaagactcctaccttaaaactccatgtaactttgatccacattcgcttctgactttatatcatgagaaagttaatcattcttccatttttgggctggttcatttcaggacatttttatttatgctgattcagacatcaacttggtgatcatagaacatttgaacattatcatgaaaaattttaatcattcttccatttttgggctggttcatttcaggacatttttatttatgctgattcagacatcaacttggcgatcatagaacatttgaacagtaatgcatgtttgcatgcatggagaatcttacagagataaggcaagcaggtgacaattccttgtgatttttcatcatacctcttgtggtcttatattgtgagactgatctgatctcactgaagaagaatatgttctcctggcacaaatgtcagtcaatcctttctgctaggatggagatagatgcctttttttctgcatttttccttttgcgattacatgaaagacgtctacgcatacagaccacacggactgccattcgcgagtacacccctttaacatatgctcaagagtcacactcatgtatgaatgatcgtagatattatgatttgatcttgataaatggagtcatgcacctacaactccgctaacatatcctttttgggatcagaagccaaagagggtccatcttttatagaaagcaagaactacatcaatatatcaaaggtgtttatcctatttcttttttgcaaattggaggacaagagagtggcaaaaaaaaatcttgcaggtatgtcaactgcagagtctcctcctctggattcttgatggacgcaacatctgccgaatcgtgttctgttcacttccaagaatgtgcagccaattagctgcaacggccttccctttctttctctccctttttcgaggctcaaaagatgttcgagaaaactctagctcgctttttgctcgtacgttcaaaatacggtgcatctctctaaatataaatttcaatctaatggcaggcaggcttggagctgattgtgatctgtcctgctggtgattatcactcatgtgttctctgctagattctgaattttgtggccataacgcgttttcattctagaaaggatgtttggatgtcgaaatttctttgcttggtgccttctattttgaattcaagttaaactaaattctaaagatttaattcgatatggagggcaatttgatatggtcaaaacctgttgaagcttcatagtacaccacaggtgagttgatccagtttaagctgaaatcaaaagcagctttagtgcacttttttcacgaaaattttgactaagagggttgattttagcattcagtaaagatattctgcatacgaatacccacggaaatctgaaactttgaattcaaaagatttgagaccatggaaattgaagccagagtacaaacaacctttttagagaagatagttcagaaaattaaataatgtttaatcgattaataatcgaacattcacgatggactgatggtgtgcgcactatgctaaccaacttccaattgatcgtccaattagtgcgtgtcggatacaggagcaattattataataaatctttactcgatcactagaaatctacatatattaatctgtaattctgtatggaccatgcatagctaattttgtactccagcagaggcaccaataagcatataaatgtgagattttattcaaatttttaatagcagtcctattaattaatgtttgtaggcaccattttacctgtcatggaaaagaaggttcatcccacaatctatatgcatgtcctcatcagacttagacttgctagaaagagattaattatgacctgctggttaattaataaaaggactcactggtggctactggctagctagctaggatgcaatctagttttgagtataattaagttgctatggctcatgttcctctctagctagctgcagttaaatatatatgatataccggtcatgtggttgaccaggagattacccactaaaattctggagctaatcatggtctagttctcatcatggagttattgtggctagaattaattccatgctagctcaacaactgtcaaaaaaagggaaattaaacagatgcgtttgagtgttatagctttttaattacttattaagcgtgatgatagtatccaccgaccactgtaactagattagagctaatttaataagtagagttaactattaattataagttaatttaaagtagaactagagctaaaatgtataattataatagattattttttcctctctttttctctacttgtataattaatgcatttgcttaagagcatttgtagaactaactcttaaatgagaagtagcacagtaacactctatatttttattctctttcatatagattaatcagttggcttatagcttactattaaacttgctctttcatatagattaatgagttggcttataacttactattaaactttcatatagattaatcagttggcttatagcttaatataagtattttacatgagttttagcagagattattgttaaaatgaaattactttgatgtcccacgatacaataataaataaagaaaatcataactgttggttggataaataggaaattagtacttataaatgctagtatttgcaggcaaatttcaaaagttagacgtcacatttgtggatggagagaacactactgtactgtgtgcgcatcgatcatcttgtcccaatcgagtacttgtgcaacaattataattattcttccattttaaattacttattgttctaagtttattatcccaagttaaactttttaatctttaatcatcaatttctataaactcatatagttttatatcataatatttatattgttatattcaccttaaaaatactttataatatataattcatgtgttattaaactacactacaaatttaatggtaaaaataaatatgtttgacttaggataatctaaaataaccaataatttaaaacggagaaagtgtacattaaaccatttacaactactgtaaggtagtctcacgctaccaattctaatatatacactactagttcggtgcactaattcaatagtagcatgtatctcagtcttaccatatcttgaactttatcaaaggttgccacatcttgtgttagatgtttgactttatcctcttgtttggttcatacttgtggaaagattctctcttattttttatggtcttatatatctacaattctattttgttagttaaggtgtgtctcactttttgctagctatatacatcttaaacaagtgtggcataaaagtatgacaaatggtgcaaaacttattagaggacgtttggatgtatatcaaagtatggcaaatgatggcaaacatagtatccgagctagctcttgtatgcttgacagtatgtgacctatattgtttctctcttgtcgtcaactcaagttacatatcatcttttttgcaccacatagcacaataatagatcatagcctatgtacatctcagttgtataaaggaataattgtgttatctcgatgtaatttatgtaattatctacgatcagtaaagttttttttaatctaaagtaatatggtactattataagtggagcattttgaatagttttgcatgttgctaatttatcaaacaccacacggtaggatattcattgcttgacactgaattattgtaattctgatgtgattatttaataagtcttcccctgtgtattactctctccgtttcacaatgtaagactttctagtattgtccacattcatatacttgtgtctagaatctagaatcattaacatgtatatgaatatggacaatgctagaaaatcttacattatgaaatggagggggtgtactagcaaagtggaataaactagtgctcaattgcttcaacctgttggaaaatatgcagatagtggtaccttttttcttgtttgttagtaaacgatatcgtctggcattcaacaaaatttggactgaatccaccataactcatattaattgctatgaaaatcctacagtaaatttcacattgagtcaccttttattactgatgttttgttttggaccaccctttaaataaaatttccattttgaactagctaatcttgcctttgttttactttgtaccattccaattcgtttctcaagcatataaacaacctcgagtacgtcaactcctattcatcaatatactccctcatctatatataaatattttcttgacacatgacaaattggatgtagatagataaaagagttgagggtggtccaaagtgccacaaaagtaaaattacttggtccaaatttgaaaacattggttgaagggtggtttaaagcaaaacaacatcaagaaaaggtggttcaaagtgaaatttactcaaatttcccatcaaatttctacattccaaagaattcaataaaaaaaacttatatgaggacaaaatgatagtttatggcctaatatgtgaaatatttgtcctttccatttctcctctttatttttgtcgtgttctctcttgcttaacattaattttgtgggttggtgcttattttctaggaggtgagagtataagataactactctctctatattaaattacttgttattttaactttatcctaagttaaatatttctaactttaactagaaaatttctaaaaatccctagtttaacaacaagtgagttatatattatgaaagtacttatcatggtgaaaaacaaaaaataatcttataatgttaggctatataaatatctagaaattaatggtcaaagttagaaacattggacttcaatctaaaatgataagtaatttgaaatgggggagtacacgtaatctcccttaagccactactctaatttccaggcatgagtataaaaattataagttggaccagttgtcttgtgctgtgcatcatgcagctataaacctatattgtggatctgcccctccctaccgcaaccaactatgagcaggtaataatgaactagagaatgcttctaagccttaagaacctttacatcatctcaatttgactttggatttgcctaatgccaaatattttttttgccaatgaaagaaaagaagaagaattttccatgacatataccatgaataagtgcgattcagcgcaaacatcatttgtaaattgtgcattttgattgtgacctgatcaacccatccacccctaggacattttcggcacatgttgatgatcgacaagactagctactatggagatggctcatgctgagtgtagcgtgcgttttttatgtaatcgaaaaacataaatgatactccctccgtttcaggttataagacgttttgactttagacaaagttaaactgtttcaaatttaaccaagtttgtagaaaaaaatagtaacattttcaacccaagacaaatttattatgaaaatatattcaattattgatttgatgaaactaatttagtattataaatattactatatttatatataaacttagtcaaacttaaaatagattgactttgaccaaaattaaaacgtcttataatctgaaacggagaggagagagtaccgtatatgttggatctcatatatgcatgcatggatgacatttatgctcctaatattttaagcaacccctaaatgggcgacaagtggactgaccacgcgcaatacggtgacgcatcatcactaatctcttcattgtgtgatagtcaaatcgtggcactgcacgttcacgatcagcatcatactgtcatgttctcgcatgtcaaagagacattagttcgtcgatatatggatgatgtcgtccatatataatgggggtacattgtggctagattggtacacctgattgatttgctagctttaattatatttactcccacaaagcttggatcaatccgtagaaagttcattcatgataggtcaaggtcaggaacactgctataggcacccaaacaatatagaaaagttaggtaaatacagagtgtgaattaatagaaaatatcgtcgtatgtgagaattatacatgaggcctggacagcatgtttaatgttgatgtagtgtggtagtttctaatttcataataatcatagttgttgcacgaagaaaattatgtaatacagagtgtgaattaatgaaaaatgccatagcatgtgaaagtgatatatgaggcctagtacatcaattctaggatgatagaggtggtgtttgaatctagaacaagtgtttcacgcaaaacgaggtggttgtaacgtgtgattaattgagttttaattattacaaacttgaaaaatggatttatctgacattttagagaaactttcatatagaaagtttttgcatgaaacgtaccgaagaatccaaactttcatatagcagtttgaaaagcgtgccacgagaatccaaaattttatcctactcttaccgaagaaacgaacagggccagagggtggtatttttcccattttacaatcatcacataaagaaaaatgatacaattaatcatcacagaaagaaaaatgttgctaaaccaaatatacagcttagaaatcaggtagttgatgaacctatttgtcagtgactgtttcgattacaaggtgaggtaactgtgaagtacatgtagctagcctgcatggaattccaaagttgaaagtgtgcatcgttagtgaccctccactaatcacaaaatgttgcggctatctccgtatgagctagctgtctcaaattttatgctccatttcttacatgtgctaattttggttagttggaggcagactaaagcaaaaaattaaagtgggagagcaaagttgtggagtccatccgtccatccgtccatccgtccatccatccatccatcgccgattgcatccaacttgattttgtcggcaatgcaatctaatgcatgcttgcatggttatcgtctctactgacatctcctaatccagcaaaatattcagtgaatatgactgtgcagagacagtgtcgcgtgcagtgcatgcatccatggaattattgttacttaaaaaaaattcagccagatgtattaaatgcgttggtgtttttggttcattgacaaaaccaaccatataaaagaattggtggtaatacttgcatatccatttgggggtctgttgccaaaaaaaaaatgaaggggctaaacacaagcttcggaagtaacattgccaatttttttggcttgacaaaattttagtaaggctaagaatagctataataatccaaacaaacctattatggctaggcactagaatttgaattgttagcaccctgcaaaaatatttgggaatagcaccctgcaaaaatatttgggaatggtgccatatttgtcaataaaaataaaattttaacacgtatttacatgtaataatcaaatattacaatatttaaatctatatatttcgaatgtaaatttcagaacttacaatataaatagtatcaaatgtttacagtgtattttttttctaatactcaatgtatataagatttgagactaggaattattggttaccggtgctgatcaacaaatgacgtaaaaggggaaaataaaaattggaagagagagaagcggagggatatatagtctgttcgccaagccaagatttggggacatatgttgcccacgacggcatgaacatctatcgcacggtccaaatccgattgaaatcaatcacaaattgctggcgatagatttttagcaataccggaatactcctacttttacatcagaattgtacatggaagttatgtgcgcgtctgatctgttaactagtactggttaactgtcgcacgcagctgttgtgcgtcccatttgccgacaccagataaaagagcttaggtattatcagtgtcaaaaaaagcagcggaggtgacggactcatggcacatcagtttatgttgtatgtcatcctagaaatgcttgtgctagctgactagctccaccactccagtcctctgatcctctactgctcctgtatacttcttttcactgaattttcagtgaattggttgttgcttgttagtactccctctgtcccagattataaaaggttttaaatggatttaacacatcataatactacgaatctatacaagctttctgtctaaatttgtaatattatgatatgtcaaatccacttaaaattccttataatctggacgacaggtgctatattggcatgaggaagagcaattcatcatttacgattcaagacaagaaccatcaaaaatgtattaaacctgcttagattaggtcatatatacaatagatttttttgaactagaacaaattatttcattgttcttcagacaaaagaaagaaccggacaaattaatcatggccattagtacacactttatgtaattattttcctttaaaaattatcttggtctgatcaacgtcatccacagaatactatgcaggttggtagtgcttgttgtaaaacagtgtgtaacagtgaaaccgacattttttgcccctgatatgggctacacatgggagagctagacttttattttaagaacaagtaaatttcacaaaactactggtattttggttaaattatcaaaatattatagatttaatatgatgtatcacaaaacgatatatttaacactaaatttatcacagaactacagatttaaagtagaatatcgcaaaactatatatttagtagcaaagttatcacaaactaaaagtttaatatcaatttaatcacaaaacttagacatatataactcaaacatagcattggtgctaaggatttaaaccctacaatctgtagctttatgacaattttattagtaaatttgtagttttgcgatacttggcctttatgataattttattattaaatctctatttttgtgatatatcactttaaatttatagttttgggatgatttagccaaagtatcatcacattacatttactgtaagagaaatgatccccacaagagagagagaaacgaaagtgcaaaccattcctagaataacattacatttgctggaaattaaaattcatccatctttgattgcacattatgtagtataaggtggcatcacatttttagtcatagtaatcaaacatggtaaattgacaaacttcagacctttgggttggagaatttgaaatatttttgacaggtttgaatcaatttccatgagaatttaacaaccagacggcatgtgcccaaaaggttctaaaatacttccccacttcggttcagatgtgaaatttgttcaaaatttatatgaggctcctattagaaatttgatgagggctagagacttacacatgatcccatctcttaaaagtgggttgaagggtgccaatcaatcacggttgtgcgtgtggtgtgagtgtctagtggtatgtgtgcaccctgcatgatggaacaatcccaaatttaaggaaccaccacgcacctaaccctgagcatattgatgttcaaactagtcattaatttttacatagacacgataatctcaagatatatcggtctagttttccagatatgctcatagagatagatgtgagcatttataagggtgagtgtgcgtgtgttgtgatcgtccgcagttatacctgtttctcgaaagaaaaaaaaagatgatcaaaatatttcaattgacaattagtaaatcatcgagttacacattgtgaacattttagtcactaaaacatatgaaagaaatatgaaacatgtaaataccatttgaaatatttctctattttcttagaaaaagtgttcctttcttatatgaaatatcaaattttaacggttaagacatactccgtatattttcttacgcataaaatattttaagggaaaaaaattaaagcttgctaaggagctttattctttgtatgaaacatgcagccatcaatactaggtatctagagagaggagggaaaatgagcatgcagagcgtcctatgagcaccctcgaggcatatcttatattgataaaatcactataggtgtcttgctttctatgagtgctgtcagggttatagataccgcatacccaatagtaatcgactaagctcggcgggcccactacataccaagtcttatacggaatcataccttgtatatagaaggggttccagataagtaaggacaagtaaagttctatatgaaaacgacaaggactagattgtatccatattggtcttcctagtcttatttggacaaggaacatctatgggtataaatacaagcccctaggaggagaggggacacgccacaaagccacaagatcaacacacaatacacaagccaacacacgccaagacatgccgtcgggtatcaacatcagagattagcctagacaaaccccgtccggtttctacggaggccggcaatagggatctagcagcatatctgatctcggcgagtgcggattcgaggaggaagactaccctgtcgtagtcggttatctagccgccaagtcaacgacaacaagataagttatcccaaatattatacttgtgtaattcaaatgaataaaggagcaacaccggcttcagccaacaggatgtaggggtattacctgtcagataaggggcccgaacctatataaaaatccttgtctctgtctcttttactccaatctcgcatataccctagtaccaatgatccccataccatctaaataccgtagtcgcgatctcaaacgtcgacaagtgcgttgcctaccactaaaaaaataattaaccttaaatacaattgcttatgtgaagtgtaggacttggacctgaatgggccaattccagctaaaggaatctattgagctactctcactttgattgaactctaatttcacgaagagatgtcctctcgtttattatatgttatctaaataattataaacaaactgataagatagattaaataattccttgaggcaagataaaaatatttttgccttctgaaacagatgttgagtgatatatcatgtataaaactatcttttttttataaatgtttagatggtatatatgaaaatagtttcccaaaagaagcctgtgggcgtaaattaggactcggatcctctacattaaaggaaaaaaaatgcaaagaatctacagtacacttgcattaggcatggtttttaccgttggatcttcatcaaacggctagaaacggatgttacactgaactcgaatagtagaaggggaataataatattttgtcaaccggtcaaacccacactgtgcaagcagtttttgctacagtactactatactgttctaacagtggcccttgcattacaggagaggatccacgtcccgtaaattatttcgtcctttttggatatcactgaattatttgcttcatgttttctaaaatatactccctccgtctccaaatatttgacatcgttgacttttttaaatatatttgatcgttcgtcttattaaaaaacttttatgaaatatgtaaaactatatgtatacgtaaaagtatatttaacaataaatcaaatgataggaaaagaattaataattacttaaattttttaaataagacgaacggtcaaacatgtttaaaaaagttaacaacgtcaaatatttagagacggatggagtatttgcttagaaaaaactttccagtagtactcattgcttttttttttttttgaacattgtactcattgcttgaaaacttatttcaaactattgactccatgaaaagtatatgtcatcgagttgcaacttgcgacgtcgtacaactccatttgggaattttgcaggagcgtttacacatggcgaagaacacgacgagcggttggcagttagccgctgactgaaacgcatgcagagacaagcatttcctgcgaaaaatcaacgccgattccggtgggcgatcgatcgatcgacggctgcatctgcgcatccaacttgcttagcttgtatcttcgtaaaacggccacgcgtgagtgagcccgtcaccctgcgagagatgtaaggagggcatgtacaaaagatagttcgacacgacacgatctcttagttaatacttctgcaatagttaaaaaaatataacctcttaactattactacatcaaaataaatttttattacccttattttcttttcttctctccatctccatgtaacaatatttcagttaataaatgctaccaagagttgaaatctaaaccgttgtcatacgtagcaacgctgtttttttttctttttttttcttttcacgtcactaaatttatatgcatatcaatcgaaaatcaaaagagtacgttaataaatatcattgtacatgtctaagaaaaacggacgtgaaaacgtgcacgctttaatttactggccctgcatctcggctagtttccatgcagaacagcggcgctagagacggcgtatgcatgatagatgtatgtatctcttggattgatgacgtttgctggaaatttgggagtcaatgcaaatttttatgttttcaatgtattatatctttgtgatgcatacaatatcttctcagtggactatttaatctccaggatttgatacttcatagatttcactcaaattaatgagtgctggagctattgtgtatgcatggcaaacattaattagaagatcaaggaaaaaaaatatagtgtgaggtattagctatgtgttcaatactccaccactaaataagggagacagattttgactccaaatttgaacgttgtggatagctatgatcccaccaccacatatgtgatgcttcccttcttttcggaggatatgcaacatgataatctatactccctccgtccaaaaataagtgtagttttgcactattcacattcaaggcaaattttcaaatttttcacaattttttcaaggcaaattttgctacaggacatcgcaattgtgtggttttaactcagggacaccgcgaaagtgaagttttgggggaagacatcccataatcgtggatattagccgatggacaccgtgccatttaaattagctcagggacaccgtgaaagtgaagttttgggggaagacatcccataatcgtgaatattagccgatggacaccgtgccgtctaaaggaatcttgccatgctgacgtgacggacggatgcccttttttgacgcggttggacctaaatgcccctgcgccttatctccttaatgtttggccccacatgtcatcctccatgtctggccccacatgtcatcctcaatctctctctctctcatctacaaggagaagactagagcaaggcaggcgacgaccagagctgggcaggcggctgacggcggccggagctggccgcgaagctgagcagagcagtagctcagcggggagcaaagcagagcagcagcacgcacgccctggatcccccgaagcaggaggtggtcaagccgtcgccgccgggccgcatccgcaacagcacgccctcctcccccaacctcctcgtctcgagcgccgacgccgatgccaagaacatgtgctgctactccgcgctgccgagcgcctgcccctcttcccctctctttccaatcctctccagcggctcccacgcgcgtgcgctcctgagcaagatacggcaggcgcgcgacggcacgggccgaggcgacggcggcggcctaaagggagcctggcggcgttgagtggatggggataaaaggctggctcagcgaggaggtgccagggcagcgccgagcagaggaggcggaggtggaggcgctgggtgatcgcggaggcggcgcccgtgtgggccggcttggccgtgcgcgggggcggtgctcgcagcgtggtggtggccccgagcaagacgaagacagcgggtggtggcgaagcagcagtggcgcgcgggtggtgctcgcacgggagatgtggccgcgcgcagtggcagcggccgagcgtggcgacgacttggtgcggcggcggagaggggagagaggtagctagcggcggtggggaatggcctgacgggaaggcctttttttgctgacgtggtgcaggggtatttacgtccgatcgcgtcaaaaaacggcctcccatccgccacgtcagcacggcaagattcctttagacgacacgatgtccatcggcaaatatccacgattatgggatgtcttcccctaaaacttcactttcgcggtgtccctgagctaaaaccacacaattacaatgtcctgtagcaaaatttgtcttttttcaaatgagacggacggtcaaacgttgggcacggatatccacggctgcacttattttgggacggaggtaatattttctttctttcttatataaaaaaacaaaccacataaaggaagtcgtgggcttaaaaatccacatcagtaacacactacataccttgtccacgaatacaaaaaatgattggaggtgtgaggtgagaaaattaaataaagagcggtggctaggagaaatagtttttgtgaatacttatatttgtatggcaaataaatattaaatgctaaaattctttatatatagtctatgaatctttatatgtgtaaataaattccaattattaggtatccttatatatacatatgatgtatttcaacttttttaaatgggaggtgtatttctactttgaacatgatgaattgagaaagttgcaataggggtcaaatctcttagatatttgtcatcccttaattattttccaaggatagtagttggcgatatttggtccaacgtttgtttgtagtaaaaagtaacggcaggagtacaaaaattaattaagtatggttggtaaaagctcattgaattgcatgcggctgatgaaaaaaacgtcaattttgtcacagatattttcacaccttaattactactagtattttacttaagcaagtcatctctaaagcagtgaaagactgaaagtagtgagcactagccactagcttgaagataaacacgccaagttaggccacagattatttttttttaaaaaaaaacacgccaataattagtgtagcaaaaaaaatccttgaattcccattaatgcgtcgccttcaaagattttttttggttagctagactaattatttccattttttcacaagattagactaattcaactaattcttttcatcgattcgcctttcacccaaaatcgatcgagctctcctttccctgattcgattcgttataggcccatcgatcttactaataaaatgattacaaatctaatcaacagcgaccactgactgaagccgcagtaatccggtcagtctgcgagtgagctcacacctcgatcctcgtcctcttcttcgattcctcctctgttctcgctggccgtacgtgtcaagcgtatccagcacacacggctatataaaggctgcacctcgagccccttttcctcccaaccaaccaacctcaaatcaaatcaagaacagctcgtgcttagatcgctctctcgcttgctgttcttccaatccactcctcttgtttgtggcaaagatctgggttctttttttttctttttttgccgggtttttttggagaggttttgtgagcatggagggtttaaggggcggcggccatggcgaggcggcggtggacggcggcgacgagaggtgggtggaggactcgtcggtggattaccaagggcggcctcctctccgcgccgccaccggatcatggaaggccgcaatgttcatcatctgtaagccactttaatttctcgatgaatctttgtccgtacgtgttcatgtgatttcttactgatcgactgagtgacgtgttcgtcgtcttcctcctcgatctcggcgtgaattcgatcgattggttaaatgaagtgattgagttcagcgagaggctgagctacttcgggctagcgacgagcttgatgatctacctgaccaaggttctccaggaggagatgaagttcgccgccaagaatgtcaactactggaccagcgtcaccaccctcatgcccctcgtcggcggcttcctcgccgacggctacctcggccgcttctccactgtcctcttctccactctcatctacctctcggtcagctctctcactagctctaatggcgttcctcgccggcagcgagcgatctctgatgatgatttttgttttgttttctgtcattgcaggggttgattctgctggcgatatcgcagctgtcgccgaggctgaaacccgagcgcaacctgcacctccacgagacgctcttcttcgtggcgatctacctggtgtcggtcggcaccggcgggcacaagccggcgctggagagcttcggcgccgaccagttcgacgacggccacgcggcggagcgggtgcagaagatgtcctacttcaactggtggaactgcgcgctctgcgccggcgtcctgctcggcgtcaccgtcatcgtctacctcaggagaaggtcggctggggcgccgccgccgtcgtgctcgccgccgtcatggccgcctccctcgccgtcttcctcgccggctggcgccactaccggtacagggtccccgagggcagccgctcacgccgctcgtccgcgtcctcgtcgccgccgcgaggaagaggcacctccacctccccgccgacgccaacgagctctacgaggtgaagccgcagaatatcaagaggcggctgctctgccataccgatcaacttaggtgaccacttcatttcaactcacgttactttccttgccccttcttttctcgcaaaaagacactaatcattgacgcacgtacactgcaccacggctcaaccaccagtcgacccaaaaacttaagctgacgagagaaaaaaattatcgatagtgaaaatgataacaatatttgatcacgttgtaaagttatacataaggacttaccttgtttatccaaaagcttaaactgacgaggaaaaatgcaattgtgattgtaatcatggaatgtgtggatgacatggcatggcaggtttcttgacaaggcggccgtagtggagcacgacggcggcgaggagcggcgcggggcgtggcggttggcgacggtgacgcaggtggaggagacgaagctggtgctggcgatggtgcccatctgggtggcgacgctgccgttcggcatcacggcggcgcaggtgtccaccttcttcatcaagcagggcagcgtgatggaccgccgcatgggcccgcacttcacgctgccgccggcgtccaccttcgccatggccgccatcggcatgatcgtcgccgtggccgtgtacgacaaggtcctggagccgtacctgcgccgcctgaccggcggcgagcgcgggctcatcatcctgaagcgcatcggcgtcggcatcgcgttcaccatcgtggccatggcggtggcggcgacagtggagaggcagcgcctccgcagcgcctcgccggcgtccatgtcggtgttctggctggtgccgcagttcttgctgatgggcatcggcgacgggttcgcgctggtcggtctccaagaatacttctacgaccaggtgccggacagcatgcgcagcctcggcatcggcctctacctcagcgtcatcggcgccggcagcttcctgagcagccagctgatcacggcggtggaccgcgtcacctcgcacggtggcgccgccgccggctggttcggcaaggacctgaacagcagcaggctggacctcttctactggcttctcgcctgcatcggcgtcgccaacctcgtcttctacgtggtcatcgccaccaggtactcgtacaagaccgtcatggccggcggcaaggtcgtcgacgacaaggccggcgacatcgagtgcgccgccgccgcagctgctgctgcctactgatcaatatcaagcagtagctgatcgattagctagctagctagaaaatcatggtaagaaagaaaatggcatcatcatgtattatgatctgctttcgtggtacgtgacaacaacaaaaaaattgtaaggattatgtcgttcgtccatgtatatgcttaatctgcttgtgattgccatctgatcgtgtgatctactgctactgctgatgttgccaagtcctgaactgattcagtgtagcagtgattagtaagttacgcgtgtgcttagtgcaagagcgaagtgctgagtagatggattacgtgcacttggagttaagagtgcgagattgagatggcccgaaagcctgcttaattcggacccatgggcggagccactacgattcctgcgtattccgaggaatatacttcagtatacgcacatgtacacatattagttagccaagtactcttcctaactgagatgcgtatagatgaaaggtttagaaaagtgaaaaatcttcttaatctttccattatgattgttgaaacaaagttgcacaatagacatgagattgtttacaagcttctcaaattggttatagtactttcagtagtaacagctagtgttcaaataatcttttatgccatgaataatgtgaagaataaattgataaacaggctgggggatcaatacttaaatcattgcttggtcacatttattgagtgtgagatgtttttgaaagtcaaggactgtgatattataaaccgctttcaagctatgaaggaaccaaaatagaaaattagaggtaccatgtaatatttgtagttttatttcttcgattatcggtattgacatactgtgaaccattgatttttttttactatgaactttttttttgttaaacgggaatacccaacttcgaaatcctggctccgccacttcggaccgagtttgcagccttgcgctgtgaggaaaaagtccaatgtatgtccctctaatgattgagtttcgatcacgtccctcaatcacagaaacaggtacaacgcattcctagtcttccaaaagccagtgcaaatatagtccaaaggcagcactgaggtcgtttttagctgacgtggtgcagtggtgcttatgtagcgtattgactaggttttcgtcttacaagacatctacgtaacacttacattcaagaacaaaaaaattttaggacctatgtggggccaacatgttaggggttcttcttcctccaaaacctcccttctttcctctcttccccatctctctccacctctatcctctcttcctaccttgtcggtagggtggtggcaagtagaggccgagatgatggcccaacacaggtagacaagatggtcacatacaatgagatggctaccatcactatcgagtgtcgcctgccttagttattatgacgtaccactttcattcatttcagcgagtcgcgtgtattagatcgattcaatcggtttctagtgcatatcgagatgacatggcatccatggagatggatattacaatgatacgacaagaagagcaagtcacaccgccctggtgtgatactgtggctttatggatgactacgagcaaatggaggacgatgaaccaccctcaccgtgagtcaacaagcccgggtttttttttccttatgccactgccggagcagaaggtgtccgtagcatatcatgcgtagctttggcgtacgaatgcccgaataaacaacaagtatgggtctcgtcggcccaatgaaaagaggaggaagaagaagaagtccaagcattatgtgtcgccgttgtcgtcttcaccatagtcgaggtcgccttcgccagcctacgagatactccctccgtactcgtaaaggaagtcgtttaggataatgtttaagtcaaaccttaggaatataaatcatgaataactctcaggttgttgagtttgaaaatataaaaattatataaatagatttgtcttgaaaaatactttcataaaagtatacatatatcacttttcaataaatatttttatagaaacaagaagtcaaagttttgtttttagagaccgtgtcgctatccaaaacgacttcctttatgagtatggagggagtatctccaaccctcgaacccaacgacccatactagataccaagaagaggggggagaggtagagatagatggggaagagaggagacagggtgaggttggaggaagaagaaccgctgacatgtcggctctacatgagccccatcgggtttttttattaatgtaagtgtcttgtgggatgaagacctaatcactacacaacgtgagagccacattacctagtccctacacaacgtcagtaaaaaccggcttcagtactatctcaggattacattttcactgattttagaagatacagatgtgttgtagccaattttatggttgagcgacaggataaaatggccgttaattagatagagacgtaaaagtagacttttcctgcgcatcaacggctgaaacagcccaaagagtagttacggtgctttggtgggttggactcgctgagtcctggtattgggccatcaagtcgcaatggggaataagttcagtttagacccctcactgttgtccagtctaaaattgataccgaaatggatacaacgtgtccatcaactcccaaaaccaccccaa

SEQ ID NO: 68232 - DNA, 4914 bp, Oryza sativa
gcagctcggctctgttcttggcctttgttcttctcgccgtcttcctcgcggcgctccccttcgccgaatccagcggcaggcaccaccaccaccaccactcccatctccatggcagaggtacgagcaaaagcagaggaatcgaaagatatttgctttcttggagcgacttcttgcttgggtcaggagctaaattgaaggagaaatatttgggcttcttttcaggggaaggcgagagaggaggagaagcacggtcgctggcggcgaagggggcggcggcggcgtggcgtgctgcgacaactgcggcgggtgcaccaagtcgatcccgccgcagtgccagtgcatggacgcgaggccggcggggtgccacccggcgtgcaagagctgcgtcaagtccagcctcagcgtctccccgccggtctaccagtgcatggaccgcatccccaacctctgccagcgccgctgcaccgccgccgcccgctgacctcccccgccgcccatctgacccgacccaccggccaccgccaccgaccggccttacttaataagagtggtttttgtttgtccctttttttttttggaaaagctgaagaagtgaagaagcagtagtacctactgtactggaggtgattggagggagcagctggtttcaggtttatgtgctggaatcagcctccagttttcatctcctcgctctgctaactacggagtaattgtgtagagattactcgccgagctatatgtacaaacggcctgtgtgatgagacgaaattgtaatggtaaattttttttcaccttcatatgttggatatgagtgaaattgttgctagcgaaatgatgatggatgcgtgcttggttcatattttccgttgctgtttgtctggctctgatgctttctctcctcttctgtattaatctcaattggattacaaggatgcctgtaaaagcttatgacatgctgttggttgattttgtctacttatgtcgataagggttaggagaggacgccaaaccctaaatctaattgcccgatcaagtgcgcactgtaaggagtacgtgaggttctctgctgtttcttttcatcaacaggaaatcagaacgagaaaagcaaatgaacaaaagacaaaactagaagaatcattgatggcttcaaacataggtcggtagattgattttataattaggagaggtgattgtttataggctaaagcttaagatcttgtaatctagaactctaacatgatgagggtaatacagcatgaacctggacgcgatccggcatgctgttccggggtgtatgaacctggacacgattggggacgaacggtcggtgaaatttgggaactgcacatcagaaggcttgtgttgctgtcaaccgaattaatcaggacgattgccatgaacaacatccacgatagtgagcttgcactttgcttagtggaggacggtctgggcctctggggattcgcatttccacaaggatatgcgttgccatgattttcactaggccgcttgtttaggcacgaaaggatgggaaagtgaggaatatgctcggcaagaagccaagaaccaatctccaatagtgcaaatttggggtgactttacatgtttgaattcaacattgcagtcgcgcaagtttgcaataccactatctgaatccgtggtccaaatctgaagagacctgcagtctgcacggtctctagagcaacattgccagtactaaagaagaaagagttccactaaattgctcatgtggtgatgttttggacttagctaaaaatatgtcgacaattttttgggctgatctcagtcggcttctctgtgcgtccgattgctctgcacgagttttcggttgtgcttgccggaccgttcgatttcttctcaaaatcatctcctataaagtaaggactgcatatgcttttgctttttaacttttccaatgtaagatttaaatttacatctcacttacacaccacttacatatgtaattactatgtaattttaagacttacatatgtaattttaaaatttacattgtaaatccattaaatttacatatctaatttagtaacttacaatgtaaatacatgctgactattttttgataaaaaatatggcgctataaatatagctactcccgatgttttttattgattcatcatgtggtggtgtcgtggtgatgttgaacagttgaaggaacagagggagaagaatctgagacaaaggacggcaagagagagacacacgtgctgaaaagaacaggaaaaagagttgtccaggcccaagtgtgcttctctcgtactagagtgaggcccaggaagtagcttacccgtcgcagcctatcaatgtgggcctcttttgtctccaaaccagtagactacggcccatgcaggcccatcttgccgcctaccgaaaagaattttttttatttataattttttttattaaaagttttacaaaaataattttccattttgaaaattgacggaagtagttgcctaccgctctctgggagggcgatttttaagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctccgctagggcgattttgtactgtgcggggggccgcctacaaatgggcggggagggggcatggaattttgcagggggcccccttgccgccctgggggagggcgatttttgcctccccctataaagcccagtccctcctctgttaaatttcattatattcactaaaaatccaaaaaaaacgaaagagagagaggggagggcagcagaaggggagcggcgaagccctgctggttcgctcacttcatcacaggtatgctcccatacatcttttgcttgtactaatatgttatgtttgagtatatatgttgcgttttagttttagttccatatattttagcacatctgtagcacagagcacatatgtgtagatccagagcatagaatataatagtatgaattgagacatagacagtagtgttaattgtaagatgtagttagtttgatctggagaatgtaacgtaattttagaaatttagagaacaatattgtagagaatgtaacttagggcgtagtacagaaatgcaaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgatgcttggagacggtatgtggaaatggcttttgaacggtcatggcccctcgttatatttgtgttggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggactttactttttattactactgttaaatacttgtacgaaactgatggtccttgtccagcaggattcgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttaagattatgtagaacattcttcactacaattttacattttggcagcaaaccaaatatgatcaatgcaattttaccttaccaaatatttggtagtgccaaaacttgcttatattttggcacaaacaaaatatttgtacggtaacaatccaaatatgccctaaaaataataaaattgtattttaccagtcttggagattttaatcttgtataattttcaatataaaaagatttg

SEQ ID NO: 68233 - DNA, 1844 bp, Oryza sativa
taaaatcgccctagcggagggcggcaagggggccgcctgcaaatttcgttgacggccgtcgcccgagagcgaacgcggctgccacgtcattttcgcctcgccctcccagagggcggtaggcgactactcccgtcaattttcaaaatggaaaattatttttgtaaaacttttaataaaaaaaattataaataaaaaaaattcctaccgaaaacgggtggaagcgtcggggattagtaccacctcgcggagtcgaggaggtgcgggtgggagagatggctataagtagagagccccgtgcactattgctccatacttacctggacggggtcaacgggcgatcaagaaggctcgtggcctaggccaatggcccacattgcacttggtgggcgcgttagcttaccatctccccaagtgggagagtggacgtcataatttgtggtagagggggtacgcgtccgcgcggcccctgccaactctcttagattaaatttcggtccttgctattgttggttaagtttaagttctttattgcattcgtatgctttcgcgcggcctctaccaattctcttaaattaaattttggttcttgctactgttggttttggttcttgattgcataggctccttgtatcctgaattttcggttttggtccgttgggtttacgagccatgtcaatctcttaaattaaaattttggatttgggtttgcgctggtaagttttgcatctatcattaaacattgttatttttcgaagagaaggtccaaatcaagcagagttcattacaggaaacaaaacaaaacgaacacagcaaccacttcaggaaaactggggaataccagctaaactaggacagcactagaacacacacaaaaaccaacttctcaaacaaccacttaaactacttctggggataccagctaactaggacagcactagaataccaggcaccagctaacgagggcggaaatactcttcatcctttggagaacgtgattggccaggcttcagttaaaggcttggtggtgtttaccttagctgaagcactgctccccgtccgacaaaccagcgataatcataaagggaagacaattggcatgaaaggaaggctgaaggaacaaggtgctcctgggaacttgaatcatcagcgtcgttgctcaatgtcgttggagctttcaacccagaaactggtagaggagcaatcggactcgtggttagaaattcagatggacaagttctcctgtcatcttggaaattcctaaggcgttgtgtagaggcagaagaagcagagctcctggcttgcacggacaaatcatctacttcctccatttcatattataaaactttctagcattgtccacatttatatagatgttaatgaatttagacatatatgtgtaagatgatgccctctaaaagatggcaaacgagaattcaagtacgatgctgccctgatgtttcattgacaaaagaataggatactagtgtctactcctttctgaatcacgacacagcgagtcatgaatttaatacatcagatacccgtaaattttcatggaaaatgctatgcataacaatcaagtttagcctgcatatgttttcttggaaatatatgccagatatagttatctgaagaaaataaaaagtaacaaataaatggcttctctaatgtaagcccaacacaatcaaacccgagaccattaccggtccaacccaacagattacacctgtctaggattgcaacggcctgtaatacaaggtccattacaaaccgccttattttggcagcccaagctagcacaaaacctctcagaagtcagaacacgagatggaaaccgaaaagaa

SEQ ID NO: 68234 - DNA, 3049 bp, Oryza sativa
ttctcgtggtcgtccatcatccttcccgtaagatagctcccctctccatctctttggtcagtgacatttggggataaaatcggacagtgataggtgataagaggaatgcatttctagtttggttctagcttcccaatgttgagggatagcattggcacctaatttcaattcaagggagagagaatgctttttaactgttcagtagatattgcttgtttcatcgtgttgatgagaacaatcatattaaattagggcagactgtacaatgcattgtaagtaagatgcaatataattctgcactgtcttctcttctctgctttaatgctagataagaacatattataattcaggagatgataggtttgcatagtattttgattacatactgaagacaaatgttatagttggatgtaaaccattggtggttattatattaatacggcttggaatatggataaaaaaacaaaagcataaaggggaaattggaaaatatatcaagctttaactacttgtgggtcaatgtttggaacctaggttcttgttccctgcattgggaggactcctttttggttatgacattggcgcaacctctggagcatgcatatctctgcaagttagtccctattttggttggctatgcaatctgttatagttgtcatgtattgattcactctaatggtgtttattcctccagtctgctgaactcagtggaaccacttggttcagcctgtcatctatacagctagggctcgtggtaattttttagatattttcatgcttaccaaactttttgttttcccaatcaagaacactactgtctttaatgtgattttttgtcatccaatttaggcaagcggttcactctatggtgctcttggtggttcgcttcttgcatatcgcgttgccgattttctaggtgattcgaaaaaaaatgtttttcgttttttttccttactgtataatctttagcaagaaaattgactgctagtctactactaccatccttggttcaggaagaagaatagaactggtcacagctgcagctttatatatttctggtgctctggtcactggatttgcacctgattttgtacttctgatcataggccgtctcctctatggtatcggtattggtttggtgagtaactctgaggcaaccttttttctccccaaaatgcaatgccactgttattgaacaagtaaaagtataaattcatgtagatgaatgtcagaggaccaatagttatatatctttttgagttgggtagcacatgaaaactttaagagaggaaactgaactgcataatctgtatacttggactgcaaatgactcattacttccagatttagtaacagtgtagcttgatgaccacattttggtggaattaattataaaataagtggaaaggaaccatgaacgcgtttgatccttccagatatggcaatattgtgaatgcttgtagttgaaatccatcatttgggacaaggtctttccatatgaactttggacattgttgttactcagtgttgcggcagatatctatacctaattaaaaaaatacataaagcttccggtaaaaatttcgtccgtcaaaacccatgtccgagagactcttttatccccgcacaattagcgaagtcctgtttctgttaaccaaattaacaaatttaagttagaagcccaaacacggtcacgccaaaaagaaggcctgacctgggccttgaagaaggcccgacctggtttgtggcgttggggaaaaagatgaggaaaacagcctaagccagctggtaaaaccatggaaaaaatttgtatataccaaaaataatgaacaccacgtataagtggaagagatatagaaaataataccatctaacataaattattacaataatgggataattttactaatcagacccaataaatttaaccaaacattatcaacacagacatcaaataatctttacacgcatatttctcggtggtctcagctcgggttgggggaggaagaattactaataaaagatacacaaggattccgcatatttcttttcgtacgctgtccataccaatccactgcacacgaatgatggccagccggcgagcttccgagcttcccctgacctttttatcccaagttttgtgaatcactccgattttgagggaaacggaaagaaaatatcgtgtgggtaaaaaaacctcaactaattttgggagatcgagaaagatttggccggatttgatatgatgatcagcttcggtattgtatagatatgggactgtctcccggaggttgaagatgctactaaagcgcgtgggtttggcttggcaacgagagaagatatatgactatgctatctgagcctgtggctccatttgtgggctgggtcgaagagagccgagccgagcagagatatatagaggcagcagactgagctggggcttataaggaaggaatgattttagtgaaccttttgcattataatgtatagtgatttcaatattttaatttattgttcaacttctaatagatgttgtataaaaaaacgcttttacccgttgcaacgcacgggcattttttctagttaatactacaaacagtatatttgtttactgccaactaaaaaaatccgcaaatatctaaactgccgatgctttgttagaaaggtgttaataataactgaagaggaacataaatgcaaatgaacatattcatatcaaactaaaggtttggagataatgaatcattgttgtgtccatgtatattacatcatggggttatgtaacatcactgaatcaccatgctttgtgccaggcgatgcacggtgcacctctttatattgcagagacttctccttcgcgaatacgtgggacattgatatctttaaaggagttgtttattgtattaggaatactggtatatctctcttccaactgctacacacttttaagtatacccatctatcccctgctgactactccctctgtccccctcccccccccccccccccaaaaaaaaaaaaaaaactactgggtttgaatctggacata

SEQ ID NO: 68235 - DNA, 3359 bp, Oryza sativa
tttgaaattatgtgccctaagttcagtgaaagttattatgtccaagttgaggtagaaaaagaagaaagataatgacctgtctattcatttcatcctgctttggtcatttcttgattttttaatagttgactaatgttacttctttgttatatggaactaaagcactgatattaattaaactattatttcagataacaggccagccaagtgttctatactatgcaacttccattcttcaggtacctctgagtttcttttcatacaaggacagacagaataagacttagttctccatatggctgtgtgccctgatacatacaattaaatccattctatcttcaacagactgctgggtttgcagctgcatctgatgctgccaaagtatcaattttgattgggttgttcaaggtaattctatgaagctaaattatttttataatctagtatatatatagggagaattagatatctattttgttatccagatggtaggtggaaaggtatagagcttacacttttttttgaacctctgtgtaatatttctattatttgcagttgttgatgacaggtgttgcagtatttaaagttgacgatcttggaaggcgtccactacttataggaggcattggtggaatagtgagtaattcttacagacttgtttaagttctatggatgcatggaaagtgtcattttcatcaccttggcacctccccagttatttgtactcattgatagtcttgcttgatgtggatactaagaaactggatgcttaaccaagttttgatcaaacatgttctgaataaattatgcttatgctttctattccctggaaatgcaggctgtttcactgttcttattagcagcttactacaagattctgaacagcttcccttttgtcgctgttggtgctttacttctgtatgtcggttcttaccaggtcggtgcctttactttctgtagaaacggtctatgactagtgcaagaaatttatgttgtccttgtgtttgcaggtatcgtttggtccaataagttggctaatggtttctgagatcttcccactccgaacaagaagacgtgggatcagccttgcagtacttacaaatttcggctcaaatgcactggtgacatttgccttttcacccttgcaggtacgttcacccagattgttgtcacctcacatatatatttatctcatgatgtttccccctccaaagccagcgtttttttagcccttcccatttaaactaaaaaataagtttaaaaaaatcagcctcttcttctatctagaatcaacactacgtattttaccagtttctcccccaaaaaatagatgaacaaactaaactcttttgccggcaatgcacgccttgtttggtgcaggaattccttggaccagccaatattttccttctatttggagccatatcgttgctctcccttgtgtttgtcatcctaaaagttccagagactaaaggacttacattggaggagatcgaatccaagctcctgaagtaagctcactggtactcaagttgtatgtgtgtgtgtgttttttttgagggcaagttgctatgtgttcattagatgaggttgatacgtgtcggtgtaaatttgttcagtcgatttatgtgattaatatagtcgtacatgtagtattttgtacatgtaaattcttgtttggactaaaaatattctagagaaatccaaaaaagctgttcttgaagtgctattttttttggtcaacactggactggtgctatttttttttttgccagtgtaacacagttaattaaattattactagcgagacttaatgtggtactccgtagcagaagagtacgcgtatgaagtatgaactaactcaacatcgctgtaaatggggacatgaagttggaacctgtcgctcaggaaacgttaatgtctatcgctataaacccattaagcatttgcctctagactaacttaacattggtggaccaagcttatatcacgatcaacgaatttaataatcaaacaaaaatgctgaaaatataacatcttttgcccatattagaattgaactcagctgtagaatttttgacgtttgttacgtgacaagacgatttgcctgacgtgcttggtatggcgccctggttgtaatattattgtttatgaagttctttccttcggtcctttagctcaatacggtgtttcttttttatttctcttccttgatcatgaagcctaactcaatcgtctaaccaatcagtgattattcccaaaacaagagttgagctttcatggttcactgatgctttgccatcatgatggtaacatcatggcaagcaagaatccaatcattctagagggcagtagacgagctgcaacatcaaacgactgaccaaatgcagcaagccgaacaaaattgccctgctcacacaatggtagaagaaccactcattcagaatccaatcaaagcttggcctgttggaacgatggcatgaaaaatgcaaccctccgatgcgaacgtggccgttacttaggctgaagggcacacgtgtaaaatgttttttctcccacagtgaaatttgttcatagtgtagcttttttttttaatttaagcaactttattagagaaagacagagttaaggagctaaaccctagtacatcgcagaaggatataacacaaacaaagagaccatctctaataaggtagaggctaaccaatctaagaaagcaaacttccagatgaaactaaatagcagtagaggaccagatcgacggagctcagcagccgctacgaccggatccttaggcctccgtagacatgcaccctgcttgatagactggattaaacaaatcttataacttgtcattctctgatttttaagggatttgaggagcatcacatcttgtaggttcacatgtcagcgatccacgtcaattttttctgacgtggcaagctaggcctgacgagtgcttgcacacttgcaagactcgagtcatgccgtcgtcttcttctctgcaggacagccaaatctgaaactctgagaccagcaacgaggttgtttagactgaccgatcgatcgacgggagctttgggttccctgcaggaaggacaggaccggtgcaaccaccgggataaattccgtcttctgcaactctgccgttctcaactccgcacgcgttccttgaccagccatggctgcttcttcgctgtcgccgcaatgggcctcacgtgtacctgtccatcatcgatctatcagttcactacccccatttccttcatgatttcatctctccccgtgaataatccgtgatccgatcagcttccaacgccccggatttgatcctgtgtgcaggagatatactctttaaa

SEQ ID NO: 68236 - DNA, 9176 bp, Oryza sativa
tactaaccgggaataaaaatcaaaacacactatataatccatagtaccgatcctcttttcccgtccacacaacaaactcctccctctatctctttttttcctctctaacttcttatctctttccttatctctaactcccctcctctccttccttttttccttcaccacagtgcaggcggtcggcgcggaggcggcgacgcgggggacggcgcggaggcggcctgcgcggcggccggtgcggcagcgcagggggccgcgcggcggcggcggtgggcggccggcgcggcggcgcaggaggccgcgcggcggtgccgggggccgcgcggaggcggcggctgcagtgggcggccgctcggcggcgaccgacgcggcgctggccggccggcgcggatgggaggaggggaggcggcagtggccgccgccggattttttttcttttttttttgagatgtgaatctgtgatgtatttttgtgtgagatgtgaatctgtgatgaatttttagaaccctgtgatgtaatttttttaagagtttgtgatgtatttggagatgatttgtttgaggatttggagatgttctgtaatatgtgatgatttggatatgagaggggatggtgtgaaatcaatattcaatattaaaagcagaaaaaaaaagaaaaaatatctttagtcccggttggtgttatcaaccggaactaaagattctcccatctttagtcccggttggtaacatcaaccgggactaaagattgatttttagtcccggttatttgaaccgggactaaagatagtcccggattcgtagtcccggttggaaaaccgggactaaaaagcatttctccactagtgtatggatgcattcaagaacaagaggaggtgaaacgtgaaatgcattatatccccatcagctcctggctcatttggatatctaccactaaccggcaagaattgccatgaaaatcaccgggactccaggagactgcagcctcgaggttccgacagttatagcttctgtaagaatctttagagaagtcagattaaaaagttctaaaaaaagtcagataaaaaaataatcttaactgaagtcaaacagtttagaattttatctaagaatatatagttatagaattaaaaaagtgggagccctattggttgccctaataaaccaaagtaaaagctaaaatttttattttaaaaaataattttgatgttgattttaatatatgttcaacgtagttttctatattaatttttgagtgaagtacatgggcggtccctaaacttgtgccaagtgtgtcatctagatctctgaactcctaaaatgcatttttagatccctgaacttgctatgtgtgttatataggtccaaacaggttctaacccactcgatgtgctgacgtggcaatgccacggtgacgcctacgtgtcagtggaatccacatgtcaagcatatataaaaaataaaattaaaaaccatattttctcctattaggtagacagaaaaaaagataaaaattttaaggtagagagaggagaaaatatatttttctaattatattttttttctatgtgactgatacgtgggtccaactaacacgtatgaactatcgtggcatgccacatcagcgcatggaaggggttggagctcgtttggacttgtatgacaccccaaaacaagttcaaggatccgaaaatgcattttgagagtttagggacctagatgacacacccacacaagtttagagaccgctcgtgcacttcactcttgatttttaaatcactaagaacatatatataaaagttttacctataaattaatttttatactcttttactagtaataagttaatgtgggcaaaggacatgaaatagaatagtccgtagatattgacgggtgacacgggcttatttattacagcgttcttgctccatctctgtgtctacgtttgggtacgtgtagccactaccatggacgatcgatatatcacttggacagtgaggcatggcactgtttgcacacgctgcgcacgtgccagcgtactcgactgccggtggtcggcgtctacgaaacgacgcatacggacacccaagtggtcctcgccgtagacgaaacccagcaaacgtttttttttcctttcctccgtacctgagttaatttttctcttctttttactttttaatttttataactagtactagtttattgcccactgtttgcttgcagctctgtactctatccgtcctgaaatgaacctggacattcattcgtccagattcaaaccctagaaattatctgtttttttcgatggagggggtaggtgacaactagctaggataggttgaggataggcctggcttagagcaaatttaatagtatagccaactactagctctaattcatctatagccaatctaatagctcatatatacaatagttacatattacactattaatacctggtcccacctgtcatacacacaatgcgtcttggagtccgtgctacagctggctacaaatctgtagctcgctgctcttctctctcattatttatctccttaaaatatgtttgtagctggcttatagcctgctattgtacctgctcttagggcgtttacaatgcatctttggaatttttttagtttctaatttttttttccaaaaatgtcacatgtaaaatctttgacacatgcatggcgtattaaatatagataaaaataaaaactaattgcacaatttgcatgaaaatcgcgagacgaatcttttgagcataattagtccatgattagccataaaatgctacaggaactcacatgtgctaatggcggcttaattagacacaaaagattcgtctcgcgattttcaagcgagttatgaaattaattttttcattcgagtccgaaaaccctttccgatatccggtcaaatatccgatgtgacacccaaaaaatttctttttgtgaaagacccttatgctctctcattttttgcaagcacatttttaaattgataaatgatgttctcttctaaagataagataattactttataaaatcatattaatatatttatttagttttttaagctaatatttaattaatcatacactaatctgttgctttgtttcacatggtaggaagaaggttctcaacagtcaaccccttttaaaaaaacacacccaagtactccagcacatacacttcacattctaaaaaatatatctaatacgatattgaaatttatagtactcctattaagatgtattatactcgctctatctcataagggcttttgcctggatgtgaacaatgaatctggacggtttttctgtccaactgtctagattcattgtattatctattcagattcattgtactagaatgtgtcacattcaatccaaaatcattatatttagagatagaggaagtactacctctatcccaaaatatactccctccgtttcaggttataagtcgtttgactttggttaaagttgaactattttaagttcgaccaaatttatacacaaatatagtaatatttacattactaaattagttttattaaattgataattaaatatatttttataataaaattatcttgggtcgaaaatattactattttttctataaatttggtcaaactgaagcagtttgactttgaccaaagtcaaaacgacttataacctgaaacgaagagagtagctatttctagcacaacatcttatcccaaaatgaaactatttcttcatctacctcctctcaaccaatcacaaccattctctttcacctaatttatcttttcaatcaatcacacaatttcttcaatcattcttacttacttccttaatacccgtgccaaccttaaaattatttatattttggatggaggaaatattctcttcgtcccattttaagtgcaactataagtttttgtgcccaactttaatcaactatcttatttaaaaattttctataattagtatttttattgttgtgagatgataaaatatggacagtactttactactttatatgtgacttatgtcttttaaatttttcaaaaaaatttcaaataaaactgacggtcaaaattgtacacgaaaaatcatggctgcaattaaaataagggagtatcttatattagatttgtctatttgaaaacaaaaaagatcacgaatagtatgcgaagccccgatcgatctcaattggctgtccttgttctgtctgcttctcatttctgaagggaaggaaaagaaaaaacaagtggaaaaggggcccagagtgtgcacgcactccctgcaggctctagcacaagcttagctagcaacgtgaaatctttgtaggcagttgaagcttatatgtgctgagctcctaccctccaatgccgtccatctccatgtccctctcgccgacgtcgccgtgcacctcgcatcgtcgccgtcaccgtcgccgacgaccagaccagcaacagtgccagcgacggcggctgctgcccaactccacactaaactgttcaactccttcagctactacttcacttgggttaatttgtacattgctctctgccatggcggcgccggcagccgttcttgccgtgctccggtggcggcagcggcggtggctggttgagctggtcgctctcctgcttcttcttgctcgaggtggcgctgccgcggttgaccaattcttgtttcccggcttctccggcgacggcgtggccaccagcggcgcggccgccgtcacctccaccggtctactgcagctcaccaacgagacgaaggaggtgttcggccatggcttctaccccaagccggtcagcttgagaaacgcctccaccggcgcggcggcctccttctccaccaccttcgtgttcgccatcgtgcccaagtatcccgacgcgcatggccacggcctcgccttcgcgctggcgccgtcggtggccgtccccggcgccgtcgccggcaagtacctggggctcttcaacacgtccgacagcacgggccagatcaagaacaagatcgtcgccgtcgagctcgacacggcgcgggacgacgagttcgccgacatcgacgacaaccacgtcggcatcgacgacaacagcctgaaatccgtgaactccagcccggcggggtaccacgacgccgccaccggcggcaagctcgccagcgtcaacctgatcggcggcgagcccctgcaggtgtggatcgagtacgacggcgacagcgcgtggctcgaggtgacggtgtcgccggccggcatgctcaggccggccgccccgctggtgtcttgcaccgtcaacctgtcgtccgccgtggccggcgacacgtacgtcgggttctcggcggcgaacggcgccgccgcgagctgcactacgtcctcggctggagcttccgcctcggcggcggcggccgcgcgcaggacctcgacctcgccaagctcccgcggctcccgtcgccgagcaaacccaagaagacgttgccgccgctgatcatcttgacaattctcctcctctccgtcgtgatcctgctcctggcggcggcggccgtggcggcgctcgtggtgcgaagccggcggtacgccgaggaagaggaggaatgggagatcgagtacgggccacacaggatcagctacaaggacctccacggcgcgaccaaggggttccgcgacgtcatcggcgccggcggcttcggcagcgtgtaccacggcgtgctgccgaggtccggcgtggaggtcgccgtgaagaaggtgtcgcacgactcgcggcaggggctgcgggagttcgtgtcggagatcgcagcatgagccggctgcgccaccgcaacctggtgcagctgctcggctactgccggcgccgcggcgagctggtgctcgtctacgactacatggcgaacggcagcctcgacaagcacctgttcgccggcggcgagcggccggcgctgagctgggagaagcgcggcaagatcgtccgggacgtcgccgccgggctgctgtacctgcacgaggggtgggagcaggtggtggtgcaccgtgacatcaaggccagcaacgtgctcctcgacgccgacatgaacggcaagctcagcgacttcggcctcgcccggctctacgaccacggcgctaacccgcagacgacgcgcatcgtcggcacgctcggctacctcgcgccggagctgagcaagaccggcaaggccaccacgagcaccgacgtcttcgccttcggcgccttcttgctcgaggtggcgtgcggccggaggcccatggagttcaccgtcgacgacgactcgccggggctcgtcgagctcgtcctcgagcactggaaggccggcgagatcacggcggcgagggaccccaggatcggcgactgtgacgaggacgatctcgaggtcgtcctcaagctcgggcttctctgctcgcaccatgacccgcgccgccggccgagcatgaggcaggtggtgcagatcttggaaggcgccgcgccggcgccggagacgttgccggaggacctagaatgcggcgtggggcagttctacgacgagtcattcgacgagttcgtcaccggcttcccgtccacgtcggagatcaccacgtcgacgacgcagtccaccgacgagcagcagcggctggttggctgtgttcagttgagcactgccgattttctgaagacaacttaaaatgtaaaaatgtcagtgagcaaatacttgcagcattaggtgattgtttgggctttggatcttctggagttagtaacatagggatactgtcaatcattttcagatatgatcatatagaggttttgatcaaagattagtacagcattcagcttagaagttaccttgttgcagtttcagaagaatgtacacctgcaagaaggcaagaaccgtgtaagaaattttgcaagggaagaaaaaaaaatatggatcccctttttttttttgtagctgcatctttcttggggcagtttgctgttgagccagatcagaatattagccaatagactgatcactgatgtcgattctgtcatgcagaaaacatgcgatatataatatgacatattggcaccttgctcaaaaggaaccaaagatattgcagcctgcttctcatcatgggaaaaagacaatgaaaacctaaaaaaatgctgtcctaatgttctgcttttacaacaaaagatgaacatgacaaatattagcaaggtatcaaacaaaaagatgacaacaaatggagacagttcaggccatggttctagggattcttctgattcatacgagaactgaacgggctttcttgtgttccaaacagaggacattagattggttgccgaggaaaaaagaactacttgcaaaatgttgacaactgacaagcaatgccagattgtgtccatggctccatgcaacattagtttacatcctatccaagctaaaactagcatccctactacccaatcgtaatgactccacctataagcacaggtgacggctctcttcctcagagttattcatcatcctcctgagttccccgagaagcaccttggatcattttgtcatcaactcctgcgattaagttcagagcttttaatatcaaatttcaacattaacataagataaactggaagcaaggtaatgtataaggatttaccttcaatgaaggactcgaattcatcatcatcacttggacccattgatgtgatattgttgactggttggttaatctccgtccagtttgactgctctgcctggccagatataagtgcagatctatccacaacccaatcgtcgactatgtcaatgttgtcgactgagacaggatcaaatgctttggtcttgtgttgttgcctatgacagttattaatcagatcgctcaccatcatcaatcatttactagctaatgaaactcggtatatttaacataaggatttgattacctgtgttgtagccttagattgtactgaacaaatgtgagatgatgcattcgctggcgttcaaaaagattcattctttggtcatgaatttgttcgaaagaaatgtgtctccggtcacatcctttagcactgcaggtttgactgagaatgcgaactgctaaacgcgtcaaatttgggcaagctcctccatacgtataccaccattcagctgcaaaatagaatctataaggctcaccaaacaatttccgtaatcatatctaagtgtctaacaataacctatatctgggggaaattaattatgtctatcaaacgaaatagtaacacagctctagttttgtgaaaggtcggtgctgaaaatgcatttcatgtttttaggacaacataatttgtcaattgagtaagctagttcacaacggaaattgtatagtactaaccaggaggtaaagtgtgcctggctcggatagccatttgcctacgaaaatccccagctgcctcactccggtatacattgagtccttttggattttatcttggattttcacatcagaaaccaacctttctacgcagtctagcatacctgagaatatctcacttgatgttccacctcgaacaccatcgaaaaataatgggttcaggaaaaaaccagctaaatgaagtggtcgtggtgcatccttgttccatctccagtcaataatatcccagtaagccatgtagtcgttcttcctcaccagctctttcttgattgctgctttggcctgatacaatccagcgtaaacataccccatagatggcctcttattgctaccgactaacttaagaagatgcacaagtggttcggtgatgcgaaccactgcagcacacgaagaccaaaactgcaaattgccaataagattggtcacttcaaccccaccaggtttctttggcagcaagtagtgaatccattcatctgagctaatcatggcttccaaagaatcctttagattgtacatgttcttcagtgtgacaaagttcatagcagcacgagtttctgcaggaactagcagatctttcccatgaagatgccttttcatcaagttaaatgcaaatgcgctgttatagataaatcccgtaatgacctttgcattacatatgatctcattgattgcccccaccttactgaaatcttcaagcatcccatcgatgcactggaaagagcattgagaccagaacaatgtaggaaaagtttcgcatagcctctttcctgccaccgcatgaatctca

SEQ ID NO: 68237 - DNA, 14809 bp, Oryza sativa
  unsure (1)..(14809): unsure at all n locations
tctcctgcatcgcaatacccatcaccacacccacactgttactaccatttccccgccattgccgcaaaaattcctaccatatgagcccaaccaactgcgattcacacggattttacaccaacaaacttccattgaaacggcacagcccactccgaatcaaaacctcaaaccatttccagagacagagccacataatctcgtatcagaaggtgattttcctctcgagcaataccccccaaaacccacaaacccaaaggaagatggggacacgacaccctctcgcgtcaaatcaaatccctagtaatccccgattagccgacgacgccatcgcagaaaataaaccgaccaaaaccaagcaaaccagggcgaaccagatatgaaggggagagagagtgagattggggagaggcgagactcacccggcttttttttcgtgaaggcgaagcggccgccaccaaatcggaggggaccggagacggagccggaggcgaagcggatgaggaggagaaaaaaccaggaggcgacgcgagagaaaccagaggagagagagagagtgtgtgtggtggttagcctgtgagtgggagtggagccggtccggtcggtccggtggcccgttatacgtggatcccgggggttggggaaccggcccagccggttttggcgcgggtttggtccgggttagggtgaggctctgggctcagacactggaatcgggagttgtgggccgtgaacactttctgggcccgaacgggaatgcaacttacgtgcagcccatatagcagcataattacacaagcactgcatattaattcattcatgtaagattcatcatcgaaatgtcaaaattaaacccattttggccgcacgaaatgacaacatacactgtgtaacaggatatcatcttttactcccaaaaatttcacaagtgcagaacacacccaagacaccacaaacatcttataaagaggctggatgccctgaacttgtgagctgtatcacctaaactaacaatatctgagctaccatcaccttctgaagacaagaatgggtacatcaaatacctgcacacagacaaccaagcaggttgcgatggctataggtatcatgcatccaagaacatttgagtataagaaataacttcgtaagaacaccaagtcagttgcagatggctatagacctatagttgcagcagtatgatatgctatgctatcggtatcaaatggctcagctgagcccaagttccttcttcagcttctccaaagcagcctctatctcagatacgctatcatcaaagctacttgtcgatgtattaacatcttgcttgtttttgcctccagactgtgtgtacggatcatttgcattgtcttccgcatcacttgagtcatcgatcttgagttcgttctccagaaactcaacaaattcttcaccaatggcctgattgaccagaatgtaatagaattaatgggagattaccaccaatgaccataggcatgattagaagttgcagtatttatgtactattgattagtgttcactcccaacagtagatgtttacaataatacagtggaaaagacaggtaaagaacttactgccaactcttcccacaagcttttaggtttctgttctgaattcagaccggcttcccagttctgaaattctgcttgaagatctctaaggaaatcccctgcagatccatgaccacagtataatgtcaaataatggaacatttttagttcaactatctagtaactacacaccctagagttccatttatctactgaagtttcaaaatacaaggattatgatgtgatctaatctaccagttgtttcttagcagaaaggatctctcttgaaacttcattttactcatcactagcacgaaattcctaaccacagaaaccataatatagctcactaatgcagaagagaaggtattccagtaccaaagccatagaatggctcttcttcatcagctgaagtagtgctgctcttcccgtatgtcctggacgaataatatgtgttgctgctagtgctcgcgtacttggaccggctctctgaattcatgagcgtgttgtacgcatgcttgatccgcagaaatttctcttgcgcgttgggctacgttgacacaacatcaaacacaaataatcagtgaaacgcaaggaggtgacaaggtttgggggcggctgtggcacgcacctccttgttgacgtccgggtggaacttgagagcaagccgccggtacgcgcgcttgatctcttcgggcggcgccgacggaggcacgccgagcacgtcgtacggggactccccccggccgcctctgcccgcgccggcgcgggccctcacgctcgcacgccgccggcggcgaggcggcgcgggcgcaggagaggagaggcgcgtggaggggccatcgcgggaggaagctacggcgcggagaacgagaggcgacggcggagcagcgaagcggcggcgtgaggagcggagaggaagagggggatgcggagtggcggcctgaagctgcagcgccatggcgcaacgcaaccggagtccggaggtggatggggttgaaagaaaaaattgcttttgaatggctcgcagcgagccttcaactggagcagacagcatcaccaccgttcagatcacgcggccctggtggagcagtgaggatcggacggccatccttagctcacaataaataggcaaagccatgtgagaactgattaatccccagtcagccagtctacagattaccgacacatattatacaaagattgaattcacagagactcaaaatcaaatcgtggaagagataagtatctttcatcttcgtattttaatagcatcacagattacagatatccaaaaacctcaatacatccaagagctcaggacaggattaaaatgcagagaatttcagcagattgcaaatatgtaggatctttttaaggttaagtctagagaattgcataagcgaaaaactaagcaatcccaacaagtctaggaagacggtccagggcctagcagcaatggtggatccttcttggcgctctcagactctgaatcttctttgggaggtggccttgatgctgcccaagcgcgaagcggcggctcaaacatgctgccaacgacatccggtggtggctgttgaggtgcatcctctccaggaagcacaacaagacccttctccctgagagacgacggctcgttgtaacactccttccagagggagtccacaagctgtcgctcctcacgatgtgcggagagatcgtcggcatccattgtgctgatgccttcgattcggctcttaaggacatctttcagcttgtcttggtcaggtagcacgtttccagcaccggatgtattgtcccgcgccagctcgagaagaccacctaaggcagcctcccggactccagaatcatcactcgatgccaggtgcatcatcagctttggaagaccaagctctgtagcaacactcctatcagccttgttgtcgtgcagtaggtactgtaggagatggagagctttcctggaattaataaagcagaaatgttatgaaaattgcaggtttgcattgcattgtttaactgcagcaaaaaataagtcatgtgaatgagatcaaaaaaaaaatcagtactacaggtaggcgcagccaaatagttacttcacttattggaaaaatgttgtgggctaagtttagaagtaaatatgtgctaggctatgctatcatatatggctaagctatcaaggccacgcatagtcctattgttcaacaagtataaataccatgaagaaagaacatagtgcaatgttagtgtcctactagctcccctgattatcatacaacatacctctgaagtctagcatcatcagaaccaagagcgtctctcagtgcagagtagccatttcccaggcggaatgcagcaactcctggctggttatgacgaattagagctgcaagacagtagtagaaacctctagttagcatatgtaattgaagcaattatgttctaggtcatggcaaagcaccaggtttattacagaagcaaatgacttacatgatattgctccaagagcttttgtgcgtgaattcgtgcttgcatcggaactgaagtttgtcaacagtggctccaggccattagattccatgacaagttgctggctcttggggttattttgcacaatcgtgctcacaacctctgcagcctttgctctgatgccagcatgtgaatttttcaagtaaccaagtaggggatctaatccaccaatagagtgcagatctggtggggtaatgcaatcatgttaaaattctttgcagtcaagagaataacatctacaaatgcagaagtacagtaaccatgattcttaccatttgccatgtcaatggattcaacatgctcctgtaactcatccaacatatctgaaaacaaagtaataattcattgatcagtgaaactgagaaaatctatcaatcccattctagggagggttttatatgttaatgttgaactgttaaggataatatgaaatgaaaagtgaaaactgtaggaaataggcaaaacaaaaacggaattcataattgcattgtccctaaaggaaccttacgtgtgagaatcagccactacaaatttacgttactagttatgtgtacgccagcccccacaataagcatatctaatgcacaataatagaaatatgattacttgcagatgctaccaaaaaaaatacttaacaaaaattactagccatgattttgtaaactttcttcagctagtgtttccgcactcctacaatcccaaaaattctacaagttgtataaatatgaaggaaatgctacaaggtggccaataaataatgaagagtgctgagcgtatatgaaattcattgttcacgtctacaacaagcaggtaattttagaaaatgaaaacactcaaaatgataccttcgatgttctctggagtcacaccttgagactgtagtacatcatctggagttttcatcacttgggtgatctccttcatcctcttaacaacatccattgtattagcttgcattgcctccataaaccatttcttgtcctcctcactgcaacccaaacaaatcatgataacagtgaacaatatgaacatgttttggcatgccacagatcgattgcacattccaaccactgcacataggtatcatttgcgcaaatttctgacatgacagctaacatgtcagtgttaataaaggagtaatttagcaggaaatatgagatgattcatcataatttaacgagcgaatttgcacatgaattagcagtctacaagtgatattgtgctagcgcatgtatacctgcagactacagtagaacaaacaccctatctcaaacctaaactaaactaaacacgcctaattccagagtacctagaagcacatcgatctagcgccccccgccagaacaaccccacagcttaacgcagccccttactcgaactgaaaggagatctcgctcgagcgggagcagcatacctgagcgagcgcggcttggcggtgccgtcgccatgggcgaggctccacttgagcaggccgttccagtcgggccctcctccgtccttggccatctcctcctctaccaactccggcgagggttcacggcgagacagttggttcaggcgtcggtgcgcggcggcgggaaaagacgaagcagcacaagcctcctcctcttcctcgccctcgtcctcccccttttatgggagggagaggtctcctcctctcgtcagtcgaggcgtcgtcgagagagacgggggacgcggcggcggaggagtccggagtgttcctgaacctacgcttcgcctcctcaggtggaaaaggcgtcttgggccgggccgtcttttggttccccacgtcgtcattgggccacctagtcagatcctttctttggtgggcccggattacgaaaaggaaataagttcatcaaaggtcccttagcttatcaacgaatcatatttttgtccttcaaccgaaaactagatacaacaagtcccttaattgtcaaaaccggtggtcccatggcggtttgaacaacgatttaagctgacgtgacgtctacatggcaaatttgattcggtcttcatttaatgtggcggtcacgtgacactggaagcaaaaatatgataaataattttattttacaattgtggggcccacatgtcggtaagacaaatgataaaaattagtgatccccgttctcctctctatctccagcgacacctcattccccttctcccccttttcactggccgcttcgtcctcgactacttctttctagctgtggcaccggctgctacgagaaggcggcggtgtggaggcttcaacgaccagtcggaagccatgatggcctcgaggtcggtggccatggtgcgctcggccctgaggatggggtcggcagcagggatgaaaattagttggaaaaagtacaccgaaggtcccttaacttgtcatcgagttacaaaatcgtccctcgaccacaaaaccagataccggacgttccctcaactaacaaaaccgttcactttagatcctcctatgattttgacccgttcacttcagatcctcctgtgattttgaccctggttttgtcctacatgacggcttagtcagcgttgaacccaggtgggccccatatgtcagcattaccacatcagccttctctctcttttcttctcttctctcccatcctcatctctctctctctccgttctctgcggcaatgcgaggcgggagaggaggaggccgtcggcgaccggcgacctgcagccggagaccggcgacgcagcgacgggcgacgcggcggcgggggaaggggcggcgcgcgggcggccgggagaggcgcggcgcgcgggtggcaggggaaggagcggcacgcgggctcccccgccggccaccacccatgaggcccacgaggcggcggcgggggacgagctgcgggcgggcggcgggagaggaggagcacgaggcaacctcctcgtgaaatacatactctccatcacgcgtgacatacgtactctgcatctgattctgtacatgatggggtagcaaaataactagctctgaaaattttgttcagaacatgtagtggtgcttgtggtcgatcttggtgttgcttctccggcggtggtgggaagagctagagatagaagaagcagtagggtcggggaagccgatgtcgtggacggcgccaacggtgttgaagaagaggcgcttgttgagctcctccaccagcgtcctgtgcagcagctggctccgcatgtccaccatcgacctgttccgactcatcctcccccgccgctgctcctcctctccgccaccctctcgctgccgcggccgtccggcgtgccctcctcctccgtcttcagatgcagaggctggccctctctcgccggccgcgcgccgccccttcccgccgcccgcccgcagctcgtcccccgccgccgcctcgtgggccgcggccggcgggggagcccgcgcgccgccccttccctcgccgccacgtctcccgtcgccggccgtcggtcggcgacgccctcctcctctcccgtctcgcattgctgtagagaacggagagagagagatgaggatgggagagaagagaggaaaagagagaaggttgatgtggcaaatgctgacatgtgggtcccacgttgacttagccgccatgtaagataaaaccagggtcaaaaccaccggacaaccgaacaacctaaagtgaacggttttagttgagggatgtccggtatttttgcggttgggggacgattttgtaactcgatgacaagttgagggaccttcggtgtgattttttcaagttagtttcggcgtaaagttaagggttctcaaatgaaccaattccttacgaaaacaataggcccattattgagttagtacattgaggcccaaatttgtagtgaacatctttatgggctgatcaatcgattgttcgcgaccttttggagtcttttggagttttgggcaaggacgcgcgctgggcgctgctggctgtggcacctgggacgttcgtgaaacctgcacgaaagcagctcgccgctcaacgcttttgatgcgatttcgacacgaaaacaacgaagcgtcgggagaaatcggcacgtcccatagtttaagcagatgaactagcgaaccatagaatcgaagatgccgcactttgcagttccgtttcatacaacatcacatagcagaaggtagtgttagcacaagtcacatttcagaagttcaggaacatttttttcccattttctgaacttggaataacatgtacatagatacatagggtttttttccccctgctaaattaacaggatttcacacgcagggcggtagatagatacagctacttcccatcacaaaagcagaacagcaaatgcacatccatcttgctccacaaaaaaaaccaccaaacaagatgcaactgcagagttagcagcaatccctacacaaaaggctaaagctgtactagtaacactactataatgtaggagtagcagcaaccaacacactgtgcgtgctgctgcacggagactgggcgcagcagcactacgcgcagctggacgcctgcctccgcggcggcgcgagcacgaagagcgactcgaggtccggcggctggaagtacccgcccttgggcggctcccgccgctccttccccagctccggcagcgccaccggcctcttcctcggcggcgccgggcactgcggcggcaccaccgggatgcggcactcctccctcctcggcgtctcccacccctgcagctcctcctcctccatcgccgccgccacctcctctccgtgccccatctccacctccattgcctctctcgatcgctactcctaagcaaagatttgaaatggcgaagctatgcaagcaaagcaagcaaccacgcttaagctaatatagaagtgagtgccaccgcggtgggtggtgatgtgcagcaacgaagcgacgaggagagtggagtggagtccagcggcgttgcgggtggcgggaagggacgcgccccgcggaatctactcgtttaccgaatgactagtgggaccaggtcatgtagggacccacttgtcagtgggaaaggtgtgaggtcgctggtggtgggaggggggttgggagagttacgtggcaccgactcgcgaatgcgcgggaaccgcgtcggtcgaaagtggcggaatggtctagagctccgccgcggattctctgtgccaaacccgcacgaacgccgcaggttgagcttgagctttcaggtcactgcacttgggagcctctctttgaagcccaacagttctcaattcctatatactccaacagtagtacggtttaattcaaaaaacaaaaactcggtagctgaaagtactcttgacacaatgctgccgactgtcttttagcttaaagtaactatatgttgctttaaaaaattggctatggcatttattaaaaaaaaagaacaaaaaaactgttagtttagcggcgatcattgcacatctgggacctgcaagtccaactgcctggccctcgaacgctctacgctacgctcctaccctaccaatggggcaaccacagttttgcatgtccaatatcgtggttgcagtggatccagctttagctcagtagttcaaactcagcctcaaacattgattactcaggacgaaccatggataggctagaaaaatggtctgcaatggaaatatggaatggtagtggagcatatctcttcggaaagtgggctccatctctcctctcgccggagtacgaccaagctgtgggcggcggcgtgacacgtggagcccgtcccgtacgtcgccgggccatgagaaagtggatgccagcgtggcgcgaccgagaagccgcggcctgcaccggcggagcacacgccatgcatgaccggatgatgattaaactgggccacaagcccacgagtactagataagttcactgttttttcagatggaatagttcaatgtgatctggaaaaagattcgaacttttcaaagggggtcctaattcatttgcatttccttcacacagaacaaagctaaaagcaaaactttactttgatgcctaaatcaactaatataggttgctcactttgatgtctaaatcaacattaccaaattttggtagtaacaaattttggcattaccaatgtttgataaggataagggtgtgtttatagttctttggatgtaaaaactttgaaatatgcgaacacacatttgaagtattaaacatagactaataacaaaacaaattacagattcccgcctgtaaactgcgagacgaatttattgcctaattaattcatcattagcaaatgtttactgtagcatcacattgtcaaatgtaatcagacacaaaagaattgtctcgcaatttacatgcaaattgtacaattgttttttttccaacatttaatgctccatgcatgtgtccaaacattagatgtggcatttttggccaaaatttttttggaatctgataaggccaaagaagagtaagttgtgcgaaaagattctagaattatgaaaatttggtaatggaggcaacttttggcattgtttagattgttaccttgccaaaacttggtaaggttagtttcggcaacaaagggaacactgcatcaatgattgttcatgaacgggcttcatgcttttctatttagcaaatggcctttcttgaaaagattaccggaaaagtatacactgcttgcctgataccaaggcctgaaagtgtggcgacaggggtgcacaagaaaaattgctaatcaaatcagttcaacaaagattcaaatgtgtcagcactgcttcttcattctattatttctaccgtaaaccttcacagaccatgaaaatctccctcgaactagatcttgtcgccttgggtctcaataaggacactttcttgaacttctctttgcaaaatttgccaaaacctacaaagttaacagtttaatgaataataagttatacttggtgtcttgttaggatttttttaaaaaagaatagctagcatatagaagatgattgctggtcataacctggtatatcctcattctcaagaaacttaattacaaggctgcctccacgacggagaatgccatcttcatcaggatctggctcagtggagctctgaaacttctctaaaattgcaatgcaatctgaatcttttgctttcatcttaccaactgccaatgaaagagcacgcatgcccagctcgcaagatatagccgcatctttggttgtaattccagaaactactgggcacatgtctgacaatattacagagaatcctcgttcctgtaaaataagggaatcaaataaccaatggcgattacagggcaatacaattggtaatccttgcttcagcctttctaaccataggaaataagatattcagatgaagcgagcttggtagtgggaagattgatgaaaccatgtttcgtagtctatcagcgtgcgtactaaagtaaactcagcttttctcaagttacaaccttatgtggtagtgttcccagttgacaaattgatatttggaggcaaaactgaataaatacacgtttacctccacaactggtggcatcatattttatttagctagtagcagaaccactttatcaggttccatcgtgcctaccgacaaatagggtacataccttttatctttgaaagaaaggaatttcatgggaatttttggtacctagctcttcccaaggaatgaaaaggaggcatgcattttctggtaaaacattagtagcatctgtcatttgtacaaactaatactccctctatcccagaatataaggattgaatggtgaagggttgtgattggtttgataagagaatattggtgaagaagttattatattttgggacaaatctagagaactgaaagttgtaatattttgggacgaggggagtagttcacttgtcgcaagtaccactagtcaccaataatcctcggtgcgaaccttccaagactgttttcctttgcaaagatcatgagtctcaatcgaatacatatggagttcagttagtactaagatttcacaaattagaataaaccaaactagattgcagcctcggatcaaacgaaactaatttgtataacttcgtaccattccttccacgaactaagccagggaaatcggtagtaaaagctgaatcatatcatgatcattagcaagctatcgaacctgtggcgacattgcccgagcttgctgcttcatcagagccatcacatcggcgcaaacggtcctgaccctcgagtcacagtgcgcagatggaaccttcaccttctgctctgcaacaaccgagcatcgaatcaggccaaccattccgtcggcaaaatcagcctcactaacgaacggcaactcgatcgccactgaccttgacatcgacgccgacgatcaccccgcccttctcgagcggacccaggttctggcacgccacctacacaatgcaacaccgagctaaatcgaaatcgcgctgatgagaggagaggaggggatccaacgtcacctggagccacgcgccgggggcgcagccgaggtcgaggacggcggcgccgggggcgatgagcttgtgctgcttctgtatctggatcagctgcgacgggcagagcaagcggctcctcgcgtgagacgggagcagttggcaaaccgtacgagcgagaggggtgaggaggaaggcgctgaccttgaacgcggagcgggcgacgtagccgaggcgctgcgcctcgcggtagaagaagtcggcggtcccgcccgccccgctcatggcttcctctccggccggcggcggcggcggtgacggtggcgaaggtgaagacgacggaggcggaggggattgctagggttttagcccgtcttcgcggcccaacacacaagtgaaacccaagcagcttgtttgctgggccggacgaggcgagcaaagcgttacgtggccaccttccccccgcgcgcactcttggcatgcgcgagcgcgacccctccccctcgaaccgccgcgaccttttcgatgcttcccaaatcctcctcctcgtgaactcgtcgccttcgtcttcgtctcgatctccatggcggactcgagcgcggcccgccccaccgtcctcgtcaccggcgccggcggccgcacaggtgggtactcctccgtcctccctgtggcctccgactgcgatatgaatcccagtagcgcgctctccagtacttctttttttttttgggggggggggggggggggtattggagcaaactgatgacagcggaatttggaatttgcctgttgtgcaaggttcgtgcgatctacagtacatgcttgttatatgatggggaattttggatccagtagagcgttctgaaaaggaattttggtcggaatgggattcatgtaatgtgttgcagtatcttgatcttctctaggataagagactttgtatcgcatggctgctagtcatatgatgagttgaatttgcaaggtttgtaaaattcacctagggcttaggcacgagtggggcttcttgggtactgattaacccattctagtttagctcaatgaactgaatatactatttggacttggaaaactgaaatttagtcgattaattgaagtgggtcaatgggtatccacagagcaacccacgccaaacccggaattcacccaatatgagtgcatgtgcctaagattttttgcaactatatggatgtatactgactgctcgacactatgtagtctgtactaatcctcaagggttactccttgtaacttgtcaggaaacattgtctacaacaagctcaaggaaaggtctgaccagtttgttgtgagaggtttagtgagaacagaggaaagcaaacaaaagattggtggaggcaatgatgtttacattgccgacataagggacagagatcatcttgtgcctgctgttcaaggtgtcgatgcgctcataatcctcacgagtgctgtgccaaagatgaaacctggttttgaccctagcaaaggtgggaggcctgagttttactatgaagatggaatgtatcctgagcaggttggctgattgaaacccctctagttaatatatagaatgtgattgtaaacttctgagctcatgctaatacttgctgtggtctgttaggtggattggattggccaaaagaatcagattgacactggtaaggttgttgcttattcttcttcatcattcatgtatcagtttgtaaatgtttgttaagtgaacattgcttgttttaacagccaaagctgctggagtgaagcatatcgtgcttgtgggatccatgggaggaacaaatcctaaccatccactgaacagcctaggcaatggcaatatactggtaagctgatggagtttgctagttctttttctataataagtcatacagcaaactttttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcaggaat

SEQ ID NO: 68238 - DNA, 794 bp, Oryza sativa
agaagaatgagatttgaaaaatatttgacaaaataaaattaatgggaaaagactatgattcaatagttacagctgcagtacagagacaccttttcattatagaaaagccaacaagacaccaaatgctggcaatgaattctcaaaaagtgcatgtgttgtcgtttgttcccagagtaacatgaacacaacatgtagaatggacattttacaaatataataaaatcttaccaactacgtttattctcggaaatgtagaatgcaactatatttctcggaaaaaggaagacgctggctgaaagaaggaaaaagataaactcttaccaactacgtttattcatgtcagcatcggacacaccttctgcagctggtgtcccagcaagtatttcaccttcctgccacgaaaatgaatcatgagataggaaaaatgatttaagagatatgagagagagagagagagagagagagagagaagggggaactctggtgaagaggttacctttgtcaagtataggttgcgtcgatcctccacctcattctttgacttctcaagttcctttttgtgagctgactccttgtccagcgctttcattatcttaagagccctgctctttataaagatccccaatccaggagcagcattggcagcagaaacggctgcatcagctgcctctgctgtagagaacttcagaaaaccagttcctctaggtctcctgaataacaccaaaaaaccatgcactaatgagtgtatatgcaaaactgcaaatgtcctctggttgatacaacaggaggaaata

SEQ ID NO: 68239 - DNA, 737 bp, Oryza sativa
agaagagaaagaaattggctgcgaggcaagcctccacggcgccccttgctcatcagaatcagcagcctcttcagtctactcctgctggtctgacccagccttttcatcagatggtcgtggcgtttgattcggctgcatcgcaactgatgcattttgaccagcccggctcgaacaaggagcaggtttatatggcaattgggaggttcttgtatgacgctggtgtgtcactggaggcagtaaattccgtttactttcagcctatgcttgaagctgttgcctcagcaggagggaagcctgaggcgttctcgtatcacgacttccgtggttccatattgaagaagtcgctggatgaagtgactgctcagttggagttctacaagggatcatggacccggacagggtgcacattgttggccgatgagtggactactgacagaggcagaacattaataaacttctctgtgtattgcccggaaggtactatgtttctgaagtcagtcgatgcaactgacattgtcgtgtcgtcagatccgctgtatgagttgctgaagaatgtggttgaggaagttggtgagaaaaatgttgtccaagtaatcacaaacaattctgagattcatgcggtggcaggaaagagctatgcgaaacttttcctacattgttctggtctcaatgctctttccagtgcatcgatgggatgcttgaagctttcagtaaggtgggggcaatcaatgagatca

SEQ ID NO: 68240 - DNA, 723 bp, Oryza sativa
tttttgtcgcttcttgaactcactagaagtaataaatttatgaaaaatttgctcaatttttagaaaaattgtggtgtttagattaagttttctaaaaatatgtggtggtttttgtaatgtggatatgaatagattatgaacgattaaagtaattgttttatttctcgcgcgagcacgaggtgaggctcgattcactttcactataatcgcggccatggcggcgaaggttgggttgttcccctcgtcgtcactcaccaccagcccccacgccatcgcggctgcgccgaccaacgctccccgcccacgcggggctcgtggattggcgtctccaggtcgatccgcggcggcgatggacgccttccacgtgtcgtcgcaggccgccgagccgctcctccgcaccaccggcgccgccgccgccgcggcggcggcggcgacggcgacctccaaccccaggctccgcgtgcggaatcctgaccctaatcctccgcgccctaattatagccgtcgtcgcttcttctatcctggggcaaggtgctggtagtggtcgtggtttttgacgacatggaggtggatgtgcaggtgcggacacatgcgcagggcggcgaggcgccctccagcggtggcgccggagatggcgcggccgggaaggagttctcgtggtcgtccatcatccttccgtaagatagctcccctctccatctctttggtcagtgacatttgggg

SEQ ID NO: 68241 - DNA, 7859 bp, Oryza sativa
  unsure (1)..(7859): unsure at all n locations
gtctattcattaagtgctgcatttcaaattctcaaagcatgacatttggtaatatagaatatcagggttcgtaattaccagattcagcaggaggtggagttgtgttcttcaaatattcttgatcatatgatgcaactgatgctccaaatgttcctatgtaataatctttcacatagcgagcaaatgtttcctgcacagcagaatagagcaagcaaggtcaccaaaaggcatggtggaacaactaaataagagtcaagtttgacaaggacttatcacatgcttactaatgattacaaacatgttttttttttgtatgtgtgtatctggaattgctggcaactttatcctttcaacctatctcagatcattcttaattcctatcaccaaagggaggtattacttaccaccaaatctgtgccattcttctttgcttcaactattggggagcacaaagcatcaggattaccgtattggaactgcacatggtataagattttaatacaacaattgcatctgacagattataaagtcaaaataaatgtacatttagcataccgcaatagctgctgcatccgccagtagaaagaggaagtcaccatcatttgctaactgcaagcatccgaaagaagttggtaaataattaaatacactattagagcattcaaatgatattttataccatgcaaggaactaacataagtggtcataaggttgatggcacaagtgcacaatggcagtttaaggacgtggcggttcacttcaaacttagttctaatgaaattatagaaggtccatagacttggatactccataatatatttttgataagcagtttcttagtttggtataacaatgccagttgtctgaaaactgaacggaacccactagattattacatgatctccaaacaagtttcagaatgcaaagtcagggaaatatttaatatatttgagaagctattttttagcaccactactttacccttaaagttagcttgacctctttatacagttttctcctttcatgttttgtcatactgaaaccaggcaggtaatataaaaatcagtaagctgtcaaagcaaaagaaatatacttgcatatcacatagaggattaccgttgatgctccaaagagttgtttaactgcattgcgaccagactgaagttgtccgtcaacaagttttgttgtttcttgtagtgctgctttgcattcagggccagctgactcaccaatcttcagagatgtgaatcatgcagaaaggtagaacttttaggtgcatgccaaaatgcgataacattataacatgattaaggatctgcacctgtagttacctgtttgtcaaagtcagtatagttgtaaacagaaagaacaactcctgaactcgcaagacttccacatgtcaagtgagggaacttcaatctgaaccaagcactaagtgctccagcgtacgaccctccaaaaacaaaccaagaactgtctgctcctgagcgattatacttagcattcaaagtttccttcaaataagagaagccaaactcagatcagtaggtacactcgtttggacatagacagtacaaacggtcctatgcccacctgataatattggcggaaaacagccagatcaaacaaggcctgttttgatgacaagaaccttagattttccgttgtcaaactctcaaaaggggaactctttccgtagtaccgatgctcaggggagaccactgccgcaccaaacttctttgccatcacctacacacatcacacacaaaccatcccatgtgtatgttatcaaaacaggtgaagtaaaatataaccatatgcttaaagtatagatcacacctagaatgtgtaacaaataatgtctaattgctccagttggaaactgtacaactatatacttgagcatactcacagctaagtagctgttaggaatcccgttgcacgaagattctccacagatatataagaaaattggcccttttggagctcggtagtaatcaaggaattcatagtaacgctgcttgaattgccgatggtcctgcattgaaaataaaataaaggtccatgaatgccaaaaaaaaaaagaaagaaagaaagaaagaaagaaagagaacatctaacaacgatggtagaatgcatcaacattactccatatcacatcacatttgaaacaacttgaatcactagtcaagaggggattatggacaacagtgaagcgctagtttgttatgtagcaagtctagcaggctcgtaaattttcagatacacaacatatatacaaaggggaacatcaacattataccgctgaagtaccgattgcctttttatgaggtccgaaagtctcatgaacattatgtgtacgggacatgaacatcggaatggcgttatcaaaagtgaagctcacatgaaatctatgaaacaaaacagaaatttctttagcatcctcaaactccataaattctcccagcttcaaaatcaatcgattgtgccagtgcggacgtgggcgtgctaattcagtaccaattcgcttagttctcacactggagactatactaggatatagattgactagattccgacagagccaaagaccaaactgatgcaaagtgacggcacagcacaaatccacttccccatatccccaattcccccaacccattgtcccgttgcgcacgaagagcaaaaacgaggaactgaacaagagcgcggatcaaccaattcaaccgagaaaccgaaagaggaggcggtggtgggagatcgggactcaacggtggggttgaagtggtcgagggtctggtccatccaccgctcctcctgcgtcaggtacctgcctggtgcggcggcgccgccgaggcgccccccgccaccggtgggaggcggcagccacagcccgatcggctccgccccgggagccagcagcaggagcaccgccacggcggcgactgcggcgccgacggcgctggacgccatctctctctcgcgcgcgcttccgcttccgctgcggcggcggagaggagacgatgcgtttccgacgcgagcaagcaaagcgaagcaacctcccttggcgagaagtcagaagtggaagaggattttttttttttttttgagaactgaagaggtaacgtgcaaagtgtattgctaccgctacgggatgtgtacgagattttatccgggcgtagggtagggtgtgacgaggaggatacggtatacggcctaggaaatacggggtacggggccgtggaataagtccaatttgcctccctcatctcttgcgtttgtgtgaatagcataccttaactggaaaaacgggtataactcctccttcatctctaaaaccagagcaaatcacctcctcccttggtggtttttccgacgtggcattgttgacctggttgacaagctgactcagcgtggtgggacccacatgtcagtgtgtagcgctctctctcccccccgtcctttcccttcaccccggtgtggctcatcgacgtgggtcgggccaaggcggcagggcagcgcgttgcgacggagagaggtacccgtgcggcggcggtgatgcgggagagcgcacggcagcgggcggcgcggtggtcggctacgggcggtcgtgcgcagtgggccaaccttgcgcgggcacggcggatggcggcggctggcgaggctgggcacggggcagcgcggcgacctggcgcggcgcggacggcgatgcggccagggaggcgtgacggttggctggatcggcgccagtgcggccggcgaccgacgtcctctccgcgtcctctcccgcgccgccgcgaccccgtcgctgcctgcgcatcccccgccgatgccgagactgcctccacctcgcgttcctgtgacgcgctggaggccgagcgcgccgtcgcggagctcctccgagagcacggggcctccccggctgatgcggcttccatcgccgcgcgcgccccggggtacgccgccatgctcgccgacggcgtccgcgagctcgacgagctcgggctctgggagtcgtggagctccggggttggggcgggccgcgaggtggagatggccgggctcgggttcgggaggaaggtgtactacatggggaaggcgaagagtaggcacggccgcggcgtggtgccgctgctcgagagcgtcggggtgcggctctcctccgcgaagctcatcgagccgtatgtttcggcggctggtctcccggtgctgatcgatagggtgagatctaccacttcattttgagctcaatttgcttcatttttttagtgcatttgatgaccatctctgcccggtacaaactgcatagtatgagtggtgaaattcgctcatcatttcttctcttctttgtttcttgttgctccggcaattcgctcgtcatggcgcgaccgtgtggcggcggcgcatccaggccgagcggctagcgtcatgggcagtcggtgctgcggtgcatcagcgtgtggagcggatgcatgaccagtttccatggcgccgatgccgccgcttttcttttcttttctttccttttgcttttcttctttgtttcttgtcctctccggccgggcgttgtggcggagcgacggcgccgcctagatgcggacgcgaggtcgccactgggtgcgcaggctcggggttcgtcgccggtatgcaggtgcaagctcgctgctagggtggccacgacgcgaccactccccgccgccgatgcccagctcctctccgctagtctactccccgttcgtcgctagcgagcgcagctgccgccaacgagggccaccgccggccgcgcccctaccccgccaaagtgaagagaaaggccgagggagagagagagagataagggagagagagagagagcgcacgctccacactgacattgacatgtgggtcccaccatgctgagtcagcttgtcaacgggtcaacaacgccacgtcggacgaaaccgccagcaaaaccaccgagggaggtgatttgctctggttttcagagatgaaggagatgttatacccggttttccggttgagggatgttattcacgcaagcgcaagaatgagggaggaaaaatggacttattccacggggccgtagagcgagcccgtgtggttgcctattgggccctgggcctcgtttggtttctggatggaccgggagtccattgttctttgagagagagagagaagagaggatgttccattgggattgagattctcagcagtcgactgcaccgtgcctttgtcactgatatatagacccaacgacacatcgggtccacatgtcagtgataaaggcacggtgcagttacttccattgttgtagtggtatcgctagatttcagccccactacctctaaaattgtagtgaaatatgatgtgcaatgttacttcttttagttgcaattttgttgtatactagaaaaaatgcccgtgctttgccacgggtaaaaatatttttggatcgttatatattttactctttggttttggacaaaaaagctcatttcattccttgtcaagtggagttgtaagtccggctcgcatagctgactgtccttttcaacctccgaaagctaatgtcatgtccgtacatgccaaaaccgatccttccatcaaatccggtcgaatctttctcgatctttcaaaattggtttgagggtttttgatacactcgatctcctctttccgtttttattaaaatcggagcgataaaactcgggataaaaatggtgattttaaaatagagattaaattcagtgaattaaaacagagttaaaagagaaaatcataggaaaatgatgagggagcagtggggaattaatttttggcaatcaattggtggacgaaacgcatgggaagacagatcgacctagcggcgacgctagtgttcagccggacgataaaaaggcatggcatataaaagaacaaatccttatcgcgtgcgagaaaatacaactaaaaaacagcaacaaacatatgaaaaaaaacccggtaaaaaggcctgaaaaaaaggtaaaaaaacagcatgggaaaaaagtgaaaaaaggcgaagagaaaaaaagcagatggaaaaaaaaagacagacggaaaaaattgtgaaaaaaagaaaaagagtggaaaggacataaagaaagaaaaaatatacggataaaaaaagaaaaaagaatcggacagaaagaaggaaaagaaacggacggagaaaaaaaaaggaaaacggacaggaaaaaaaagaaaaaaagggcgaaaaataaaaaaagacggacggattttttttgacggaaccttgcttattttttaattaggtatagatatagttttactttgtttttatctaagtttggattttttttccatgtaattttataacttttatgaatagcatgtttatttattgtaattctgtatgttcaaatataatgctcaaccttttacatataaggagaaaaataggaagggtaactagaatcattggattgttatctaaggaatgaaaaagagactggaattttcataaatttcagtcaactgaaatccagacactcccttgctggaaacatgtttattccactgtttgttctattcaaatttacaaagtaagcttgttctcacagaattttcacagaaaaaaaattgttacttatcacaatgatcacgatatatatcaaaccactgtcgatctgtcattactcagtggcacgaccaatgcacggagcgggtgctgcatggtggtgatgaacccgtagtccgccgtgagatccacctcctcctcccatgggactcggcgccactcgaaggccgtgaccagattcgcgagaaagtactccaggtgcaggatggcatatcccatcccggggcacgtccttcgcccggcgctgaacggcatcattttcaccttagttgttgcctcctgcttgctgccgatggccaacctcaccccttcttccccgccctccatgaacctctctggcgagaactcttccgacgatgtccatatctgatagtggagttgagagacactagttagtgtatataagacgtatctatctatatatctaaagatggctgttgtacgctgcagctgattagtggattcaccggccatcaactttttgacacgtgtccattttctcagctgtgacatacgtcatctgtatatgagtcggtttttaagttcgtttttagaaatacatatctatatttgagtcgggctttaagtatgttctcttttgaaaatacagaagaagttgtataaaaaatctatttagaaaaacttacatgctaacttgagatgatcgaactcctaattgtaacttatgattttatgaaaaaaattatatatccaagtgaatttctacagtgaattccatcttatctaaaccgtataacaataataatgaaataaccttcacccgttgcaatgtacgggtattttttctagctaatataaaagttaaaaaattagataattgatatgtatagtatttcaggttttttttttcctgagtttatcactgtgcgtttgtgagttttccgtgtgatggaaaaaaataattatgtgacacgttgatgacgctactgtgcatacggaaaaaaaattctgtgcggcagcgccgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68242 - DNA, 3706 bp, Oryza sativa
tataaagaatcctataggagttaaaagttccactcaacaaagttttcatgtgttttttcttaaataaaagtgatcctaataaaaaataatcttgctaaaaggaattgaggagggacatgcaatgatattctcgcaacgagtaagagacaattcaacatttgtttttttattatcgtatcgctcgttttgcctggctatatgttttccttgctttcactatccccctatccaagacgccaaatttttttttaattggttcagggagtacctagacacatgaaaaactgatttaatttgatactaatgcattatgctaatcaatctggggttaccaaaataaaaaaatctagctcaaaataaaatattaatatgcgatgttaccatagtaggagtaaaatactatgcacagcaatgttacatttttagaattggtagccaacgagatctcttttttcacaataggtggcacagtacatattggccaacttgttagaatccttgttctctttttagcttatcagtttatttcccttttgaagggtaattggggtttgtcttgccacctattgtgtttttgttacattaaaaacttgtttcctatgcttacggcagagtttggactttggagatgtaaaatatttttattacctaaaatggcacgatgataactagtggctgcacgacagctacagctacagtgccagcaaagaaattgtacagcatctacgtagctacagcctaactactcctatacaggaaaaacaatatgaatgaatgatgttttcggaagaaaacaatggccagagaaaataccatttataatgataactgctgaatttgacattggtaattgtatataaacaaagtaactaaagatgactggataattcaaaaaatgtaaataaagaaaaggaaaaaaacccaattagcattttctcaaatattctggaggacaatgatatatattttcagaatttcctttcaagatagaagatacttcgagagtgaagaaccaaagtttctctaaattaaggaagatctctctggcaagaggctaacagcgtcggcatctcgtaactgattgaacacataacaaagtttcaacctcatggttagccggccagtgattagtaaatttcaggtttggtgcacttttcagttttggatatacttgaagatgctgcaaactgctttagtttatcggtgaaccaccatgatggctttggaaactgaaaagcattggggggtagttttaacctgaaagttttttggtagagggtacaaaaatatatagttcaaatccaagcacatatttaaacaattttcttccttttagggtgaactagttatatattacaactggatagtccatttgtaaatatagtactagtgtgttgtcgcagaacttgttacaattgtatagtcctttagttttttgtactaatgtcatattggcaacacatattccttgttgagttggtactacctgcatcagcaccttaatctttcctagtttgctctgctaatgatgaacaatgttatcaccaagttagagcagttacgtaactatagagtatttgttgtacaaatttcttagcctacttgccactaataatataatggcaatatattcactcttctttacgagaatacatccatcaaaatcagatatgatctttgtattatcaataaattgtttatctatggggtccatgaatatgtgattgtggcttaggtcgtgttcgattcagccgtctggcagtattattgtttgtaattagtattatctattataaacttaaaaataaatatacttaattttaagaaatttttatataaaattttttacacgaaatgtaccatttaacaattttaaaaagtgtacttactttatgagaaatgagtaataaagctcatccgagaatccaaaaagaacgaaccttaattaggccttgtttgtttcctattgagtttttgtcttcaacttaaagccaacgaaagcttaaggttctcgaaacgaaattgtagcttctctacttctggaagaggctaaaagccaaaatggaggttacaaatgtatctatcagctgtgatcgggcccacatccatacatttctttaaagaaaaagaagaaagagaaaaaactctgtagctagtttttttttttattttttgaacttttaaattttaaaaataaacccttataaaacttgttttcaagatctgaacattttcgtcacgttagccaaactgacttggcaaaacaacattgtcacgatggtttggctgacgtggcagcattatttagtcacgccggtctggctggtatgacaatgttatttgaccactccgccctcgatgacgtagcagaataaaattgtcatgcccattatgtgcgacgtgccagtgttgttttgccacgcaagacagacgggtgttgctaaaagtttcagattctggaaaaaaagttttggcaaggttaatttttaaaattaaaaaataaaagttcaaaaaaaaattgtagctagtatggaaggtgctgagaaagcaactgaatgcaattttccaaaatggaatagttatggatttggcggatacaatgaaaataagttgaaagtgaacatttgtatttgttttcttgatccatcctttaaccgtatatggtgatgtaaacagctagtcttaagaaaactgaaaaatatatggtgatgactgatgaataccaaatgctaatcgtgtacggtcgtttaagcatgtgcactaaatatacaaaaaggaaatgtatctgttcaacatcttggattagactaagcattcatggatcttcagcccaactgtagtattgattactatttgatatgaacaattccagacctcgtgttggacaagttcaccctgttactttggccggctaattgccagtttgccaattgccaccacttgctcagtcagttgtgttactcagctgtgctaacgtaatttccatgctattggcaaacctaatttgctgcaagatatggaagtgtcaataaaaatatattacttttaatagtaacgaaaatataataagagttatgatataggatacttcatatatctaaaaatatactaaattctaacgatgtatttggatatatttatctaaatactagtcagaagttactatattttgagatgtggatatataggtgtcatgaaaaatgattgaaggagaaccttttcgtgatatactgggacccactgcctaaaaatatagaggaaaaaaaaacgaaaatgcatgtatctatggaaatttgagatcctatactagtcttaaaccagatataaaaatatcattcctcacctactcctcccaactctatataaaccctggatcatcctaactttctcctcagctctacaccaagagcgcttataaacataaaaaacatctcaaacacaacccaaaatagggccaaaattctagaatattatttttgttttgaaaggaatttaagtttgtgtggtgtgtcatccatggcggacatggtgaagttcaccatggagtggcttcaggatcctctgagcctggcgatcgtcgtcacggtggccgtcctaatcatgcggatgcagcggcggcgcgcggcgccgttcccgccggggccgaagccgctgccgatcgtcggcaacatggcgatgatggaccagctgacgcaccgcggcctgg

SEQ ID NO: 68243 - DNA, 3252 bp, Oryza sativa
gaacatggcgttcgcgcactacgggcccttctggcgccagatgagaaagctgtgcgtggtgaagctcttcagccggcgccgcgccgagacgtggctcgccgtgcgcgacgagtccgcggcgctcgtgcgcgccgtggcggcgtcgcgcggcgaggccgccgtcaacctcggcgagctcatcttcaacctcaccaagaacgtcatcttccgcgccgcgttcggcacgcgcgacggcgaggggcacgacgagttcatcgccatcctccaggagttctccaagctgttcggcgcgttcaacatcggcgacttcatcccctggctcagctgggcggacaccaacggcatcaacgcccgcctcgtcgcggcgcgcaccgcgctcgacaggttcatcgacaagatcatcgacgagcacatggagcgcggcaagaaccccgacgacgccgacgccgacatggtcgacgacatgctcgcgttcctcgccgaggccaagccgcacgccggcaaggccgccgccgccgccgccggcgccggcgacggggccgacgacctgcagaacacgctccgcctcacccgcgacaacatcaaggccatcatcatggtacgtgcagttgacaacctactagtaattaattactgccaaatttttcaccaacttaatctctctatcacggtaatgattaattaccacttactcctcccggccgatcaagataaaacccgatcgaaattaggcaacaccaaatccgtaaaattactggaattaatgattcaccgatttagagcaagtttgatagtatagccaactattaactctaaatcatctatagcaaatataatagctaatttatacaatagttacttactatactattaatatctggtcccacctgtcatacacacattacgtcttagagttcgtgctgcagctggctatagattttgtagcccgctgctcttttctctcttgctttatctttttaaaatatatttatagttggcttacttatagcctgctattgtaactactcttacacagcacagcagtatggagtagtaatatatatcttaaactctgacaattaaacatgataaattcatctgacgcaaacacaactgtacgctataaatacgcgtacaaatcagcaacagtagtgtacggggccggattattagtcaggtaatatatcattttattttaggcgattaagtcaggcaaattatcttgatccgtgtagattatttgacagggcagagatctctcctggtatagttgacatgaacaccatgtgcagtccatgtgtgtgttcgcctcgtttgcaggtgaatcgatatgatcaaccgttagatggcgccacgtatgcatcatggatcatagattaagccctgcaaattaaagccactcaatgaaatgctagatttgaggagtaattaattttagtgtagaatacagtggtcctccttgatgcatccctcgcaatgtatctgcacttctacaggcagtcaactcacttacataagcattgtcgactgttcccgaggagatcgacaccgtcagatacggcattaacctatgattatttatacccatatttcaatatacgggtagtaaaatattccgagaattttatggagtagcacgtactcggaggaagtagtaaaaatagctttgtacttatccctccgttgtataaaatatccaatccttaccatgtacttcctccgtaaagtcgttttgaacaacgatacggtctccaaaatacaactttgatttcttgtttctataaaaatatctattaaaaagtaatatatgtatacttttatgaaaatatttttcaagacaaatctattcatataatttttacattttcaaactcaacaacttaagagttattcatgatttatattcctaagatttgacttaaaaacagtcctaaacgacttcctttacaagcacagagggagtacccggatatatacgtgtctagttacgtggctagaaattgtctctctctttttcttttttttcttttttgatatagtagtatatcggatacagctagaagtaactatagtgttagccttttttagcgaataaaggtagaagctaatctttaaccacgttctggtaggatgacagctctaattttatttcacatcttttagatgtggatgttttcagcgtgtaatatatatctcctttttcaaaaaaaaaacctatattttaaacgaacttatataggaattttcagtggtagactgaataagtgttttgacttgctggtagaacgactggatatttgcacacacgaataatcttacagtcgcttggcgcaacagccaacctagcttgaggctcaaattaaagtcagagcacgagcctgaccaacgccggccggcggcgggtcttctccggcgccggcggccggtgatcgatttcatttccaggcttattctccgcgtatgcatgatgtgtcaagctactgagctatagctagccgtctctctcgtgtacgagtctcttaccactcttggctagcaaatctgacgactctttgactgaacgaacaactcgtacgtcttaaaagccaagaaaacaaccccggtaggctgtaggtgtgttcaaggggtattttgatttggtacctatatattcttgtctttatcaattaattcgtttgtaataaattgtacttacatgttaactatttgaattagacctaaagtataccaaatcaatagagtggtgtcaaacaggcactaccaaataaaaaaaatgcctactagcaatttttattagggtttgaaaccatacaaatcctaagttatctttgtgatactattgtcgtcggcctcacccatggtttgcatatggttgaatatatctgggattttttttcacttaaacggacatctccttgttattattttaaaaaaaattgacaataaagaatattatgtaatatttcaatctaaaaatatataagtttaaatttaacttttaaaatatattaaaaataataaatattattttgaatgtctgtatactagctatagtttaatttgtttttttaataacttgtggaagttaaacttagcattattcgtgtgcgaagtgatatatatcatattaatttattttatagaaaaagaatttttttataactgtttgagtggcctaagaaaaataatggaacatcctctcgaggaataaaaattcatctccaatatatttactgtgttgatctttcgctg

SEQ ID NO: 68244 - DNA, 1328 bp, Oryza sativa
cgccgtcgcgcggctcgcccacggcttcaactggtcgctccccgacgggatgaagccgtccgagctcgacatgtccgacatcttcggcctcaccgcgccgcgcgccacccgcctctccgccgtcgccacgccccggctcacctgccccttgtactgacggcggccggcgaccgcggcggcgtacggcaagaatggtttgcaggtgatggtgttaaaagttcagacgcgtgtggcgccattggaggagcttggtgtggctagcttagcttcctctgggcctttttttttttgctggtttaattttcttttttttttctcctttgtaatttaatccatgtctccagaacaataagtggattagtagggtataattaagggtgacagtgtgatatatagactataagatcaaagttgtaaatttggtgtccggtgtgcctgtccacataagcacagcctctgaattttcttgtaaaactttgtcatgaaaattgagaaagaaaacacctcgctttccacgcgtacgcttaccaaactattaaatggtgtgtttttttaaaaaaaaattctatggaaaagttgcttcaaaaataatattaattcatttttaaaatttaaaatagttaatactcacctaatcatacgcgctaatgacatacctcgttttgtgtatctttttttttcctctcctctcaaactatcgggttgctatatgttattaaaacgggaaaaaaaaggcaaactccgaatgtttgttgtgaatttacatttctactaaaaatttaggaccgcatgagttgtgatgtagtggcctgagatgtgaatggggagagatcgtacagggccaaatatttccccagcggctgtacagaaagaccacctatacaacttttctcaatgtagtaatattatactccctccgtttctaaatatttaacaccattaactttttagcacatgtttaaccgttcgtcttatttaaaaattttttgtgaaatatgtaaaactatatgtatacatatgagtatatacttatatttaacaataaatcaaatgatatgaaaataattaataattacttaaattttttaataagatgaacggtcaaacatatttaaaaggtcaacggcgttaaatatgtagaaacggagagagtaattttcttaggcatcctaccagcattagtagttagagcacccgcaatggtaaagtaaggtgctatctataaaatatgtacatctcagcaatagactaaattaatagtaaaacacctcaatagtatgtctacataggtatctatagctctctaatcaattgagggctgcaggaat

SEQ ID NO: 68245 - DNA, 2210 bp, Oryza sativa
ctactgccaaggcggcctgtacagcagtacaggcgtcacgggcgcgtttgattgttggcagttggcactgataatttgttccacctgcgtttctttctccaagtacgttgttgagtcaggttagtgatttttgttgaagggctcgtctagtgcgttgctgtgagcctgtgatctggacgtcgtgacgaagcttgtgaactaaaaggcaggtgtgtgataagctgtgttgctggcttgcagttgaagctggtgaggtttgtgcgtccttttctgctcctagttgaaagagtgcttgcacttgtgacttgtacaatctggttgttattgactcgctattacaagaccgcccatcggtgtctcagtctcactaccgacggatggtgagaccagccaaatcgttttttccacttggacccaggctaaaacctgccaagttataaccgggactcatgccctggtagtacttgcagttgcagaatcactatcaggtgggtgtccaattggatccttaaccagtggacgtttagtgttaaatttgaatcttccaaatgtgaaaatctagttaactcctgttaaaattctatggaatctatttaaaactcttacatccaaaccgaatttaaagatttgacgcttatatgcgaattacaaaatatctatagcaaagaatgcatcttcttcaaatgtacggcgtgccactatactgtgtaccgatatcacatatctatgatcgaagttgcaaacacttgaactgagagtgctctctccgtctaaaaaaaaatctataattgaatttaacatagtattccttcggggcccctttgatttgcaggaaaaatataggaattttggaggatttcaattctgtaggaaaattttatatgaagccctttgaaacctttgaaattcctatggaatggactatcctatagagattttggagaaaatttagtaagagcttcaacctcttgtaactttcctttgagtatatctctctcatcctgttcgtgcgtttttcctgcggttcaatcaaacggtcatttctctattttttcccgcgttttgctatcatctgttttacacttacattcctattaaaatcctacgtttttcctgttcctacgttttatcaatcatgcgattcaaaggggccctcagtctcgtaatataacaacaatcgaagggagtactccctccgtctaaaaaaagccattcctaacatctgatgtggagttagtggagatggagaatgactaaaatgaccttaatcattgaaaaaaaagtagtaaaagtcatgtgtaggtaaaggatattaaaatgataaaacttatcgttttacgtgttgagtataggtaggatggtagaagttattttttggtgggacaaaatttaaattgtaggagttgagtttttttttttttttttttttttacggagggagcataccgtgtcatatactactgcatcctcctatccatcaacccaaccaacggttctctcaatcaatctcaccatccgacggtcgcaacgagccaatcggagaagagaaaatcaaaataatcaatcaataaaacagaaaaaaagtaaaaaaaaaaaaagaagaagaagaagaaagtagcaagccggagtcgagagcctctcaacccatcggccatcgcccaccaccgccattcgccaccacctcgcctccgattcagatctccctcccccccttccattccacgcccatcggattccctcccgattccgctccattcctccccgcctccgcccccatctccgccgacctcgtcgtcgtcggcgtcctcatccaggcagtctcggcggcgattcgatcgccgccacggtcgccgatggaggccatccggaagcaggcgtccaagctccgggagcaggtcgcccggcagcagcaggtgagcccagattcgagattccctacccctcctcgtggattcctcgatcccagctcgccgtgtctccctccggtcgagatctcgtgctgccgctcgcgcgcgctctcccatggctgacacctcgggagtttcgcatcgcaggccgtgatgaagcagttcgggggcgggtacggcgcggacggcgcgttcgccgacgaggccgaggcgcagcagcactccaagctcgagaagctctacatctccacgcgcgccgctaaggtacttggatttgttcccttgcagttttacttatggtaa

SEQ ID NO: 68246 - DNA, 6034 bp, Oryza sativa
  unsure (1)..(6034): unsure at all n locations
ttctgacatatggattaatatcattaggtggcagaaccgttgagggctatggtgatgggagctcctttggaagatgctcgccatcttgcccaaagatacgacaggatgcgtcaggaagccgaagcacaggttatctcactatgaaacatactgtctttactacccttcatatgttgcctattgttatggtgatttctattaaacatactgtctttaccctttttatctgttggctgcctattgtgatggtggcagatttgagtttcacactgatatgttatgccacaattttattttcattgatcatataagaaacttagtaaggtactgtgagttctgcaggctattgaagtctcgaagcgccaaatgaaattaagagaaacatctgggaatggtgatatgatttcaagattagaggctgctgaatcaaagttgcaagagttaaagtcaaacatgggggttctaggcaaggaagccgttgcatcaatgactgctgttgaagctcaacagcaaagactgaccttgcaacgactaattgcaatggtatattctatgcttgtttagtttggccaattgattagttccttgtttgccttgagaaataaaatttctttacatgacactactgacttactgaaggtcgaatctgagagaagttatcaccagagggttctgcagattcttgatcaacttgaaagagaggtactgatgattttgtacagcatccttatcaaacttatacagaaaaggaacttgttaactatcgaaaaagaactgctttgttttggttatcctgattcagtctcttgtttctttacttttacagatggtatctgagcgccaaagaattgaaggagcacctcctccagctgttgagagttctatgccaccaccaccttcatatgaagaaattaacggtgttttcatgaggaatccaacagtcgctgaattggtggaaactgtggaattcttcttggctgaggtacccaatcatcacttcaccacaatgcacaagtttgtagcttactactacagtacttctaataagttttgtctgttgagattttattgctgatttctatgcatggtcatctttttgacaggccatccagtcttatcgtgctgagagtgaaactgagctcaacctggcagctggtgactatatagttgtccggaaggtacggccctatcttcccattggacatgtttctaaccataaacatatctttgctggacttttgtgggcaaagttggctacactaaacttgtgttcattaacctgctcaatcaggtgtcaaacaatggatgggcagaaggtgaatgcagagggaaagctggctggttcccttacgactacatcgagaaaagggaccgtgtgcttgcaagtaaagtcgcccaggtcttctaggcgttcaatgagccatacatacataaccctggtgttgtacactgtattatgatcgttcgtgatcttcaaagaccctctgatcagagaaatcacaaatattcttttgttctattattgtcattatcactaccccttttgtcaaaaccagtgcagccttttgtatgacatcttgttgcatggctagctttctgaatatttcaaaatatacagcggagaggacactgttcatatacattcattctccctaaaaaatacacccttgatagtcttttaggtatatatccgaaggacaaattaatcaatgtttcaaagtcgcaaagaccttttgttgaagaatcacagaatttaaattgagggattaaacattggtttcagctcatttcagctgtatggtgatgtgccgatctcatttttacagtttgtatatgtcttgcgtatgtatatgtcttctgaaagtctgaactaaattgaaaaaaaaacaagaaaatgttctgagctactccctccgtaccctaatataaaagattttgatattgacattttgcttgtactgtttgaacattcatcttattcaaaaaattttagaattattattttttttgacttactttattatccaaagtactttaagcataatttttcattttttatatttacacaaattttttaaataagacgagtgatcaaacagtgcaagtaaaatatcaagtccccatcggttggtaatacttgttataagctataatggcttattagcgattaaaaaatgatatgcgagtaaaacttttgtatgtatgttcgtactgattgaaaagacaaagctaagaaaaaaactatgttgaaaaagcatcaaaatcaaattcaaaatcaagttttaaaattcaaattttggttttggcttgtaagccatagggcaaacgaataaaacgatgaggccctcaaagggcctgtttggaggagttttaaattctgagaagcagctgtttggtaggcagcttcagagaatctggaaaagctctgaaacccagcttctccagcttctggcttattagttcatttttcagaatctcagaagccgtggactgtttggggcagcttctagcagaaacagtttttgaaaaaagctgcagctgagacaagcttacccaaacagggcctaatctcttaggtagtgtttggttgtaaggatgggatgggatgggatgggatgaacccacttttaggggtgtttggttgagaggtgagtgggacgggatggtccctggagaggaatattcctctcagatctgggatgaaacggtccgccaaaatcggccggaccaatccatcccacttcgacggagcccacggcgtcagctcccgtagcctcaagctcggctccgccgcagcgccgccgcctcatccgcgtcgacctccgcctccgcgaccggccgtcacctcgtccgcgaccgcctccgcgaccgaccgccgccgctcgttgtcagctcccacaccctcccgctcagctccgccgcggcaccgccacggccgcccgtccctcccccggcaccgctccttcccctggcgccgctccgtcctcctccgcctgctccctccacctcgcctcgcctccacgaccggccgccgcctcgtctgcgactgaccgccgtcgctcgtccgcgttcgcctctgcgaccggccgccgtggctcgtccgcgcctcgtcgcctccgggaccggccgccgctcgtctgcgcctcgcctcgcctcgcctccacgaccggtcgccgcctcgtccgcgaccgcctccgcgaccgaccgccgtcgctcgtccgcgcccgcctccgcctctcctccgctcgcgctgacgagctcctccgtccccattctcaccactcgctccaacctagccgctgggagcagacggacttaactgtccgtgaaacattgtccatcccatcccatctcaatcctttctaccaaacaaaaaaactataaccatcccataccataaaccaaacacacaactcgaaccatcccatcctaaaaaactgggataggtctaacccatcccacttggtccccaaaccaaacacatcttaagggacggagggagtactatacaggtcatacgtgagacgtggccctgtcaggtgggaccaaagctttgatcacatcttacactgccgggtggggtcagcatctgtcagacggtcccacgagttcttatccccttctctgcttccgcagtttgtgtgggctttgccgctgctgtcccctgcttatcccctcctcctcccgggttcgcattccgtcgaacaccatgacggcggcggcggcggcagcggcggtgaccctcctccgcctccctctcgcccgactctcctcccacctccgctccctccctccccgtcccataccgccccctcggctccgcgtctacacctcccaccgcctcctctcctccctcctagctcccagccacgtccccgccgtctcgtccctggccgaggcggtggctgcgccggatggtgagggggtcgaagtggaggaggaggagnacgaggaggaggaggcagaggcgcgccccaccaccttcgtgctgccgcggctgccgcggccgaagctgagcgtgaaggagcggaaggagctcgcgtcgtacgcgcacggcctcggcaagcggctcaagtcgcagcaggtcggcaagggcggcgtcacgccgtccgtcgtcgccgccttcaacgacaacctcgagtccaacgagctcctcaaggtgcctctcccgtttccccatcctctcgcattataaattcgtgacatgatacaacacatagtttacctacaaatacaatgagaacaaatacatcaatttcagtgtatgatataccaatggaaatgggatgcttcatcatgctgctgaatactgatatacaatgatgtcatgtgattttgtttaactgggaattaggatcactgtagggtatattcatcaatagttattaaagttaactaatgctttttatggttcgaatctgattgtaggagtagataggatgctgaattgctgataaccgcatgcttttggtttaggtagacatgcaatattcaatttaaccatgactaggttgaccttgagttttccttattattggcttgttctctttccacctcgttttgacggccctcatatttcttgttaggtaatgcaaagggtggtttacatgctagctaattctgtgaaaaaaatggtgattgcttttttccaaacaaacaaaccagcatgagctcattattacagtaccttatatgttatactagtcacagtacatgttacagatgtattttcctcctgtttgtattccttccacacaattgcgctggatacagtctttaaacttcttaattgggttgttgttttgaactttacccccatggcatatattagatatccttaacttcttttgttactataggtcatatgcacgcctcttcaaattgagaagttttctgacttctagggtcttaagtgagtaacagggatttcaggttaaacttgttctgattggtcttgtgttagtatttttggtttggctgagttgcataattgttgggcttttttctgtttgcatttggtggttttaacctatggtcagccctgccacaaatcatataggtaacacaaaaccattgttcattcggaagtcattacaacccacaggcctttttttattcaaaagtctctctttcaagaagcagcaaaatttgtgttatagtgcaagcaagcgatctgacttctaacctctgtgaatgcatatagttattaaaccaaaatactcaagtttttcataaatatggaattgacttatactgaataaactccacatctttattctggcctagccaagttgtgacagacaattgttcgaattgagaagctaagtgcctgtgtccaacacttaatttgcacacaaattttccaataaggctgtgttccatgtgtgcctgtgttccattctacgtatttcgtatgtaagagagccaataagcctgtaggatttagtgtcttgtgccttttcttgctttagtgagcccttttgttcggctttcctttctgtgatgttaagttgttcttcaacattcggcatatgttatgacagctaaaaattcatttgaactgccctggagagctgcctgacgtgatactacaacttgaggagtcaaccggatccattgctgttgaccaaattggtcgatctgtcattctatatcgtcctagcaccagtaagatgaaaaagagagaagaaagtgctaggaatagaacaagatttgtaagatctagagaaccatcagaagaacaacctagaagcagcacaagcaagagatttataaaatctggaggagcatttaggccacaacagaagagaagaccattagcatctaaggaatcgtcgtatgggcgaagatagatgccacattcaatccttcatcttgttttttttcattgtctagacttatggaaatcatgtaaactttagaccatctaatttgataatagatattagtgctgagtttttatcaaactatggtccaaccatatgctgtaaatttgtgtaggatcatttcctctttattcaaaaggaagttctaa

SEQ ID NO: 68247 - DNA, 3097 bp, Oryza sativa
  unsure (1)..(3097): unsure at all n locations
caaccgcaatgctctacccctattgcattatctccttgggatgaaacaagtgactatcaaggtgaagctgttgattctgctctatggggtgtccaagatgaccaaaacaatgaaatgtggtcattgtcttcaccaacacctactctccaaccttcaggttaatggaaatacctttttttaatcactttatttgtttgcttgataatatttaatcttgagatattctacaggtattggagctgataccaaaggtgcttcctgtgctatagaagaggtgatagtagcccaaggaaatagtggtgttgttgaaccgtcaccagcactggagaagaaaaggattgaaaaagtaccaagtgcttccatagatcgtggagtaccagagcaggtaatgctaacttaaatatttaaatactaggcaaaattcatcagcattatgcaaagagaatcctagcaacatgatgtacccaagttttaacagcagttttattttgacttgtttaggtaaaaccaaaatcagatgctgcattatctccagaagagagcagaaaaccttcaggtttgcaactatcaagcacatatctacaagggagcacaaaatcttcaggtttgccaccgtcaggcacatctctagatgggggcatagaaccttcaggtttgctaccttcaggaacttctttggagtggggtacaaaaatttcaggtgtgcaatcctcggcctcatctctagaggggagcaaaaaggcttttgttaggcaaccatcaggctcttcactagagggaaacacaaaagcgtcaggtaggcagccgtcaggttcatctatagaggggagtaagaaaccttctgataggcagccatcaggtgcatctcaagaggggaatacaaagccttcaggctggcaacaatctgtgtcgtctcttgaaggtggcacgaaaccttcaggctggaaaccttcaatttctatagacacgaatacaaaagcttcaggttggctgcgatcgagctcatctcctgatgtgggcagaaaagcttcagcatggcaatcatcaggttcttcgcctgttgcagggagctcaaaagcatcaggttggcagccatcacctcgcgagagctcgaaatctaagcctaattccacatggggtgccggccaaagccgcaactcgtcttcgcaccaatcaacaacaccaacagctaaatactcatcagaaaccccaaggagacaaggaaacaacaacacaaattctgctggctggggagactctctcggaaacaagagctggcattcaccctcaggcaatgcgagcagccgaggcagccattctagccaccaccatgaccggcacaatcagagcagcgaaccatggcgtggtggctcaaatcattccaggagatcagatcatcgtcaagaacatggcaacggtggctcgtcgagatcatcgtcgtcgagggggcaatctcaaagggggatctgtagatactacgagaatggctactgcaggaagggcacttcctgccagttcctccaccgttgaaaacgccctcacatttttgtacagccctaaatgatttctcactcactccgtagtcagcacagaagtgacctttatttaaccttctcggcaccactcagctgttagtaagtatatacatatccatcagcacaggagtatgattaagttagcattttatgcttggaaaaacagccactgatgtacggccacgactgtagatccttctctttaggtgaatgatgcattttgattgatcctgttaggtttagtggaattatgagttcacccgctttaaatctcccttgatcgcgtatgcaagaagcaaaattttgatatgtttgcactgtgttgtctcgtctccagaatttgtaattcaggcagcttgtttacctgggttactagaaatcggaagctgccgggctannnnnnnnnnnnnnnnnnnnnnnnnnnnnngacggctcgccggagcaatcctggcgtcgccgacatgggcagctccaggaacgaaacgattgtgttactgtgggttggaactaatcctccacgcaatgcaacgtaaagcgaaataatggattggtatataattaattatatgttagtaaaaaagcttttgttttaaaaaacatacttcctccgttccgttttatattttatattgtaaatcgtttctttctttctgctcaaatttctttaagtttaactaaactaggtttatatatatatataaaaatacagtagtgctttcaacccaaacaaacatattattaaaatatatttaattttagatttaatgaaacttatttaacattttagatgttgaaataaaaaacagttagattaaaagaaaaaaagaaagtcaaactggcttttggaaaagcagccgtgggttttggcttttgcaaaagtagctttggaaaagcagctacgaggaagtcaaaaacctgtttggttgatcagatgtgacttttggaaaaacttctcacttacgactggaccctgcctatcagcctcactgcattcatcctcctcctcacacggttcgcgtgggggctcgttgtcggggtgcgccggcctaggctcgtcggccagccatgaaggcagcgtgggacgagggaacaggcggcgacggggaagagcagacgcgcgtggtttggaggaggccggcgacgggagtcaggggatgcggtaggggaggagcttgccacctcgccgcaggtcgccgcctcgccgggaggagaaggggtggcgtcgggcggggtcggcataggatgaggaggagaaggtgcggcgtcgggcggggaggagcaggggcggcgccggccatagatgcgcctctccacccccactgctgcacgctagcggtgcgggaagacgcaagaggagtttatcgaatcgtttttttataatggtagaggtgggaaattttttctctcaaaagccagtgaaaacaggggtagaggctgcttttggatttgtactacactaaaagcagctttggagaaaaacacttacttcctccgtcccaaaatgtaagcatttttgaggttggcacgggtattaagaaagtaggtgagaatgattgaagaaa

SEQ ID NO: 68248 - DNA, 7706 bp, Oryza sativa
  unsure (1)..(7706): unsure at all n locations
taatgtgctcaaggctatagtttcaagcagttggaatctatagaactaccataccttcctggtagactcccacagctcctccttatctgaaactggtgcacctatcatcacagctctttcaacgagtccctctattcacaatgaaaggtcagccaaacaagctataaataaagtttcatatatgcacatagttaagaggtaccattatttcccaacaaagctagttcctccaaacacttgaagacaacacgtgcccctagggaaaacccgatgagagtgacaggcctagaaatcccagtaaaaaattagttccattgagaaatgaagtctactggattgtacattctaggcagagaattacctgcttccttgcaatcctctgagcagcacttcagcaagcattttcccagtcttatctgccctggaaacatctactcaattaatttcttgtgcgctcatgtaattttggaaaggataaaaaaagattaatgcatacattacagctttaagtttgttgcattttttcgtttttatcattgctcattagtttctttttcgcgaacgcattgctcattagtttcaagataattgtattctctgttctgttttcagcttttgtacaactaatgaaaaaaaagagaccagttttgtacagaaaagggaaaaatgcatcagcattagtttatgtaatgagagttcattatgtcacctgtcaatagcaatggaccatttactatcgataaaatctgcagcagataccaagtaagccggccatgcaaacgcagaaacaataccacttaacacagtttgcattgcaccttccctcatcaactcaattgcaaatcctacatcattaaccaacaaccggacaattttatgttgagtaatcagtaaagtatgaaagaaagaaataaacgcaaacactgtacacgtcgaacgccaaaattacttgatgccagccaatcgcgtattgctgtactgacgccaattatatgcttagactcccattgcagaatgtacctgccaattacaagtttcttgtacttaagcaaggcaaacatgttctagaaaatgcaacgatattgatagggacaacagctgcatgaatcttacctgtattcatctcatgtgaatattttggtttctaaacagaatgcaataggactatcatggctatgttaataccaaagtacttgcaaactacaaagagaactttttttttgaaaaagtatttcgtgtgaatgtcttttggggggttgtacctctctaagtttgtcttccatccttcccatggcttcatataatcttcctcggtaaaggcaaatccagtgaccaagatggcaactgctagccgctgaaatgtcaatcctattaagtgtcatccactcgaaaaagttttatcgaagactagggataacatctttgctttatgctctctgaacctttccaacatcgaatcaaaataacacaagagaacaaaaactcacaccctggttatggttctcgccgatagtgttgaactcaaattctctcacacaaccaattcttttggccattttggtcccagtcaacccagctccagcagctgattttcaagttaagatgctggttagttacagatcctgataaaagattcctgctgggttcagaaataaacacctccaaataaggaatagtatcaccaaattaatattcaaaaaccatctacgctcacctccgaatgatgcagcaaccgctacagagcctgcagtatgtccagcagcagtagctatagcagcaaacccactagctcctattaaagggataagtgtgtgcaatgttggaaccagagcagtgaatcctgcagcaattgctggagcagctaaacctgaaagttcagacgaaattattcagttacagaacttatcttgatctgacatttcataagttcatccaaatttctttcaggtcatatacccccggagatggccatcagcgttcctcccgtcaaggcggctgcgccgatgattcctccacgcttccagttctcccatctgcttcttggtgactcgcttccttctgactgttcttcctctctcgctgcagccatagcagagcaagcaaccattatctcgatagcttcctacaatgccaaaacgttcgattacaaaaacatatagtttgtgtccatgacaaaactggtagagagatcactgttcttagcgtgtgcatttacatgtacaactaggctttctttctatcctaatttcacatggacgagaatgctgtgctgttatccaaaaaaaaaagagaatgctgtgctaaatgtaccctgtcatgtgttctagacttctagcattttcatgaaaaaactaatctagtgatcacagataatgagactactggacactatggtcataaaacatttgatgcttaggacaagttagtcaaacttcttttgaaactttgaccatgaataattcctcgaaattcctagttaaaaaatggtgtaagcaaatttcccttgaatagtaatatcgtaacattgaaacttattgtattttataaactcattctaacaaaaaaattatatggtcatagttttacaagtttagaatcttgtcctaaacatcaaatcaaatactccatccgtcctaaaatataaataattttggctggttgtgacacattctagtagtacgaatctggacatagatgtgtcctatcctactccaataccttatattttgggacggatggactacctatgatcagagggagtgttagtgatcttatcttgtaagaaaagcaatggaatctctggacaaatcttaccatcttgatccacttgacgtcgagccatgtcgcgagcagccggagcgcgacgcggtggcgggcgtcgtagcccctcctgatgcgaggcgagcccatgccttcctccgccatgttcacgtcggcgacgcacgccgagaggagcatgtacagcaccgccatcttccggtaatccttggtgcggctgccgccggccgacgacgccgacgccagccacggccacccttcgtcgccgtcccccccggagccggtggccttgatcagctcgtcggccgcgactacgtcgttctccagccccatcgccatcgcctcgacggccttggcgagcgcgagctcctgctccgacctctccgccgccgccgcctcgccgtcgtcctcgtcctcgaacaccttccggagaaactgagaaggaaaaaaaaagtatgtcacgattgaatcgccatggaaatggttttacattggagattgcattggggcgcgtacggctccgatgtggtgcttgggctcggaggtggcggccgtcgtctccacgcccggccatgccttgtggtcgatctcgagaaacctgagagaaattcatcaatcaatggcgatccatcgatcgatttgatggggtttggagatggatacctgaggacggggcggaggaggccgtgggagtcgtgggtccagaggtggcgggcgtcgacggggtcggcgagagaggggactgcggcagcggcggccggggcgtcgtcgaggccgtgggatccgagcaggacggactggtggatctgcgcctggcggagcgcgagcgccaggagcgcccccgccgcgtaccgctgcgtctggctcagcgtcgacgacgtcgccattgccgcgatcggatggcttggctgaggctcgccggtgggcgtgggcgcgggcgcgaagccgatcgaggaatcggtgccactggcttagccgcggcgcgcgcgcggaggcgaggcgagggcgaggcgcgtgcgccgtgcggggcgtgtggcgcgtgtggcgcggtgggaatggctgcctggctcgatcggcgccaccccgtcgcgcgcgcggcgcggcatgtcgctcgcgcatggcggggcgcctcgcgaggtgcaagtggtgttcgcgtcctcgcgagcggatggcccagagacatttggatgggcctcaatcacggcccgtttacgtgtagccatacacttggatgggccgagattgaggcctagctaacgaggccgtaatgtgagatatttggaataagtttacctaccgtctctcaattttacatgagtatgtaggccatccctatcccaatatcaaaaatgtctaccctcaaatggtcaaagccatgcaaataggtctcatggcagtatatatgggtggctagtggttacagcgaatgagcatgtgtatatccaaggtaaagggcaagagactctgtcaattcatccaatgagtaagcaggacagttaagttagaaatcctttaagtccctcttgaatttaagtaaactccgaaggactcccagactagctccgcagtacgagccccatacggagccgcgcccttgtgatatgataagaagaaaaggggccaggccgccctcttttcttttccgcaccaagccttctcttcttgtaaaatcgggtgtannnnnnnnnnnnnnnnnnnnnnnnnnnnnnnnnnnnnnnnnnnnnnnnnnnnnnnnnacgtgacatcctagttagcaaggagggaataaaaaaaatttgtggaagcccacatgacatacttactcctccctctactctatccaacgtttgcctagaccatggtctggaccgtctagaccccgtctagacgcaagaccgtacataggtttttgtcttgtttagggcctaaacactattttcttgtctagatggtcaaagactgtctagtccaagtaattagaccatgctgagccaagtctagaccgaaacaatgatacctagaccatggatggacccaaaacatttggtgggtaggagttcaaattttctggcctaccaaggccaagatgatttaaatttgaagctaattgaagattcattattgcaaaacaaggtaaaccttaaatctcatcttttcttgctctcaaatgttctattgaacttttgacttgttgagtgaatttacatatatagcaacaaaatatgctggtagcataatatatggtatacactctagattgagagttaccgtccatctagcatctagcgtctaggtgaacactgactctatctcctctctctctctctccccccctctccagtagcgcaggcgggcggtgtcgggcaaagcgacagcgcacgaaacaggccaatggggcggagttgataataataataataataataataataataataataataataataataataataataaacacaaaccacaccacgtgccaataacataaaaatccaccgcaaaaaagaagcaaacacagtaacgtaacatcgtattctgactacactttgtcaatgcactatcaagtgtatcttaagatggatccgttaaaaccacataccttttgtcattgcactatcaagtacatcttaaggtggatccgttacgtagggcactcactgtactcttttttttgaagaaacactcactgcactctagcatcaaatcaaattaaagttccaaactatgatacagttccatgcatgcataccatgccaaatcaaactggacactttgcgcattcttcttcacatgcacatgaacacaacacagctatacgctatttggctgatagctggtctctcactctgaagaatatcagaacactaccacgaattgttcatgtcctggctagctttttgccgatggcttggcgatcgccatcaggcttatcatatcatgctatgatacgtagcttcaattttcgcccacctttccgacggtttgacgcggcccgtgtggatcgatcgccagcagatctcgccggccgatcgggcgccgtcgtcacgcctgaaaaaaaggcgacgagaagatggcagagaacgcatcgatctctgacgactaaatcccgaatattttcaagctcaaaagcgacctgtgtgatcctgaattcttcctgcgttgctcgcacggtagaattatattgtgccgtgcagcgacagagaaaacttgaaagaaaaatgatcgcaggcgttacatcagtgcgtgtcacgtcgggtttggtgcgatgctgtttggtacagtggcgaatctacgaaatttttatgagtcgagcctaacaataaattatatagtatacccaatttggtataggtcaatagattattttgggttgagttgagcatttactttgttggtttgtttaattaagtatgtacactataccattgcttctgctagtgactaaataattaggatgattaacaatagcaaagtaattagaattaatttactgaggcatggctctgcttctgccgctggtttggtagggtcgatgatcaaacagatcaaccgtatcgaaaacgttgagacgttgctacatacacacgatgaaaatccgaggcccacgatccatgagaaagtgacactgcgagaaaatcaataatttaattaagccatgttgctgaatttctcttaattttctcaggatttttcagcgccatctgaaattagatgcaattgatgatgaggacaagcgcacttgagctgtaaaactgacttttgattcaaatccgtacgcgttaaatccacgtcgtcggagaatggcgagaacgacaaaacacaacgcaccgaggacgccgacgccgtcgccgtcgccgccgccgccgccgccgccttttactgtcgataatatcgtctcgtcggcgtggaggtggagccggggccgcgcgctggccggtgcaggtgacgaccaagcctgccgtccattttgtgctcatgcctcacctcacgcagcccagctaatatgggtctgtttggttgcctgtaccaggcttggctcgtaccagaccatgcagatttggtatgtttggtttcctgcactggcccgtgatacaggatgaggcgatgcaaagagccgaagattgcctccgagccgggccgagcagaaacgcaggaatcgagcttcccaacttagcctggcttgacggatgcagtggcgctgcacccacgcaatagtgcatattgcacccgcgtgtgcaagggggagggggctagtcacctccccctcctcattttgcccgcgtaaagccacatggattgtataacggcaaataaccctgaatattaatgtgttataaagtaaaacaaaatcatcctattgatcattttaattttgatctaacaaagttatgagttgtttcatagtcaggtttttttaactgttatataatatattttattattttgatgcgatactaagctcatgattaatggtgtggcttagagttcctataccttccgtgggaaggttagtaccacctcacattagggcgataattgtaatgtgtgaattttatctctgtaatttgaaatcaagatttccaaatcttacggtaagatcgtggttaccaccgttaggtcgtgataactgtgctgtgaccatgatctttgacttgaaaaaagagagagaagaaaaccactatcatacattgtgaacaatagaaataccatatatgatatccacaactataataattaattatagtgtccacaagcatcaaacctttattacgaagcaaactctccttttagtcgtgccaaaatatggagttagctttgcattttttcacaaaatcaaatttatcactagatatcattattacaaatgctgtactacttctaggaaatttttaatttttccccctttttctccaaaatctaaattcatacaaattctaccaaac

SEQ ID NO: 68249 - DNA, 1440 bp, Oryza sativa
aacttaattttaaaaaaaatttaacataatttttttagcgttagcttttaaatcgctacgaacaaatatataaaagttttaactataaattaagttttatttcctaataaaccgttttgatttattaggtaacatgggttaccctgaacttttgatatagagtactcctgtttactccatcgtcaatgcagaccaatctttgggtatccattgatctactgttgttcagctgaatcaataattgttattgatgagaaaggatcaacaagtgcagcaacactgtcaaaagctgtcgcccgagcgaacacgaaccaagctggccctgcagcagcctggttgaacaatcacatgcggtggggttttgcaattgtactgcgacgctgtgacactgatgatcgatcgagagatgagtatggcgtggctcagttaaagctggagacatttcagactcattgcgccgctgtggcagggaccgcagaaggcaagtacgtacccctgcttttggcggcttcttcacagcggttaagagcagttacagtagcagagtagtataaccaacctataaacatatttcgaaaaaataaaaaagaatagagaaaagtagcggactataaatttataaatttatagctagctacagcacagactctaaaatatatgtgtatatgacaagtgagaccagtattaattgtgtggtgtatgtttacaggtaactattgcatgaattgattataaaattaactatagatgatttggagtcaatagttggctattctattaaatttgctctaatagtagtaattgtaacaagagacgtgttatccggatgaactgtacgatactacctctatagtaaaatataatgttttttacctatttatctcgtcattgaattatgaaatggagaatagagatgtactcactccatccaaaatataacaacttttaggcttttggatttttcataaaatataataacttttttatcaacattatctttccaaccaatcacaaccattctatcttcacttttcatcccatcacgatcttcttttatttgattctaccaactttcttaataaacgtgttcaaccctaaaaattcttatattctgggatggaggtggtagtatttatccactacatccattccagaataagttaatctaatacgaaatgtaacatattataatactaaaaatttggacatgtgacataacttattttgaaatggagggagtattgaattactcctgcaatgtatatacggttagacactccttttgaattgttcagttaactacttccttgttaacttcctatgttaagttgttttaattttttaattaaacttattcaaatttaatattttttaaaaaaatattaatacttttgatatgaaacaaacatattatatatatgtaaagtttgattagtgaaa

SEQ ID NO: 68250 - DNA, 7884 bp, Oryza sativa
agcggagggagtagcttttggccgtgttagttgttttggtaaaaacaattagcgtatacggacacacatttgaagtattaataacaaaaaaaattatagattccgcttgtaaactacaagacgaatctattaagcctaattaattcgtcactagcaaatatttattgtagcaccatattgtcaaatcatcgcgtaattagactctaaagattcgtctcacaatttacatgcaaactatgcaatttattgttttctgtccacatttaatgcttcgtgcatatgtccaaacatttgatgtggcggaaaatttggaagtttgaagggaactaaacatggcctctatctatctactgaacttctgccggtactcttatatacatgcctggtttagatggcaaaattttttgtttcgggtgtcacatcggatatacggacacatatttaaagtattaaacgttgtttaataacaaaacaaattatagattccactaggaaagtgcgaacgaatttataaagcctaattaatctgtcattagcaaatgtttactgtagaggcatattatcaaagcatgacgcaattaggcttaaaagattcgtctcacaatttacacgtaaactgtgtaattggttttttttcatatttaatacttcatatatgtgaaaagtttttttttaactaaacagggccagttagacactcttttttcactgttcagttaactagtgctagtaccttttggtttggtgcagcctcctgtgttctgtcgtgctgcggatggagctggactcctgtctctccagtgcggctggacctggagctggacggctcctcgtctcatcgctgtcccatggcgcgtcggcgccttttaccgggggcgtgacgccgtgacgggcaagcgagcgagctgcagacaccaccacacgcgtaccagcccaggccacgcgtcacgggctctcgtcactgcgtggcggtggggcgtcagcctcactcgcggcgtcttcgtcttccgtccttgtcaagcagtcccaactcataacactatacatgatttctataaattttactagacactactcttctaatgcaaacaccactattccatactttaatttaatgctacttatctcacataatgtcttggatattgtgtgaaaaccatgtctacataagacatggtttccttctctttcctcatttattcacttgccacatcattttttttcctaggtggtaacttatttaatgccatgacactatcttagtcgttgggttgggaatgtccttatatactattgttttaatttatacgatgtagagtataattgtactctttcatggagtagtatggacgtgtttgggagagattaaaattcagagacctagatggttgatagccagcttctgagaatctgaaaaagttatgtttatagcttctggcttgtaatttattttctagattctacaagtacagtttctcagaatctgtatcaaaagttgtactgtttagggagcttctgattctgcgaaaagctgcagcagctagaaggtccctcaaacaggccctatatatatatagtctcatgtctgtatctctcgtgtaagtaagggcttgtagttactccctccattttaggttataagacgttttgattttggtcaaagtcaaattttatctataaacttagttaagtttgaaacaaaatgacttataatatgaaacgggggactaattctttttttcaaaatataagaccgaaacgccgaaacttttatcatatgaaatccgatcactgtcatcaagtagtcacaatattacttgggagtattggaatcaaaattgttgtatttaaaacacaatatttcaaataagctgtcatggtcagagaaagtgactttgcaaaagaacatgatgaatgccgaacaaagagcgtcagtgaaagtttactcgttaacagagacacggcagggcccaatgcaaatcgcttcatgcggttggagaatacgaacaactcactgtgttggtcgcacatgttacacgtgctgtgctgcccattttctagtccttatcaccagctcttgagttcgcaggggctgtttggttcttaactaacattgccataactcattttaggcaatgttagacaagtgtgacttgccacactttttgtgggctacaaattgtaagccacatgtgtggcaaagttaggcaaaggattgagtctatgacatgtggggtagaacggtaagaaagtgtggcttgccataactatggcaatgaaccaaacacaaggctaaggaggtgtggcagcctaaggtgtggtgtggcaagttgaagcattgaaccaaacagccccatagactcgcagaacttgtttactttattgtcaaaaatgacttatcaaactgaaataataccaaagacggtcatgccattttaaaagagtggagaatattagagaatgacataatatcaaataaatagaatgggtgaggcttcaaactcaggtcgtctaacccaccaccttagggcagtctcaaccctccacctaggatggtgtctatggcattaactatattgccatgtaggacttttagcttatgttgcactatattaattaagagagagagtggagagaggaagaaacttggtctcatgcaagacacagtttcaacacgagaacctatgcactagacactatgaagttttgcattgggagataatagtgtcttcataatagatgaagaataaatatgattggtagagaagagagatgatgtatttattaatgatcactttaagaaaacatgggttgtagaatgtagtttttattgtgatgtcttattgatatggcaccatagacactgcttatggacactatgggttgggactgtccttatagagctagccgaaagacccatggacgtttctcggtcatgccattttaaacaattcaattctttgctaaaattgataaatatatggtaccatttattttgttaccaaatatacaagaaacatcatatttaatatatcctaccaaaaccgtgcatgctagtctacaggaatgcatacatatgggtacactggatatgagggaagaatgcatatatgtgggtacactaggcatgagggagctcaccaggaagcagcccgaggcagagaagctccaagcgtctccggtgatggtgagtggcatgccggcatcagaggtgacaatgacaccaaggacattccaatctggtacatgcacaccaaaaacatcgaatgcaggaggtggaatatcccctaaggttgtcactgctgcaggtaattgacatccaccgattgcggaggatttggcgccggtagcatttgaccggagttaaaaaaaggcgctgccgatctccttgatcggtccacggttgaaggagtttcatgagacgtttccttcctagatgctaggtgaatctcctggcgaagtgacttgatcagggatagtgtgaggtcgttggaacgttggcacgataccatagctacgctctacaccgtgctagcgtcacatgatcagggatagtgtgaggttgttggaacgttggcacgataccatagctacgctctacaccgcgctagcgacgaggtcatgttcctgggacttggcaagaaaaaaaagagagggttagtgcagctaggcaggatagacggcactggtaacggtatgatttatatcccgcctagcctactcgagctcaccgaacactgccattgtcttcctaggcggctggatgcctgaaatagtgtgagtgtgagaatgacatgagtggaaggagcaacgacaattttacaatagtaatgtagcgaaatccactttttaaaggtattttaacgaaacctgtttttgaggacgacataatatcaatctcctcgtcaccgagccacccgcagaaaactcaagaagggcagcggatcctcggccaccaccacgtactctcttcataaaaaaaaacttagccttacaatagaacaaatctggataaaaaaagaccctttctagtataatgaatttgaacaatgtccagtttcattgtataaaaatatcacctctaaataggttaagttttttcttttttttacggagagagtattccacgactagaggtggccaaatgggccgggccaaacgggcggcccggggcacggccgaacctgtagcaggcacggcccggcacggcctgctacagtaacgggccgtgccggcacggcacgagtagccgtgccgtgcttgggccgtggccgagcccgcgggccggcacggcacggcacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcaattggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacacagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcaatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttttgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattactttttttttaaacattttatttccatttttaattttttttccttatacatttcctttgcttttttttataaaaaaaacactgtgcactgcaggctggcgggctggcggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctatatccacgacccgtccatcgcgccgtgagcccaataactgcatccagccgagccagccaaccacgccatcaaaccccccaccccaatcgccgagcagcgcggggagccggggaaaattgaagcaccaaaacaaccgagacacactcacacaaaaagaaaaaagaa

SEQ ID NO: 68251 - DNA, 3260 bp, Oryza sativa
attcctgcagcccaaaaaagaaaataaaaagaaagaaaaaaccggggaccacgaccccaaaagcgctgccacccaccaccggccgcggccactctttcccctcctccgatccgtcgcttcgcccgttcgccggggccacgcgcgcgcaccggaggaggaggaggccgtgacttgagtgaggttttctcctctcttttttttaccgcggcgagttgttactgtttcaccgcgcctccctcccctcctcccccgccttttccatttcgagctcgcctccctcccgtcccctccgtgcttgcttcctcccctcccccacctcacccacctgcccgtggaggcggtgcgcgagagagagagagggagttagggttagggttttgggttgtcgagtgggtgggtggggtgaggggagtggtccatccatggacggggggacggggccgggggcggagctgctctcgccgggggaagccgagtggccgcccgagctccgcctcccgcctccgccgccgccgcatcctcctcctcctcccccgctcgagccggctccgccatccactccccagctccgcggcgaggcgtccccgcccccgcctccgcctccgcccgtgggaccacccggcgcggcggtggtggccgccgccgcgaggaaggaggcgtccgcgtccgccgaggggtttgatgactcgcacttcctcggatcgatcatgggggcgcccgcgcaccagcaccagcaccagcaccagcagccgcctgccgtggggccgccggtggtggtgaagaggaagagagggaggccgccgaagaacagggatggagcggcgccgcctccgccgcccaagccggtgaagaagagggaggacgacgaggacgtggtgtgcttcatctgcttcgacgggggcaatctcgtggtctgcgataaaaagtgcgtgtgcgcggttggcgcttgcatttctgcttatagtaccgtagcttcaatttcgtctgctcgtaaaaagctgaaccaaatgtcttccattttggggctgtaggggttgcacaaaagtctatcatcctgcttgcatcaagcgcgacgaatcattctttcgatctcgggcgaaatggacatgtggtaagctctcctgttggacttctgcttctttgtacttaacatctagtgattactgctgtgcacaccgagggcgcgttctaaaatgcgttttgaaactgatgattaaccgcacgcaaaatgacaaatgtgattagcatatgattaattgagtactgttaattattaataactagaaaaatgggtttatttgattttttaaagcaacttctgtatagaatctttacgcatgaaacacaccgtttaacagtttgaaaagcatactaacggaaatcgaggaattaataaaaccgaaatggagtttagaatgtgccgagtaggactaggattagtgtcatatcttatttgacgtacaattatagttgacgtaatggtggccataactgctgttaaaaaaggcatcttttgtggatactagatatataagtgcatttggtatgattgccttcccttctttgcaatgctatgaattttatgtacttgaatttaatgagcagattaggtcattctttttgccattttaccatctggaaagtacatccgtggtaaaatttattgggtatttgcatgtcctgactggtccgctaacaaaccaatagttcaatacgacttatcctgttcttgatgtcatgtttttcaggttggcacctatgcagcacctgtgaaaaggcagtacagtacatgtgctatacttgtacatactccctctgcaaaggttgcatcaaacaaaagccagtcaaattctttggtgtcagagggaataagggcttctgtgatacctgctatagcactatactgttgatagaatccaaagatgatcgtgccaaggtaacctgctgctaatccttatattccctctgtgtttcttgaattatatgaccatctatatgcaaatatgtctatagagttgtgcaaatatccattttctcagtcctttggacagcataatgctcatttttaacatttggttcaactaggcaccttcttttcaagttcatttgatattgaaaatcatgattaattaaggtcatagatatttctctgagtagtttgagaagtaataactgcagaacccaaagtcatggaatacatgaaatttgctatatctctattttgttgatccaatatattggcacaatgttttgtgagttgcaggcttgtaactatcagcttttgtaatgtaaagttggtggcttttgctgggtcaatttatccattccgttgtctattgcctttaggttgttgcgatgtgtggctttgatttggtttatgttgcagtgcagaactgtacttttagctcaagtgcatctgtaactaggaaatattggcgtaatcttcatgacttcatgtaatcttaccaacatagttctatcctcacacatcttgtatgaactaggcaacctaaaacaagtagcaatacacttttaccttgaagttctaaatgattttaggcttatatttacttggtaaaaataaataaagaggacttgctgaaacaaacatacaagctaaacttctcttctactttagttgcacaaatattagaaatctccattttgttgataagatactcagacattttgtatgacttgctattgatatgtgccttctaggctaaggtggacttcgatgataaaaataattgggaatatctcttcaagttgtattggttggatcttaaagggaaacactctctaacattggaagaacttgtcaatgccaaaagctgttggactgttcgtagcacttccgctaggagagaaaaggaagattcatccaatgacctctatgatgcaaattttgaccttgatgccagttctgatggcgcctcaagaaaacgaagacggaatagtttttcagggaaaaggggacggaaacgccaaaacaatggtgctgaaagcttacctaagagagtgcaaaatgaaggaatgacttttataggtgacacacaatgggcatcatcagagctcttggaattcattgggcacatgagaaatggtgatatttcttatatttcccaatttgatgttcagattcttctgcttgagtatgtaaagcaaaaaaatcttcgtgatcctcgcagaaaaagtcaaattatttgtgatgcgaggcttgccaatttgtttaggaaaccacatgttggccactttga

SEQ ID NO: 68252 - DNA, 9577 bp, Oryza sativa
ctacaaatgttggcgagcctcagttagtgcatgctgcaagtagagtagatacacaaagagcaaggctacacctaaacatggagatagcaacaagccaacatattagtagatgagaactttgaaagctcactatatttcgacgatttctgtttcgaggcatggcgccatggatcttgagagccatttgtgaacactattttagaagctgcaccatttttcatgcaaaatcgggaaaaaaatgtgagtatcaatttagcattcaggacaacagtgagaaaatctgaaatccagcagcgataaaaatctggtatctagaaagcagcacaaccatagtatgcagtatgcttacggttagtgtacaatgaaatttacagaccgtaccaaggtggcagctggactgctgaaattgttgattccatttcgcaggcatggataggccaatgattccacaaaaaaaatgctaatatacagagaataaaagctagctagagagacaaaccagcaattcttgtgcctccgtaatacaagtttgtcatgaacacatcaggataaacaccttcaccaaagacatttctgcataggtccaaatggtacctggagatatgcaaagcaaaaggcatatgtaatggtaaaagtattagctagtgaacttgattatatataccaaagagcaaaaacgtgagcaacagatagaaatcaaaagagtccaggatatctaagatacactgcattaagagattatcgaaggtgaaaatacagtcaaatagtatgctggcaatgacttcagtagaacatattgtggtgcaaacacggagtgatcacaacgagagtaatcgaaacatgacaatttcttaaacaggtacccaacccaaggcttgactgaaaaagaataagcatacagagatggaaaaaaaaacataggacattaccctgtattgatctctgtagagcgaatgctatcgtttttgggtgccacttgaaaataggcaacctcactgcaaacttggaaccaccaaagtctagaacctaaacataaatggcaatgcactatgggtattacattcatggcaaataacaagaaaacgatgtcatggtgtaactgcagtttggtttcgctagcaaaagagaacaaatagaaaatcatttactagtatcatcaggagtcgtattcttcaagtattcctgatcatatgaagatacagttgtcccccatcttctaatgaaaaaatcttgcacatactgagcatatgtttcctgtaaaaccagcacatgaaaattcaagaaggctggaatcaatgtacttttgcaaatgtactgccagaatacaatggttacacgaggataaataaaaaataataggtggcctatgcaaattaaatgaaaaggtacaatgtttaaagaacataattatgacatgattgttgatatgtcaagattaagttgaaaacccaggcacaattttcattaaaaaaaactggcacggcacaattggggtgggtatccaaggctctactatcccacttcatatggtgtagtaatcttaggcttgcttcttgagtgttgaaaataaacctggatgtataccagacccgtacattttactttgattgttgcatcagtgtatgtgtgattgtgtaatgtgtccgactgcatccttgatagattcagaagccgggtatttttttaactaaatgaaactttaactttctaaaaaaaagtcaaaactctggctattatcaaaagtaacagatgaattaccaccaaacttctcccggtcttcttcgcattgattagaggggagcatacagcatcaggactcccatattggaactgcaaaatggcataggttttcaacaaccaaaaatatatcttaaagttacagtgatatcataattcacatcatgcatactcctatggccgccgcatctgccaggaagaacaggaaatcaccatcatttttcaactgcaaatcaaaagtggattaaagcatgcgaaaatcctggaaacagagagattgtattcatcgtgtagaactagaggtacttttatgttacaaaagtaaaaaatgcacatcccaagtcctcaatcacaaggggttaccttctctgctccaaataaaaccttcacagagcggctgtccaaccgaagctgttcatcgacaagtctagttacctcctgaagggcagctttgcattcagggccagctgaatcccctacctacacaatggtagccatacaaaaaatttcatcagatccaaagtggattacacagaacagcagcatggatacaaggatcatgagttcatgactcaccatgatccttgtccatagcactggtgaaactgtactcctaaatcataattcctaacctgcttgtcaaagtcagtgaaattgtacacagcaagcaccacccctgagctcgcaaggcttccacatgtcaagtgagggaacttgagcctgaaccatgcactaagagcacccgagtacgataccccgaagacgaaccaaggattgtcaaaccccgatgatcgattgtacctagcattcaagatttcctacaaaagcaacaaaaccacacagagagagagagagagagagagagatcagaaaatcacgtgctaaatagtttatccccatttgaaacgcaggggaatttcacatgaatttgaccataaacagttcgatttacacgggaatagggagatttttcatgcatttcgtcgatctgaatcctgacctggtaatgctggcggaaggcgaccaggtcgaacagtgcctgcttggacgacaggaacctcaggttctccgtggtgaggctctcgaacggggagctcttgccgtagtaccggtgctccggcgtcaccacggcggcgccgaacttcttggaaaggacctacacggcggaggaaccccaacaaatcagcagaaatggcatcggcaaccgtcgatgggtttgcgatgtctcacggccaggtagtcgttggggatgccgttgcaggaggactcgccgcagatgcgcaggaacaccgggccgccgccggcgtggtagtcggcgaactcgtagtaccgctgcttgaactggcggtggtcctgcacgccgccggcgacatcagcgcgagggcgctaaacccaaagaacttttttgtttctcgcgacattacatatcagcccctgatattaaaactaatacaatccatgccctcgacgagtgaacaagccagagccactcagggatcgttttgagaaacagttttaatccagggggttttagagtaaaacaaaactaattcctccgaggaggaagacgaggaagaagacgactcacggtgggggagaagtggtcgaggcgctggtccatccaccgctcctccgtcgtcaggtgccggccggcggcgccaccgccggcggcgatcggctcggcgccgcgcgcgaggaggaggaggacgacggcgacggcgaggaggtggtggtggtggtggtggtggtggtggaggaaggcgacgcgaggacgagaccccatcgactccgtggctgagagactcttgttcgagtgttttgtttggccgagacgaggactcgactctcgaggagtactacagctattatactattatagtggacttttattattcttaggattaggaaaaaggaacaaaacgatgatttctaagagggggaaaaaatgaaaattaaacacaggatctgaacttgttgacgacaaattaagagttgagcagttacactgtacccgctccattgcgaaatgtaaaaagttttagttttatactaagtcaaattattcaaaaattaattaagtttagtttatagaggaatattaattcatccctttgtttacaaagtatttacaaccctaaaaaggtgccacattcttgaagtgtattacatcctaaatgtaagtataaaacttttgttccctttagtttaacgatttttttttgaaaatatccattttttttaaaacaaaattgcgtttatataaactagggcgaaaaatttgtgaaaatatacctattctgcagatcggttccgcgggagcgctaccaaagcgcggcgtggagcggacgacggaggcgctcgcgcggaatggggctgtgggaccgagcttgtcgtgaacttggaaccggctcgctctcgcagcaccagtgtgccgaaccgcggcgccatcttttttgttgtactgcatggcactgtgttcgacattgttctagtacttttgacactgttcgtgggtcggttccacacaatgaggacacggtactgatgtatgaacattgtcggacagtacttgaagtgtcggaacagtgctacatagggttgaaatcgctgggcaccgcggttccgtgtttgggaaccgcgggaccgtcgtcgttccgcgttttggagctaggggactgtgatggtcccgcacgactgtaccgcgggatcgtcggtcccgcgttttgaatctgtgggaccgtcatggtcccacatttctgtcctgtaggacggatatacttttgcaaaacctttccgtacatgtatataaaccatacatgtatataaacgtaaattattaaaaaaataagtatatttgcaatttttttctaactaacatcaaagagtaatgcatgatcgaagttaaagttgtcagttaattaaaaataagagattaacatctaccatgtcaaataacgaaacaatgaaaatatatttcataacggatataatgattttcatttcatatcttaaaaattttataaactgtcaaacttacgatagttatttcagaggaaaaaaaacatcggttttatatgttaaggatagaaggggcaccattcttgtgagattattggtaccggtagcctgggactcttaattagtaccaatcacccaatcagccaaccaaaccttgtgttatatattaggataattattcaagatagcttgtcttgttagcctttcttcagaaagctccacccatggacatatcggccaggctagcttcttgtgcgattgaaaacgatgcaggcgtctctcacgttaaacattcttttgtgtaggatatagcaggtgatttatcttgtacttagctcagtagtaacattttacatatcattggcactcttctgcagagaaaagcctgagagttacctgtaaggttattgacaaattataatcgacagtgattatctggtacttatcttatattttcaccggaagactgaacgagttcatccgaacgtattaaaaaggagaatagttataaagaacggtgtaccaaagtgtacgcccaagcaccacacgctaaccacacaagcacaaatcgctaagagtggggcctagcaccaaaatggcccccactaagtgtggttgatcgccgccaggcctatgacaacaccacaaagacaagacttcgaaaatgatgccaccacagaggtcacgacatcaaggatgttgccattgtccatttaagaaagatgtgattttcacccagagaaactcgtcgagaaaagaaagaggtaccctcgacaatatcccaaggggttacaacgcccgaaggcgtaaccattaccagcctagtgaactaccaagttaggcttttgcctggaacccctacaaccttacttgtagttcgccgcccactaactcagaaaccaccacacaggcattggcagcacgtggcctccaccacaccgtatcggcgccccctccaccgaccgacttccaaacttgccactccatccaccccccccactccgccccgagcgagagctggcccaggcccccttcgtcccgccactcgccagccttcttagatttggcccaaaagaatatcttgtagtagtagcagcagtgtttgagcaattattacggccgtacgtcctgagaatgtttgatcgataacatgagaatgattggaacactcaactgtctgtcttttagtgtgattgtcctggccttcaaactaacaaatggttgttggtagctcgagcagataatcagtaagcagctacgctccatccactctatatatgccctgagatattaggtagatcaacaatgaaattgacgaaaactgaattgaatttgaagggaattacagatgtgcttggctcaaaatgcagaggctctgagcaaattatatcgggagccattggttagaaaaaatgttcacgatcactatagctcaaatggtacaatagctggagtgctggacagctagcaaaactaacctttggtccgtcttgcattttttatgaacaatgcgatcgacaatctgctctatattttgcttcacagcttccgagatgcacttgacaacgagtgataaaggatatgtggttttaaccttgagattccgtatccaatcctcaacatactcataattcttagaaaaatattcagagggacatatctcctttcaaatcttgaaaaaaaaaaacttcacagcttctgaagatggacagttcttcactaagagatatcgatggattaccatattgcatcatcactcatcagtaagaaacatcgatcttactactccattaaaaaaaagtaaattttagctacgaatctggacacgtttgtagttaggattggattttcttttggatgaagggggtacagttgaaggatctggatgattagacgagcgatggatcaggtactaatccgaaggagggagagagaggccagggtttaaaggaggttttgttctgaggaatttctctcttctttttttttcttcggagaggggcttgttcgtttcttcttcctcgcgccgcgcgctccaatccgatccgccctgcttgatcaaaaccctagcgatcgaattcccccctccccattgcgagctagtggtggccaaaatcggccatggcccctgactgcgtcttgctcgaccgctacgtcaccttcctcgacgaccccgcaccggcaagcgacgaggtcgatcgccggcggcgaacccggacgacctcagagacgggatcgccgcctacctgcgtgccatgaggccgcgcgcgcaggtggagagaatcccccgcgggtcacctacctcgccatggtgcggccgccgccgtcgtcggatgacgatcccctcgtcccgcagttcgggcggcagatcgactccggcgtcgtcgcggcggccggcggcaacctcgtcgccctctacgccggcccgtaccgccccgcctcctcgtccatggggtgctacctcgtctacgacgccgccgcccgatcgagttcgccgccgctctccacggtccccggcgtcccctactccgactcccactcgagccccggccgcgcgaccgtcatcgcgccagccgccaccggcggcggattcatggatggccacagtgtactaccaccgtcgaccgccgagatcaccatcaccacatggacactcgatctacaggatgatcattcgacgtcaacacaaaactggacgaatcgggaagcataacttcaaactaaaagtgaacaagaacaggggtctgaagtaagctgtgacatgtacaagtaccacccttgacaaatgtacatgtgagcaggctattaaaatggaatgccttggaatatacattagaatggtatgtgggtgttccttactgttagaaactagtggtccacaatttgatatggaaataacaaattttggtacacagttcttgttgcagctagctgtcttctggctttcttttattctaaagttgttcgaatttgtagtcctgaaaggaagaagttgttatacataactccactttgcactgcacttaacattgtgatagggcagactttttttttttggaagtagataaagtctaaagagtcactctgatcaattttaacaaagtatgtgtgacaaatatatctgtttctgctagattgggcttctaagcagtggaggtaagtgcaaaaaggatgaagatttgatgatctacgatgcattgtcaagtgatgtgatgaagccttaatattatggtatgatttttcatagcttctgtggagaacaaggttgaatgtgttttagtttatctagaaggttgatcttattatcaagtagtactggtggtttgatcctgaatgtgtggttgtctaataaccatgcagtaccactggtggcttgatccttaatgtgtggcctaaatccttcctatatgacttcttttaatactgttccgtgcataaattgcattttatgtgttgcctgtactccccctagtcacaaatgctttataccattgacatttttggcctcctaggtttaactttgatcattacttttctattaaaatataactataatatctataagatgtatcccttatggtcaggcttttctaagaaaaaaagatgtagtcatatctcatgttaaaaatggttggagtaggatgtacccggttatctaatatcttagtctcatgaataaacaaagtttatcttgtacataattcagtaacattttacatatcatggtaatcttctgcagaatgggggagcctgagagcaacctgtaaggttattgacaaatgacagaggtcgtcaccatagtagtgtttgagcaattgttaccgcagtcctgaggataatgcttggtaccatgagaatgcttggaacaaccaactgtccgtattatttgagtgaatcatactagtctaaatgacagctgcattgtcttgtactcatggccttttgaacatatggttggtagctcgagcaggtaatcagtaagtagctatgctccatctactgcccagcaatggctcattgtcgtgtcctgagattaggtagagcaaagatgtcattgaccaaaattgaatttgaagtgaactgcaaatgtgtttgtcacgaagtcagagtgatcgagaaaagcagaagctcagaacaactaatatggatgtattagttataactttcttttttttttttgcaatcactatagttcaatagtataatagctggacagccaaaaccaaccttgctcttgacattctgataaccataaatcaatgtgatcgacgatctgctttcttactttgttcacagcttctggagatgaacaattagacgagtcacctggtaaacacaaaatacaaacatattatgggcttggtcacaactcacaactcaaactagagacttgatatatcttaatactagacgaggcaaagacagttatcaagtctctagtttaagttaaaatctacagctaaaaaggaaagtcacattttccctgcagtactgtcctcaagagaggcttcagcaaaggctggaatgttggatgtaccttcaatatgtgaaggagcttgagggcatccagatagatcactgcaatgtccgcaattgctgcactcaattaagtatgacggcactgtacccattgaaaaataatttgtaagcatatcataatgccataaaaaatgcattcacactatttaaccatgctcatatgagatacaaaaacagtgctattgaaacaaagaaatggccaggactgtacagatgctcacattcttttgatgatttctgcttagaagcatggcgccatggatacttgaggggctgcaggaat

SEQ ID NO: 68253 - DNA, 1199 bp, Oryza sativa
tgtcttgctaattgcatattagtaacagggaaaacaaattctgataaataccttcaccggcagcaataaaagaaagagcatgccctggagataaaacaacttcttcttttatgccttctacatatgttccctagagcaaaaaggaagcaattcgtaagctcacaaataaaagagccacagaagtagatatcccgtagaaaaagctatatgtgcatataacttagctagaacactatgtgaacaaggaaaagcctagcaaagttagatatgaaaatattatgacacgcacaatgaatataaattacaaaatgattaaaaacttttcatgttcatcaatgtctgaaccaaatggcactccacaaaaaacaggccacattttgactttaacgaattcattacaaaatgagaatcgcacaaactgtttccacgcatcaaaataggagtgaatttatatttcagtacacactacacaacaatcaaatcctctgttctgatatcatagagatctaaatattccgttagaagtttagaacttttaaaagaaccattgtgccatgataaaacaaacaaggtctgaaggaaggtagtttgtctgctacagcattatctatatcaacagaagagaagtttacttgcctaaaaaggacaattagatgtaacagttgaaagcaaaagaagggatctcaaggggggtatgcaaacaaataaattagagcaccgatattatatagaagtacatgccaacatgataaccaatgctgtagaggattaacctgtgcatcttccctcacacgcagattttggccagtaggatcaagtagatcatttatcacctgcaatgagagagaaattaaatccattgagatgaatgtacataactacatatagaatacaactaaatctaacaaacctcaaaatttgacaagacctcttaaataaatgtggcactgcccatagtcataggtatcacttggacagtatttacactataggattggaaatatgaaggctaggcagtaactaactgcaaagctggaaacagaagaatatagccagcagaaatggttgtggattacaagggcaatggtgcagccagtaaattctatatgtatatatgagaacaattttatgcacaatctgggtaggtcatcaaccaatcctttggtgaaggcatgaagggcaagttcaaaaataactga

SEQ ID NO: 68254 - DNA, 2519 bp, Oryza sativa
attcctgcagccttaatatgtgaatgtcagtactgcaagtctgaaacatctcagaagttaaaacactaaatgaaatgatatggacaacagcaacaaacattgtacaaggaaaggtaatttgttcaatatgatatggtagagaacagtttggaatgaagtgtgtgccatcatggtgataatatattacaatatgaccatagagtaactctcgaacaataattgtcctccatcagatataaataaatggaaaactcatgaaacaatgtgtcggacaatctaaataaggataggtgacataccatttataccctccatggcacctttaacaacaggccgggcagcaacatcatatacagcctcagtagttgttttaggaccaaaaactctatctgaaaagaaacagcagtaaaaaaatgattggttattaagtagaaaccagatgataccatagagaacagcatcacaaaatgtgatattgttcttaatatgaacattgaaggtttgcattgatttcagtcaagttgattgaccatgaccagaaacataattacagtcgccagaaagcacagaacaaatgcttaataactggttgagggagtaggccatgaaacttcttgaatgaaaacattgatgtcaatttcattaatcttatagcataccaaataattgcaatcgggaactagcagtcttctgaaagacgaccacagtacaagcagcatgaaaaggcaacaaggcaatgaaacctcacgggcagtgttttagattttagctggctatcaacttcacagtaaaagctgactcttaaaatgtcgcgaaaatgcaaaacgaagaactgcattttcaattttcaattaatcatcaagccttgtcccagcgctgatgcatttatgcctatccaaaatcctaagcctctccttagtgatttcagcattgtgcgacttatcccataaatctgcggctgtgaacatccgacattggctgaacccatgaattcaatcccaagccccaaaattacagaaagctcaaatgtactattcaaatcaccacattgccaaattaaccgcacaagcaactgaagcatagtacttaccgtaaccataagccgtcgccgggttgtactcgcagcgcacaagccgttccccatcagcataccacgagatctcgtcgccgcgctggatctcccgctcgctgcagccacgcccaaatccagctcaaatcagtcgaaatactcacaaccacgccccgcaaacagatccgcgcagctcacactcccagatccccctcacctgagcggccggaagcggatggtgacggatatgctgtccccggatcgggaggtgtcctcgatgacgagctcctccgcgctggggaacggcacgggcgacggcggcgacggaaccggccccaccaaggaggaggaggagctccccctccgccccggggtggtggacctcgagcctcccccgctcccacccccgccgccgaagaaatgggaggatgaggacacggacgacgccgtggagtacgaccgcggcatgaggcggcccgtgaggtacgagccggcggaggacgacgacgaggtcggaggccgcctgctccccgccgagaacggcgagctgctccgcctcgacgacgccgacgacgacggcctcgacgacatcccgcacggaaaccgaagcttccctccccccacctcccccccgcaaggcgacgctgcgcggcgcgacgcggcgcggcgggggagctcgacggcgagagcgcgcggaggcggaggcgagacgcggcggaagaggggaaggtatcggaaggtcagaggcttcacatggccttgctccaaaagaggcgagaggccacggcgttgcgagtttttaaagcgagacgccaacgcgacgcagagggaggtaggaggcgactgtactacacgtgtcagcctccgcggcgctgacgcgcggggcccacggtgcacgggcccacctaccagtgacggcggtggggctcggtaatttgaaatgcgtggacaggttgcgggtggtgggcgggaataactgcgaggaggggtgtttatttattttcggggaggggtaaaaagtgaaaagcggagaagcgtagggggcgaggtgaaaaaaataccccaaaaaagggcaggtggtgtgccggtgcggtggcgcaccagcttttgattggtttattgcacttttcccaacccgttggtttgttgtttgttgttgttttcgatgtgatttgaaattagaatttgaaatttttcgtgataatgaccggcgctcggatgtggtctggtctctgttttcaaatgggaggatgagaagttgacaggggacgctcttaacaagatggaaagtacagtttaaatcaagcgtttgtctgtttcttataacttgtacttcctccgtcgcatttcaagcataaccataatttttcgtatttaactttgattgtccgtctaattttaatttttttttataattagtatttatgttgttattagatgacaaaacata

SEQ ID NO: 68255 - DNA, 11780 bp, Oryza sativa
atcaaatatttggacacatgcatagtgcattagatgtggagaaaaaaaaccaatggcacagtttacatgtaaatcgcgagatgaatcttttaaacctaattacgccatgatttgataatgtgctgctgcattaaatatttgctaatgatggattaattgggcttaatagatttgtctcgcagtttacaggcggaatctataatttgttttgttattagtctatgtttaataattcaaatgtatatccgtatacttaaaaaataaatttggcacacgaactaaacacaacctcggtttatataagcagttgagccaccaccttataacttagtagttgtctgtggaacatatcaaatactcccttcgtccaaaaaaaaataatcaagggtttgaacttggacacacactgtaaatcagatcaaacaacacacaaaaattacatgtctctatcacaatgttccatagcaacacacatttccaccacaaattcacagaaaattatctatttaataaaattggcagcttaccggttcgttaaaaaaaacaaattcacggaaaaaggtgaagaagatgggtcaaagaccaacaataaaagagctcgcctgcattagctcacaatcgtcaagctcatcattggtcccgtcctctcccacctcgatcaacttctatcttggcgacttagcatggtgcggtggtggtagggcaagcaactcccaagattcgtcgctcctgagtttgcggaagtcgtcactacttgtcgagcctcaccgatggcagatccttggggatctgggcctcgacaaagtggctgacgcggcccttggccgtgacggggacggtaacaacatccttgatgccccaaaacactagcgggcagaaaccaatacatatacccatgtcccgcgtgtatgggtaacccagtgggctaagtaacatatgaataatatctatatggacaaataattaaaagtctttaacactgctagcaaagttcacaacaattgttaataatagcaggttttagagatctacgggatcttccattgtcatcacaagtagagttcttttatagccgttagtaccaccccaaaaaaaaaagaaacatacatatgggaaatatctttttttttttaagaaatacgttccgagacattttgatgtttttaaggaaacatttgacagcatccatcaaacggttacacttcacgtgcatagtctttaaaaaaaaagggaaactagtacacaaaacagaggtcacagtaaaccgtacagtaaaccatatcgcatttgtgatccgtcctgaaagacgggacagcaccaaatgccgggcggccggtgcagatcggaatccccaagttaggaggatggtgacgatgtcaaggcacaacgcgatgacagcaacgagtggacgaagagggatcaggcccagctggggcagctggtgagtcgatcgatccgcccctttctactgttcggggcgcgcgctgcacgagagccacaatacacgagatggaggaggaggaggagcacgtggtctcggccacctgatcacgctcgcgtccacggatcgttcggtggcgaaggcgatggaacggtagtagatgtagaactagcctggaccgtgcgtgtatactgcccgcttttggtctttgcgtgcagcgcccaacaatcgcgctgttgcgactcgcgaatgaggaatatatacgtcgctcccaaactggttctcgtggtgaaaacgttttctgaacgttcacggaactggatgagacctttttttttaattgctaaatcacatctgacatacattttgagccaaaaaatttacagactttcaacttcaagatctgtttcactattagtgctctgatgagcctacgtcctctcctccagcgctgatgacccttttcctttagctttgatgaccatggcgatcggtagcggagtgggagggtgcggagaggagggttggccagttggtcatgggaggcgttagaacgggcgggcggcgccaccttcgaagctgtggggttggtaaccggcggtgagctaatgatgtaacggtaacagtagggattgcaattgactagttataatataaggacggtggctgtgtttctccaacaatatgggaagatggtggggtgggacactcgccgcctttagcttggggaggaggaggagggaagaggttgattgagtgggcctcattggtgatgtcttttgatgcgggcaaggccaggcagtggaggaggcaaccaagcgaccttgcgctcgctcacatgcatatgggagaagtggagtaaaatgataggttgcttcgtgcacggttcaaaaattttgagagtggggttttcttattacatatataggtggtatttttctcttttaaggcttccaacctcgtttacagcagagttttagatgagatcctgatcgaagcacacgtttacagcctatggctggtgaattatgaaggagtgaaatgtacccaccatctagggagtgaaatctctcacccatgtactttgcttctaaatatttatacgaataaacgggccttaaaaaagaacttctgcttgtaatacaacgtttccatagctaaagtggccgtgaaacattttgtgcatgaacaatctaattttccagaaacgcataaaaagtttaggtttgtagatctgaagagcaaaactgaaaacttattatttattcgagtgggaaaagtccattttacaccctcgaactcttatgcttgtttaaaatacacccccgaactacaaaaccgggtataatacactcttgaattgtcaatatcggacacttaaccccccgggctgtttttaccgtggtttttgccacgtcagccctcgccacgtcaggacacaaggtaatatgggccaagcccatactctgttcgttcttctctccctccctgttcgttcttctcttcctcacgaccactggcggcagcggcacggatctgcgaggccggcgatggctgcggcggcggtgcggagctgttgcgagggcggcggtgctgcgaaggttgaatatgaaaacattttatgtttttgtaaatggaacctgatagattgaaaaaaaaaagagagtagaagaatgcatcactttaagcatttgatgtatttcctttgttcctcgaaatttgcagagaggaatcggccactaaactatcctgcttagccacaagaagatcggccctcttatggcacagcacacacatgcaaacaaccatcatcaatcgtctcaaacacaatcaatcttacaaagcacgataaaaaattcctgtccttccacagatcaacagcgggcaccgcctttcctctcagatcgaacacctccaccccctgcaccccctgcagagatttcgcgagctcttccaccggcgccgcagctgcctccccggtcgtccctacaaatatcatcgcacatatcaacggttcagcaccatgcacgcgaggggaaggaggagcggggcctggaggcttaccgacggcctcgggctttgcggctgctactggcgcaatagagaagcaaaggcggcgcgggtggaggagggacccgcactggcccctcgcgcggaggagactcaacaccgtagccggtcgcgagctggtagtggccacgtgtggaacggggagccgccgccgcagctccgtcctcacagccgtcaccgccctcgcagcagctccgcgctgctgccgctagcggacgtgaggaagaggaacgaacaggggagggagagaagaatgaacagagtatgggcttggcccatattaccttgtgtgttgacatggtgagggctgacgtggcaaaaaccacggtaaaaacagcccggggggggggttaagtgtccggtattgacagttcgagggtgtattatacccggttttgtagttcggaggtgtattttagacacgcataagagttcaagggtgtaaaatagacttttccctattcgagtagatgttgaatggaatttcattagcgacgagtaaagcatttcatcagttccattggatttgtcaccatccatttgtcagcaaggacggcccactacaacgcaaaaccagtgctggaaagcccagaatacacaggcagagatgccgggtagccattacgacccatttaaatggatttggactcctaatttgggaggtcgttgagtactttgaattagactccgagcccctgtattttcacgaattaaatttgaaaatatattcttcgttcttttttctctctgaaatattcttgatgcggtttttttgtcacaaatatatcttcgatatcgctgaaagtgatggtggagtgacgacgtgggtggtctcgcacggtgaggacacgagaccacgtggtgttggtcttgcgcggagagggtgcgaaaccgagcagtctcgcattatcagcctgcgagagtgttggaaatgaaatgattagtgattaattaatcattgattagcgtccaagaacagcatgctggctggtctcgcttgttggtcatgcaagactgacaccgagcagtctcgcgcgggaccgcaataccaactgtatatttgtgtcgataaaactacatcaatatttttgagaaaagaaaaaacacaatatactttcaaaattaattcgtattttcacttgcttggttgattaaccttggaaacaccgtattgaaatcaaagccaaacacaactttatgtggttttaaataaactagaagattcataaattcatattactaatacagcccatctaaattggacttggattcgttaatgttgtttgggccttttctcaaaaaaaaaaaacatatacgaaaaagtttagaaattcagattactaatacgacccatccaaattggattactaatttgttggtgttgttgagcaggagagtttgtggggtttggagaattggactccgacccccatattttcacatgtttggctgtttcactatgaaaacactgcattgaaattcgaaaccaacacaaatttatgtggttgtacatatatgaaaaagttcagaaatttagattactaatacgacccatctaaattggattactaatttgtcgatgttgttgggcaggggagtcagggggccgacccccatattatcacctgttttagctatttcacttaccgaaacgtaatggaaaaatgtgaacaaaaccacttgggtatggtaaataaagcgccgtactgaaattccaatccaagcatgacatctagaggaataattaaaaaaagagagaggagaaatcccgaaaattcagattactaagatcgttttgagtggtatatactggcacaaatcttgcatggatttacagcagaggggacatattttcatcacacatagtctaagcacaattttgctcagtatacattgcagagatcccatcatcattttgttaacgtctcactgacagttggctacgcagtttttgggacaatttttctcaattatcaatgtcggaacagggaaaattacacaatttgtcaaataggaaattaaataaaaccttacaccattcgcacagcaagatgcccatcaccccggtgcatcggcgtgcatttttattctgagttctgacacatcacacacaactcgaactattatactctgccgttctggacgaagcaaaacggggtttattacacgcccccaaggtctcatttgaaaaggcctcaaacccggcccatctacgtgaatggaccgaaaattttcaaccaaaatcacggcccatattcacgcggatttctcttggtgttcggcccatgtggaacaaggcccaaggatgacacgactgatttttttttaattggaagccatataatttgttcaggttaactacgtcgtgtataataatttgtttttatggatatggatttggatatgatttggatcagcggcggaagctgcgctgggggcgcggggtctcgccgttctcgtcgcggagcttcaccgccgtgtacacgccggcgccggcgaccgcgcccagcgtcggcgcgatcaggtatatccacagctgccggtagttgcccgccgccaccgccggccccagcgtcctcaccgggttcatcgaccctcctgtcgtcggcctgcaccgcacccacgccgccggttagccggagatcaaatccatccattttttttttgtttgttggaaccatgacaccctaattttgtaaaatttaaaatatgccacccgtatctcaatgacacgtaggaaccacataagttaatgtcatgtgggtcagggtgtcatatcacaaattttacaaaatttataaaatttgtgtggcatggttcaaattttcttttttttttggaaatccatccatttttagtgctcattgtttcatattataggtcgttttatttttttttcaaaatttccttttccaaatttatagaaaatagtttttaataaaactaacttttaatatgtttatttatgttagaaatgttactatattcttatataaatttaataaacttgcaatataacacagaggcagtaacgtgctacgagcagggttcaaaaattctgaaatgaaatttccaaaattttggttattttggatcccctatgtgattatttcggccaattttttttattttggtaataatttgcttaatttgactaaaatttgatccaaatttcggtatatcgacacgttccgatagaaacattcaaactgaaagattaaaacctggctacaaggaggaggaagaggattatacgtacccggcgatgaggatgttgagggtgacggcggcgccgacggcgatgccggcgagctcgccgacggcgcgggtgtcggtggcgacggcggtgacgacgaagaggaggttgaaggtgatgatgaactcggtgaagaaggcctgggcggtggagatggtggggtcggggacggtgacgccgccggagaggaaggggtggaagacgcccttgagggcgaagccggcgcagatggagccgagcacctggacggcgacgtacgccgggacctgcagccacgggaagtggcggagcgcggcgaaggcgatggtgagcgacgggttgaggtgggcgccggagatgtgccccgtcgacaggatgatggtcgtcacggcgagccccgcgcacgccgcgttcccgaacggcgagatcgcgccgccgtacttctggttcacgatcggcgccgccgtcgcgaagaagatgaggatgaacgtccccacgaactccgctccaagctgcaccgcagtttaattatttgttcagcgttaatctcccagcttaattaacacactcatacagattactataatttacgagttcatgaattcataacggagctctcttttaaaaaaaaagtgaattcataatagagttaaaaacttgtttagatctaaaaaaattttggccaaaaacatcacatcaaatatttagacacatacatggagcattaaatatgggaaaaaaaccaattgcatagtttgtatgtattatgagacgaatcttttaaacttaattacgccatgatttgactatgtgatgctacagtaaacatttgctaataatgaattaattaggcttaataaattcgtctcgcagtttacaagcggaatatgtaattaatctaagtttaatacttcaaatgtgtgtccgtatacttcaaaaattttacacctaaaaactaaacacaccataactgtaactgtatatgaatcgtgtaaatttgcaatcaatttaagacactctctctttgatgattaatttactgtttgattgatcaatcaagcaaattgagctggacatttcagtttcagaagtactttcaaaagtccatccaaaagtctatggatactttcaagtgcgtctgattgattatgtggcaatgctaaactgcaaaaaggtgtaatcagacacaaaagtttgtgattgcgtacttctgaatttagcgagattttggtcgtgacaaaaagaacagtaggaatgtgggatcatcaggcactaatcaaaagctgaaacgacatatatgtttataaagttttgtttctgtgcatgataacaaaattacccgcttttagtccaaaagaatcacacagcaatgtcccgttgaaattttacactaaaaccatgcgcttttcgcaaataatcatgaaccaataattctgcggcgattatgtcaaatcatgaactgattaccctcccagaaaaagaaacgaaaaccagggacagattagacatgacaggcacatagcaaagcaaccactctctcctcacggatggatggctcgaagcgatcgttgagtcaactctgaattttggacacggccctctcatgtcacatccaaaaaaaaccttatcaccaaaaatcattgtactttctcgctcgcacgtttttttattttaaaaaatgcatttttgtcatcgacttcaacagtgccattgataggagtagtatttaattttctttttccaaatggtaagtactccaaatggagtacaacatgaccaaatttttaatcgaatcatcagttctggatttctgaaattgcgatgggttatgggacacacagggatggcgtgaacagtaaacgcggacttgacagacaaaccgccggattacgcgcgccgccgccgactgacgccgagcaaggccaagaaaattcagcatctttgcaggttttatactcacaaaattaatcaaacatgatgtaggctagctaggacctaatcgccttaggtagtactgtactgtttgatcccatcagtgatcattgacaatataaaattcagcttccaaagatgagcattgcgtgttttctttgtagacggcaagataaatagtattagttaaatggagtacatggaccttcgattaaggacatccacaatgtactacaaaaagtagtctataggaaataaactattccattcagccatctagtaacataaataatattatctatctctacttctctgtcttctcctaatattacattgtatctatatacattgtgaggattgctatagttaaagtttattatatgggtcccatctatatagaccacttttgccatatacattggtgatgtcctaagggattgttttgaagataagagttccacggtaatttggtatgtatttcattgtaatttggtttaacttcgttataacatcattattggttttcttcacttatgcttatacttataagctaaaatttaaattctaaaacttaattttgaaattcgtaattcattttacaacactagcttttaaatactaagaacatgttaaaatttttactcccaaatttttatttgtttgctaataaaaactacgaatatgcataagcaaaagccaattgatgactccgtaagtttgatgacggcaatatcttcacacaccacacatgagtttgatttcaacgttcgaactgaattttgaaacttttaaaggtttgtttgaaacacactgaatacaatgcggttgcttgaatcgtcagaatattttaaaatttctcacggaggaccattgccagagtggacctgtgtaaaattttgagtctgcaggttcggatccaacaaagctctgctgacggcacccctgattccagtgtgttagcactgtgtaagtacagatctaaccactgtcacttccttaattaatcacctactgaaaccgcgtcagtgtgatgttgctcttttgtctccatacgtcactgttaacacatttcatttcaaaaagtacatgtaccccatgtaacatccaaactttataccaccgttatataactttttttagcaattttacggtccttaaagaggtaccatgagttattattttttctattgtaaatttggtacctcttggtaactaggtactatgaggtaccatgagttattaaattttacactaaaattttggtacctcaaggaccgtagaattgctctttttaaaaaatgattttgcatgatatatggttttctgaatgagcactttggccaaatagaagagcatgttggtactctatatatcaaccctccatttttatttttgatttctttctaagaagagaaatataaggggagaaactgttcaatatttagggggaatatacggaatttttttcctcttagagactaattaatcgtcacttatttagaaatggcacctagtaatttaaaactaaccaaaaggacattggatcatacccaacttggccgtataatataccgtgtatattacggaaaaaaatactagtactattcagcaactagcaataggacgatcgatcagttcctctgacttttttatttctgaagcttcgtgacaaacaaaaatcatgtgtttcattgtctgttgtgtatactctctttgtctcgtaaaaaaaaaatccagatttattgcactgaaaaaaaaaattcctgctaggaataggacgatcgatcagttcctctgactttttatttttatttttctgaagcagatggatgccagagagtatttttgtaccggatgcatgtttgtacatcagtacatgtctctgacattataccgtgctggttgtgtacgtacgactacgtctacgacatctcgcgcacaatttcagaagcagagtaaaagtacaccaaaaagtaccagcacgttcaactccatagtacaaaaacaccccaaaaaaccattttaaaaacatacaaaaaaaggttaaaagatgaagggttagtcatgttatatccagcttattaatttacccaattattgatagattatttgctcgacgctcaaaaaatacgatttttttagtcatgttgaaaaactttttttcattatattgcttatatctcttgtttggagctatttattaaatttattttcaaaaatattttattcatacctacaaatcaaaccaatagtcctcagcaataatccactgaataatcaaatcacatagctgagtgggagaagagagctagctaagagtgtccaaacattttctttaaaaaaggtaaaaaaaaatggatggaactcaaataattgcatgtatatcccctccataaaaagaaaaaaaaatcaatcctacctgtaaacctgatactagttttttctttttattttacagagtacttcttgcttaaagttgatttattttaaaacgaaccgaagcaacagaagaaagaaaggtgcctaaatttattttgagacgaagaccgagtttagctccaaaatttttctttaaacttctaactttttcatcatatcaaaacatttctacacatataaactttcaatgtttccatcacattattttgacgtgaactaagaacacccaaagtgagaggagggaattgaaagaagcggtgggtgtccacgtgggggcgtcatgtgcatgggggcgcgtaccttgcgggtgagcgagacgtccggcgccgggatctccacgacgcagccgtgcgccgacggcgcccacgcctccgccaccgccgccggcaggcacttgcaccgcggcatcgacttgcgctcgtacgacagcgagtccacccgcggccccgcgaacagcggcgccggcgtccccggcgtcgccggcgccgacgccccgttcaccggcgacgacatccccgccgcgccgcccccgttcggcgccgccatctccattaatatatcaactctttcttgctctcctcttcttgcaacttctttttttttttgttcttgtttttttctcttttcaggcgaatgatgaggtagaaataggatgggttttta

SEQ ID NO: 68256 - DNA, 985 bp, Oryza sativa
aaggcttggccggcatccaagcagttaatgtacctggagttgaaaatgtaagtgtgttgcggcattcaactgggccaaaaaatttcctctatacagctaaaaactcgataatatttctgaactcacaggttgatgccagtgagctcatcgttggacattcttcctacttgacacttgtcaatcaaatcctggaccagcttgagctgaacacctactatcctgtcttctatcccagcacaccaaagtgcggcacaccgaagtcaaagtaaccactgtaattgagctgcagaaaattatatatatgttttacgactggaaaagccagatctgtgctttgcaaagaagtgtatatctgatagcttgtggaacaaacagctgaatttagtgacagacaggttgcagtaaataaagctaactgctttcttgaatcaaaagtgcctgcaatatatagtactgcattttactcttaaaaatactgtttataactctttaatagctattagctaggtaatcactctgattcacaaatcacaactacaaatcgctcagatttgcaaggaatcgacagatgaatgaatgaacatctgcttcgttatttccgtgtgaggtcatgagcaagggaggagactcggtgcactgacctcgtcggcggtgaggaaattggagcggtgccatcgagtcgggacgaatcagacggaggagaggatggcgctcgccggcgccggtctggagagctcatggcgatttactcatgggcgatttccggccgccgtggcggcggcgaaaccccattttacagcttctccagaacatgggctgtactacggccaacaaaatcagccaggctaacatccgtgcggcccattcaacggtaggattgcgttcttttctctcctttcctcaattgtaaattgtactccctccgtttctccgtttcacgtaactcaggtgtgtttggtggattgggattcggtgatattccccc

SEQ ID NO: 68257 - DNA, 2581 bp, Oryza sativa
aaggtttctccgaggagtaggcttcgtctgtaccgtcgaggatgcctgtggagtggtgttcccgctgcagttctagtcaaggcttagctcctgttgtctttcgttctttccgctgcatttatgtaagacttttatgatgtttgtaagacgtggatctgaatgtcaacattgtcgtttgtgtaccccggccggtcctggacggtgattttaatgcacattctgcttggaattctattcgggaatttctgggcgtgacactggcggagctcgggtgcaaggggaggccggattcgccgccgccaggccgcggggaggccggatccaccgtcgtcagaccacggggagggtggcatcgtcgtcgacgccgtcgaccgtgctgcctggatccctcctctccgacctcgacgtcgtcgaccgtgctcccacggctccctcctctccgaatgtgctgttagatttgaatttttctttttttttggcatgttgttccagatgatgcacatgttttgatctgtgtaaatgatgtttgatctgtgctaatgatgattttgcattggcaaaatttgctacaggacatccaaaaaacatgtaattagctggaggaccccgccaaaacgtgtatttggtgtagtgcatcgtaaaaaactgataattggctgctggacacacgtagcattattttattatttttagaggaaaaggagagagaaacaatgattaaagacaagtttgcccttggctcaaatgactccaacgtgggccccacatggaagtcccctctccctctccctctccttcttcccagacagtccgggtggcggagcggcgatccgcggctgcggtgctgaccacgttctccatcaggagggggggtttacgtgcagccacaccgccgcgcgctgccggccgtcggcgctcatctgcgtgctcagctcggcgatgagctgcgcgctcaagtgcggcggcggtggcccggcgctcgtctccctctcggcgtcatcgtatttacggtgtcctacaacaaatacacgtttttacggtgtcctccagctaattacacgtattttggatgtcttgtagcaaattttgtctcgtgtatttcgtgtttaaatttggaaatgagcagcgaatctagatgcggatttgaattttgaaattaatgaatcaatcggcagttgtatgggtatttttcgctggcggttgtgcagctgcatgggtgtttctttttggctcaaaatagattttcactggcggccgatttaacacagccgctagcacgctggcggctggcttaagacgaccgccagcgaaattgaattatcagtagcggtcaataaccgtagcgaagattttgatcttcactggcctttgcttcgtgggggctctaaatttcgccagcaaaaatctaaaatagccaccacgaaagataatttttgtaatagtgatattgaataggacccacctatggatattgcctctattgaagaaataagcttccttgtatagacttgacccacctagtaaacgagttacaatctacgttggtcatagccttatattttggaacggagataagagtttataactgtaaaaatattttaccggtccggtgtgtagaaacccctgttggcgttactaggtacgcctctcactgttaaaaaaaaatatcctgagaggctgagtgtctgagacacagctagagtgatccatggattatctgcaaagtaagtatatacaacgcgtaaatacgaggaaagccaagacggacgacgcgtagtgaacgagtcaaagcctgagatggctcaagaaagtagctgccccgcgcgcgcgacggcgatggcgacaacgcgcgcgctaccgtatccttctttcttccgccgccgtgacttgatccctacttccaatcagctactagacttccgctccatgtaaacgcctgagcacgcgcgactcacgtgcgtgctcacgtcacctcaccgcccggcgcccgccatggccatcatgcacgcgcgcttcgaggtctccgacgtcgtcggcggcgacggttccagcagcggcgggagcagcccggcgtcggtctccggcccgtccgacagcgacggatccagctgcagcagcagcagcgccgccgacgagctattcccggacgcgcgcgagcttccctccacctccgcctctgtgccggtgctcgccggcgtcggcttccacccgatctctccgacgtcgctgtccgtgctctccgacatcgacgtgcacatgcagcgcatggcgcgtctcctcccggccttcgcgtcccccgccgccgcgccgcgcgcccaggcgctgggtcggtggctcgccgggttcgacgtcggctgggtgctggagatggacgccggcggcggccggctcccgcggcgggaggtcgggaggagggtgagggtgtgggcgcaggcgctgagcaccatggaccgcgtgttccgcctccggcaccgggaggcgcgcaacccggccaacgaggccgcggcggcgcagctcgccgcgctcggcgagctggcgtccgcgagcgccggcgcgatgctgaggctggccacagacgtcg

SEQ ID NO: 68258 - DNA, 1910 bp, Oryza sativa
caggtttatgcatatcttgaatttggattgtttttagatcatttttctgatgcatttcgaatactcagttctgcagaaggatagattgatgataattagttaattgctgtatatataccaagcaatacataattagccaggatatacagtagtgccagccagacaaaactgtgataaaccaatactctgaaaaggattatttgcaattgacggaaaaaagactgaatttgctacagaatctgaacgcctaaagagatagcaaatacaaatcggatgcaattcaatacgaatctgtgtggtttgtgatatactggcaagatttaatccaggaatgctgagatcatgagctagaaatttgaaggcatacaatttacaaggcttctagtcgatgatgatttactacaaatctttcaaccaccttgccttctaaatttatcaaaagggactcctgccaagatatccaaagaagttggatggaaattctgatgcaaattgatacccgagacagaagaaaacgagaaagcgtcagtatgaagccacaaactcaccatctcaagaaggttgactatatgcaggaggaaaccatctgagcttgtaaggtcatcagggctgggatttccaatatacagcattgaattgtcttgacggaagtaaccacaatgacctcccgtgctaatatatgcattctgtatcatataggaatcaattacatgctatatcatcaatgtgaagctctaagatcatcagcaaaaagtgaagggaatgggagttaccacttaccactccatattttgcaaaaatacgctgaagaggctcatacaactttgttgtttccagtgtgtgcgcctcagcacaaacaaagaatggatcatatccaacaactattttcctgtcttaaagtacactgttgttactgttacgacccattgaaaccagcatatatgcttaagaggtcctaggtgtgaagcatgatgtcaaggctaacattctaatactataaagataccacaatataaacatgatgtcgcttatgtatgctactaaacaattcatttgtatagtatatatgcatgttgggagtttgcatttccattccagaaaattttacgctaaaattttacgctgcagatccgttagaaacagcttcaacaataacacacaaaattgtataaccagtagtgaacactcaccagttactgctggttgccgctattgattgctctagccatttaatttgttccctactagaagctcttattttcccatcatgaataggttcctaaaacatatgcagttacgaacagaatcaaatttataactacagtcatattgtttatagctaaatgcccatgctttgctacgggaaaatatacattatattgcctaaaatacataaaaataaatatatttatcatgaagtgttatgatgttacccatcatttttctatagggaataatagtaaccttaatttgatcttatatatggctatacatttagatttgattgtttcttaacattaagaagttcaaagggtagtttgcaaaatttacaatgggagtaggtggggtagcagattcactgccaccaccactatcttcttttaaaggagtatagattgtgtccaagttatttacaaagttctaaacacaaataaaaacaacgctagtaaagaatattagaaaaatggaaagaactagtaggcgcgtttgcaaggaggtgttgaaatagttagtacattggacttacaatcggggatgtaaattagaggccattaagaaaagatagaataatcagttaaccactattgctcttgatgctaacataattagtgaatagtattgtttgtcagataaggctgcctagcataagaaactaaaaaatgttgagaaataaaaataatacctgtaaa

SEQ ID NO: 68259 - DNA, 2714 bp, Oryza sativa
gaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacactcatatagtttattcgcatgagggataacctgaccacacacaaggaatttatcgcggcggttcaagaacaactcatgggattcatcaacgaagaaatccttgatcccaagggtgaattctactacgacgaaaacacaattcaccggtccttagcttctgagctagcagcgagtactactacgtcgaaatcgtagctagctaggacatataatggattataattaatacatgactacatatgtttctatatgcatgtgtacacattttctataatgtaaatatattttgttcatatatatatctatatacatatgcatttgcataacatatatatatatgtataaatacatatatattatgaatgtatatacatataatataatataatatatatatatacatatatatatgtatgcatatatatgtattgaaacatatatatgcatggtttatatatatatatatatatatatatatatatatatatatatatatatatatatatatatataagccatgcagcaacaggggcatgcaaaaaaaaaaggtcagctggatctttagtcccgcctggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgctagtaagctagtaacacttgcatctatcgacggttgagaaatgtacgtgcgtacgtatggctttatgatcggagctacatatgcctaacgataaaccgtacaaaactttaaaaataaaaaagaaatgctttataaataaaacctctctactacaaaagaaagccaccttaaatcaattaaaaagttccaaaacttaaagtttggcaatgatcgatcatccctgggattacaatcgagctgcggatcatgcaaccacaagaaaatttacagcggatcagtgcaaccacaagcgaaactactatattcattctaaaatgttgctacttagaatgagatgtgtcaatattttacgacggagaaagtacggatcagtgcaaccacataggaaactaccatattcattctaaaatgttactacttaggatgaggatgtgtcaatattttaagacggagaaaataatagtactccctctgtcccactgtcccagaatataatgcctcctccaacaaggatgagtcagctagctcataaatctccacatcagcttttgtatgatgtggaagagagagaaaataaggagagagaatgcactatctcttcttcaagagctaagctcctaaagaaaatgtaagagaaattatggaacccaaagcattttaaacaatgtgctatgagacaatctattggagaggtagactttttgctatctcttgtatgaggtggacaagcatgagctagtgcactagctcaatcatgaaggaggcctaaggagttttagagttggacacggttattaagaaagtaggtagaagtgaatgatggagagttgtggttg

SEQ ID NO: 68260 - DNA, 1840 bp, Oryza sativa
atatatatatatatatatatatatatatatatatatatatatatatatatatatatatatatgtatatatgtatatatatatatatatgtatatatgtatatatatatatatgtatatatatatatatatatgtatatatatatgtgtatatatatgtatatatatgtatatatatgtatatatatatgtatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactagggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttaatcttagcttgtaatattatttgagttttaatataagattattttatttgtaattagatttagtatataattatttactagctagggttgtataatatacgtcacctagacttagcttatatcacgattcgtaattagacttagcacgtaaggttgtgtagggttctaatgtacgacatttacacttagcatacatgacttagattgttaaaacataaatgtctcatgacttagcatatacgcacgaaacacttagcatatacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggacgggggatccactagttctagagcggccgccaccgcggtggag

SEQ ID NO: 68261 - DNA, 1462 bp, Oryza sativa
ggcttagctggttatcacgacgctgtcatttcttctctgaacgatgacgtactcatttagatgggattcagctctgaacttgtgcagtttttaccacacaatgtttgctggagtagcttttctggccacaaattgaagtttggaattctttggagtatatgatgctccttctgataatgttcagaaggaattttggattagctcaaatcagatgcacatgagttctgttctgtgaaaatgatgagcactatagatgggtgaacaactggacattagaggttgaattgtcatgcttgtggtaaattgatatattcacagacaaacaagatgcagttacatgattttcttgttgtttccaaaaaggaacctgtcatggtttgtgaacctgttgtgtgacatggcttcttgatcttctgatgaggctgaccatccaaaactactccattttctgttagtgttagttacccacttgtgtggctgacaacataccatccacattttgtattcttgaaaatggattgatgtttcattcgtaaggctgaaatgttcctatcactattgctgttggaaatgtccacctactcctattggacatggtttgaatctttatgataactatactgtttatagtagaattgatattgctcccagtttcacctttcttatgctgactactggttacttctttacttttcagtgtttaaccactgcttctccacggatttctttgaagaagatgagctgaaaccgtacatcggaggcatcttgaaacagctaattggccgctattccattgactcattcatggtgttcaattttgagggaagcaagaaggacaaccaaattgcctgcattttctcggactttgatatgagtgtgatgggttacccacgaaactatgagggatgccccttgctcaccatggagatgattcaccatttcgtgaggtctagtgaaagttggctctcattaggccaggacaacttcttgcttatacattcagaacaggggggatggccagtccttgctttcgcattggcagccctactgctttacctccgaagatataataatgagaggaaagcattggaaatggtctacaaacaggcaccacctgggctagtagagcacttctcaccactgaacccggctccttctcagatgagatacttgaagtatgtgtcaagacggcacatgtcaccagaacaatggcctccagctgatagaatgataaatttgaattgtgtaatcatcagaggggtgccaaattttgatggaaaaggaggatgtagaccaatattgcagatttatggtccagatccttttgctcctaatgacaaaagtactaaagttctcttttcaaccccaaagacaagtgattctgtccagctctacacacaggtatacttttgttatatttactaatttatcatgaataatataacctttattacagtaagct

SEQ ID NO: 68262 - DNA, 5458 bp, Oryza sativa
  unsure (1)..(5458): unsure at all n locations
acacattccttgccagaaacttactcacttgcactagaatctcaagagcacaaactctttgaagattcatctccaagggagctaccaaaattggataccaccaagaacaaccccaactccgacctgccttcggcgaattcacgagactcagaagctgctggtgatgctgctgttgctgaatggtcagacaccaacacggacacgttcctgtcagatacaccttcaagcagctctccatcaagcccgcagaagttcgatgaagattccatggaggctggaattgttgagatccagacacaaacagcagaacctcaaagatgttgaagctgcaaaattcttcctcctgtaaattggggcaacactgatcactggagctgcccagaatgtagtcacatatgtcgatacatatacacctgcacagtacattggtaaaaaagagtggtttatccagaccacgaagcatgtatagctgttctcttcggtaatggtaaacatgtacaaaaatttcagattgcctccaaattttggagaatatgagttcttgccgcgatgcaacttggaaacaaagtcttttatcattttcctcgcaaaaaaaatgttctttatcatttgggatgtgaactacaatattgatgatggtcgaagttcatgagaaccaccattgcgccattacatagtgtggcctaagggcatgtacgaccacaattaactgactgtcttgtgtcaatgacggttgggctccacaatagggcggtatgacaaactatttgtcacttttaaaatgcggcaattaagaatttgtcactcgcaatatatgacatgtgaatccagtggcaaatagtaagagtgacatagttatatatctctaagattggagcggaaccccatctcgagcaagtttaagtacccagaagcgaaaggacctgtagcctagtggttagaagagcctcagtaacactttaggtcctgagtttctccataggagcgattttttcaggatttaacggctttgtgctttcagtggtaggtgacgtacctgtcgagtgtgcatgttcgaagatgctcataggtggtatgcgacgtactcatcgagtgtgcgtgttcgaagatgctcataggggtaagatttgcgtgcgtgcgttcatagagggtaggtgtgcgtgcgttgtgagtatctgcgttgtactatgtaattcttaaaaaaaaaagtttaagtaggcagaagcccatcatagtcagggctaatctccatggccccaagtatcggcccaaattgaacaaggcctcgtagcttgtaggtatcgggtttcggtccgggccggaaatgtcctgcactgacaggtgacgaatctcacagccctaaataacaattttgccccatatgatttccatgacacagaagaaaacctaccctcgccgccgccgccgtgatcgtcgaacggcaagagatacggctctccgtattgtgccggcgctcggacggcggccgacggcaagatgtcgtcgccggcggcggcggcagcaaatcagccagtatccgggtctgcactgagcatcggtggtagtaactagtaaaccctccattctcttgctgttaaaatacatttcatcccttaataatcatcatggaatcgttgctctgattagcgtgaaactctcctgaaagtacattcgaatttcaaacaaggaaaaaaagggggggttacaaattagcgtgaaacttcgctgaaatggttcgattctttgccaccaaacagaacggtcaaaaggattaatttgcacagattatcaccaagctaagcgtagttggaacaaaaaccaggggattactcttttgtctcagatgacagaatttctagctgcatcctgtttttgctcgagcgagtctgaaattctgaacagattcttcagagatgcgagacgattatcactactactctagctcatcgccattgctgatggaccaagctctctctctcctttcccctgtacacatgcaatgcaatgccagcgcgctagctagactacgagacggagtagcgccgattcctcgacgacgagctcgacgacttggacgccggcggcttcgccgacgacctcgggctctgcgagctccccgacgtgtcggagctcttgctgaccacctcgccgccgggcggcttcccgccggcccacagcctgtcgaacatccgccgcgaccgcgacgacagcgacagcctgctgctctggttcgccacgctgctcaccctcgccagctgccgcccgtcgtcgccgccgccgccctcgtcgccggcggcggcgagcttcaggctcccgagctgcttcttgagcagcgacggcgtcggcgtcggcagcgcgcgggacttgctccagtccccaccgcctccgccgccgacatcgtcgtcgtcatcgtcctcctcctccaccagaagccgcgcaatgccgccgctcgccgccgccgccgccgccgccgggttgttgccccccgccgcggcgcgcagctgctcgaagaagagcacctgcacgacgacgcggagcgggaggcgatcgttctgcgccgcgtggatgcatgcctccttggacagcttcttcacgtccatcaagctcgagatcttcctcttctccgccttcggcaaattcggatgcaactgacaaagtgacaacagattgcaacatgttcatgtcaaaaataatagtttagaaatcatatagttaacttggaggatgaaaatatgcatcaacatgcaaaataaatcaaattcaagaacaaaaaaaaagatggaaaatgatcactgtttgcatcatgattcttgtcaagcaaatataccttgagaaagacatcaatggcggtgtacagtccatcatgggttgctcttgctgcatcaggcatggaggtcgccactgcaacgaagctcgagaccgacaggtttggatcagaggcgacctcagccaagtatccatcaacaatcttggacagtgcgagcaaagattcatcgtcgacgtcggtctcgaacatctcttgatcaaggttgttgaggaagatcccatcttcagtcactccggctcgcctcatgaacctgccgacgagcgtcagcaccagctgtatgtcgtaggtggtcaacgccggtggccttgccgggatcaggaggtcacagacagaggccttgtgcagctgaaggatcaccctgtccatgagctcctccttcagcatctcaccggagccgatcaggacggcgaccttcagaagcttgaggaagaaccggcatgagcagcacgatgaccccttgtctgacggcagcagccagacgatcgtctcgagcagatggttgtacgccatggagtaggcgtcgtcatcgattgccgcggtgtcgaagcattcaggaagccaccttgaagcataggccttgagagcttccccaacaacatcagaagtgatccttcctctggacttgacagcaaccatgacacgcttgtagaggtctacatccagctcacacagatcctcaacccaccagtctttcggaaccggctgcgagttcttcctcgcttccacaatctcatcggacgacgccgatttccggttgtatgtgtatgaccacaccacattgcaggggttggaggtagccttggaagcaatggagtcaatgcatcttgcagccagcttcagctgctctgaccatggtagcaatgcatcagtggtttgcagcgctatgatcgagtctttccagcttctgaagatgccggagttgaggaacacctcgatcttgaacaccaggttgctcttgtcaacatcttcagtcatcccaagtaactcggctgcacatcttgcggcgacgacattgtacgcgttgagggtcacaaccatgccatagcagaactttgcacagatctcaaatattttcactccaccagggatgtcatggatgtaactttcatcagtgccattctggctggcttcaatgatcagcctctgtagaaggctactcttggatagtaaggggaactgaaaatgaattgtgaagtggtcanagttacagagtgtcatgtgtcataacagagggtttttttaacaggaaaatggccatgattgagcatcaaacattttgttggtttgctgtagcattctatctgtcaaacttgtttaacaaattgatgatatcttccatcgcattgcacgagcattgctgtcacctaccattgagaaggcttatggaaatggaggaatgatttaaggagaatgctgggaaagattctgaatgcaacatggttccaaattacaagtggctcttgacaaaatatggcactgtagcagcatcttctgatgtgctcatagctgtacattggcgcatgcattgttctaactcaatttcaagacttgccttaagacacaacagtataatctagctttgctcatgcagcagtgacagtgaaaaaaatggtttaagggattattaccttgtgcaggtagaaccttgcctcctccacatggatgacaatgtctgatggaagttcagacaacacatatctgcatcataagaatgatgtgttcagagcttagtggctgactaccacataataatagcatctcctagcaatgtacagcagtaagatgttcagattaacttcactaatcaaatgctctaaagaacacatctttcttggctgcaagctgcatgcctgaatattcttgcttaggtccagacatgcacatagccacatatacttcaaccaaaattaaaaaattaacaaatgcattttgctgttttaattatgtcactctctgcaagatccagtgggcgtggccaggttggttggttctatgcaaagggagaggagagcagaaagcaagaaacatttttatcaaggcccaaggattgcaagttagttataaaaaaagagattattttgatcttatcgcaacaacaactactactactactactactatgcctgccatgttttgtttgtacagccaaaagggaaacaccagcttttttcagagcaaaagtgaggtcgccttggtcaaaatgccgtgcagagaaacccacgtagctcacgagcactttgagcagtagttagccccacatctcaagatcacagtagaactgcttcgatgacttgaaaaataaaattcatttttggtgggtacactaatcatgaaaatgcaaagcaaagcacacagcaaagaaaatatttttcacttgaaaagcaaacctcttctactatcatcagataaacaacacttgaatctttatttctttcctgtttgtacaacacaagaacctgcaatgcaagagcagacgccaaggaaacaaaaaaccaagaacacgtctggagcaagctcaagaacacaagagcaggctaagccatttcgtcagagtaaccagaacagagaagaaacagagcgagaggaagaagaagaaacaaatccccaggagaacctctccatttgatcaca

SEQ ID NO: 68263 - DNA, 719 bp, Oryza sativa
aatggcccagcccaaacattcttcaggaaatttgtactcctaccaaatggattaaggactgtcaacctgtcatcaccaggaatggatcactaatcacttaattaatcagttcatctcagctcaccggtcaggaccagtacttagtaagtacactgtacacgaaacagtggtaggttttccatctcttcaagacttgaatacacacaacagagaaagatcaaaatactactacagctttgtggctggctggctgctgccgccaccaccaccatcaccatcaccaattcacagctccgtgcaaaaactgtagctgcgtttgtgtttggctcgggaattgggtgtgaagaaagacacacacagagagagagagagagagagagagatggcaccgaccggaaaggccatgggccaaggcaagcgaagaaacacaaaacacaaacacgaggcattgctgcgatgcaggggctgcagcgtagcaggggggtgctttctcctgccttcctcatcccaagcacgaaaacatttcggactggaccctccctgtttttccctgtctttccctcccccacactagagtgccctttttgtgtctctctcatcccctttgagctctctcttcgatgctttctttactgagtactcaaaatttttttctactacatccgttctaagggctgcttttaatcgcagggttaaaaaaattggaggaataggaaaaa

SEQ ID NO: 68264 - DNA, 2215 bp, Oryza sativa
ttgcttccttgacaatggaaacacagagccccacatcagtaatcaaagcatgaagaacaccgacaactaaaattacaatgaagaaacttgcaggtgaaccatgctatgaagcaaatcagtgcaggatgttcacctccaagccattaccatctctcaatagaagatcgcttcagttccttccaaggggaagtgaccggcatgagtatgtctccttgaaatctgacttcttggaagaagtaaaaatcgatgcatacacttctttgtttgcatatgctggtgcatggtctccagccttgaaccgcttcaaagagggagcctcccccttcttcccattttcaagcttctcagcaccccctgccatcacggcagcggcagcatgcttactcccacttagcccatttcccaccttcttctccttcttttccttcaccttccccctctcctcctccatcctcagcctcaatgccgcaacctcgtcctcagttccgttgagcggcatcttgtccgcctcatcaaactccttatggcataccaagcacgccgaggtcttcacctccttgagagccttcacgctgagcacatggccacacttgcgaagcgcgaggaattggtacttcccattgaaatcgagcccggtgaccgggcactggaaccggacctcctcaccagccgcatcggcatcaggcttaggatgcaggtggatggggatcatgtccttgagacccctgatgtgtgagagcgccttggggaggcgcttgtggaggagcgcctcgacgagggcctccttgttgaagaggttacccaggcgatcggcgacggcgggcgcggcaagcggctcgccggagagcgcgcagcaggtgaagcgggagagccgcgcctcgttggggtcggccttgtcgggcttcttcgcgaggtacatggagaggtagcagtcgcgggactcggcgcccgtggcgccgccgtcgccgccaccgccgcggagcgcgcggaggcggagctggaccgaacccgacggcggaagcgacgccacgggcgcggacagcaggagcgggcggccatcggcggtgaggtagaacgacgacgactcgagcagcggctgcggcagcgcgcggaggaggtgggagaccgggaggcgggacggcacggtgaggcggcgcggcggaagggagaggtcgtcgaggcggagcaccaccgccctggtggtggtcgcgcgcttctccatggcggtggccgctctagggttagggtttcgccgctggtggggaatcgagacggggagagagatgcacgcggataggaggagacgagaaagagagagagagagagagagagagagatctgaaaggacaaaaggaaaccgaccttgcggaggaggaaagtggcggcttcgtggttgggccgcattgttttgggccgggagcgaagcggcctgctcggtttgtccaattccgagactgactgggcttttttgggctgttgaaatcgacatgttgcccggactttctgcgtctgcatgaacacgaactgtctgtcggtactaaacaatcggatcagtattgagatcctctaaccccaaacaggcaaaacgaagtgatcattaacgtgtgattaattaaatattaattatttattttttaaaaatatcaatatgatttttaaagcacttttataaaaaaaatttaaaaatatgccgtctagtagtttgaaaaacgtacgtgtgaaaaggagaaaggtagccaaagaactcagccgaaatgtctgtcggtactaaacaatcggatcaatattgagatcctctgataaagccagacgtgatcgttggcacgtactccctccgtcccataaaaaaaactagtactctgtccatccgataaaaaatcaatctaaggtggtttttgggcctattcagattgtagttaaaataaaccttaccagattttagcaatgctaaaattttagcaagatgacaatattgttaaaattttggcaggattttttgtgtattgaccaaatttggactaaacgtagacattttttttggcaattttatcaaaaaatggtatggttaaaaatgacatcaaagtgaataggcccaaaatgatggtttttatgagatggagtaagcctactccctccgttaaaaaaaaaaggcaaactgtgggttcccgtgccaacgtttgactgtccgtcttatatgaaatttttttataattag

SEQ ID NO: 68265 - DNA, 1217 bp, Oryza sativa
gtgggtcatcgccgttagacatcgccgccggcgaggtcgggccggcggcatcgagcatcgtctgcgccggcgcgccggcgtggcggatggacgggcgggagaggagcgacgccgatgaggtcgccgacgagatggcggaggcgagggagatcggcatcagacagagccccttcccctgcaggtactgcatcgccgtgcccatgtcctcctccatcatcttcgccacctgctgctccgtcacccgcatcccaccaccggtgccacctcctcctcctcctccgccgccgccgccgccctcgccgccggtgccgcccttgctcgccttgccaccgccgccattgctgctcccgttgctgttcccctgcacggacgcacgacgtcgcatatctcagaaccggaaactacacgcaacggcggcaaaggctcgccgtgtcgatgaacattggttgcttgcttgcttacctccgacgacatgctcgccaccagcggcgccatgccggcggcgccgccgagccggctcatgctgagaacctgcggtgtcaaaggcagtcacgatggcatgtctgatcgatcctagctcactgagctcaaacacacagaatcgattgatgatcaccttgacttggagctgcaggaacttgacgtagtcgatgatctcgtccagcatcgacgccttgtccgtctgcaagcaaaatcaaatcaaagaactccattcaatcacttcattttcttcatcaagatgtcaagaaaaacgatgacaaaattgggcacgaatgcgcccatgtgctcattcactgcgctccatttctatcagttggactgttctttagttcagaaaaaggaaacaaagaaaattcttcttgacaatgcaatgaccatatatatgattaattctaccagaatgtaatatttcagaagggatgagagttttgggatgtaaccttgttggcgtttgggactagctcctgcagcgatttcatccgctccgctatcctctccctccgaagctgaaaataacatgaacaatacacaaaaagttgagaagaaaaatggaaatgttgctcaagttccatttattttttggttgaaacttgaaagaggcagtaataattgtaagatgatttcgtgaacagtgacaggtttgacgtagctgatttgatctgtcagatttaagcacgagccagatcaagcattttctgctgtcgtgagtaaacatg

SEQ ID NO: 68266 - DNA, 15185 bp, Oryza sativa
  unsure (1)..(15185): unsure at all n locations
agttaatctgatcttagtactagtaaattagtgtacccacacctatcaactccaacaactaatcccctggggatgcgtgcagctaatgattaaaccggggagtacaaaaaaatataacaaaacatgggatttggagccggaacaaatctcgtcaaacatgctgttccatgtacgtacaaaagcaccggcgattactctatggctgcttggggatcttttgctacggacaagcagctaggatctgaaggccagttggccccatacatttgtactaacttcgtcccaaagtacagccgtggatattcgtacccaatatttgaccgtctgtcttatttgaaaaatttgtgaaaaatttaaaaatatttagtcacatataaagtactattcatattttatcatctaatatcaataaaaatactaatcataaaaaattttcaaataagacgaacggtcaaacattaaacgtgaatagtgtaaaactacacttattttgggacggagggagtacacaccagcatgtactagtaggagtactacgtacgcacaggcacagcacactgcacacttctcctttgcagaaagtaagtactcctacacaagattctttatacatctcgtccattccaatcgccatgattaatttggaatctaagcacgcatgcgtggctccttctcttccttccttctcgatgcatatatattgccagcgaaatgttaggccaagccaaaaaaaaaattaattctgagtctgatccccttacctatatgtggtatgtgacatactcggatgtaatacagtttgtaatatctctactacggccgtgtttaatttttcccctattcccaactttccattatatcatatcacatcaaaaactttcctacacatataaacttttaatttttttttcaaactctcaactttttttaaacttctaatttttttcaggaactaaacacaccctacgttaaaagaggagtcgtcctcctcctctctgtcctacgcttctctagaaaaccagctaattaaaaaaaccctagaaaaatagggaaaaccataactatctactaaaaacataacaaagcagttttattttttttaatcctggaatcccccttatcataattttttcatattgtttacatttcgttatattttggccctgatcggcttcactagctacagctgttgcacaagtccaatgtttggtgcttgaaggggagttactgaatagggcctttgatattatcaatcgaaattttgttcattactgttatataaaaaaaacagtaactcaaactataagagtataaatcgacctatctagattatagctaaactgaaaaattttagggatagagtagcacaaatcaacaggtaaatggagggaatagttttcttttatgggaaaaaatcataattatgatactgaggtaattatcgtcgccaacaaaatcactccccatcttcctgcgccacccatcccatgtgttcatagcctttaacaactagtggctaactgatatagaggaattaattaacaagctaaccctagattattgttccattgaaaagtagtaacccctagactaatcagtccctttggtttgcattggacatttggaccacatgtgccaacaatctatctagctagctagctcatgatcatgcatggatcacacacattttttttcaattgttcatgattagggcgactatctatgatgatgatgatggatatgtagatgcatgggtggccgttgcaaaaatgtatgagtgtctcaaggggaccaaaggatatggagacatggtcctcaccctccttctaattaaacagtcaaacatgggattataaatcgtagtagcatttggaccacggggagatggatgtaagctttttggtctcctcacactttgttgttgtgcaaagtgtggcaaatgtggcatgtgatggatttcagtgctgaatctagttacttaggatatggcctaccatgtacggtatgtcaaccatttgtggtttttaaaatatatttcttgagattttgtagtccttgaggagggattgcaagatactacacttttaaatattaatgaagctaagtgctagttgagcctctagagatatttcagagacccaaattggctactcatcttcagttaaatactaggaagattgatgttggagcgctagttaggtatatatatgtatacatattatcaattgattaatcatttgtaatttatttcgtaaaaaataaaatcatttgattcatttactttcaaggatgaacacctgctagaggggaacgggggaggggcgagatgtggtgtatgtatgtctatgtttaccaggatttaaattctaatgacaataaatactactctcgtcctattatcctaaaactctttatattttagaatggatgaagtacataatgtcagtcagggagttgccgctgaggcactgacccggttccttttggtatatctgcccattcacaagtgtctgcatgtgtgtcttatatgtaaaaaaaacacacacacataagcacaatagacaatgaaataccgatttcccttaaaaaacaataaaatataaaaacctggtatggaatgagacacattatagtattataaactggacataatttcttgtttaaatttcttccacccagataattctagtactccctccgtcccataatataagagattttgagtttttgcttgcaatgtttgacaactcgtcttattcaaaaattttagaattattttttttgacttactttattatccaaagtactttaagcataacttttcgttttttatatttgcacaaattttttttaaataagacgagtggtcaaacaataaaaaaaaaacttaaaatctcttgtattatgggacggggggagtattagaatgtgttccatttcatacatgtttattgaatggatggagaaccaatcaacgtgcaacagaccatcatcagtatgctctgaaaccatccgctacctggccggctgaacaaccttacctcgcaggtaataaccaccaactcctgtctgcatttttacatttgctcacatctcacatgcaaagcaacatgcctgcctacctcccctcctgggctccctgcctacacggcgcagcgcagcgcagctctcttttcaggccgcgcgcgtcatcgccggctcagctctcgcgacaccacctgcaaacccaaactattccgcctccctttttctgaatcctctccccctcgcacggtacgatcgcgccgtgcacgtacttccctggtctcaaaaataaactaaccttatacgaaatatgatatatattctattacgataaatatggatagaatgtgtgccacgtcccgtatgaggttaaattgttttggcacaaagggagtacgaatctaatcttggcgtgcgatccccttttggcttagtgacgatcagtcacgtttagctaatgtcggtttggtgctgatgtcttctctctcaggtgttgtgcaatgagcaaccatttcacggtgtaacaatacaactatactacagttacatttgaaagtctttttcctaaaaaaacttgataatttttttaacactttcctattttcctctagttacgatcatttttttaagattgtaatcttgtaattttttacgatgcgttaaagaaaaaaaactactccttccgttctaaaatataagaacgtaggactagatgggatatttcctagtactatgaacttagacagtccaaattcgtagcattgggaaatgtttcattcagttctaggttgttatatttttggacggagggagtagcttgccaccagcccagcaagtgtaccctagggaggagggaggggagtaccctggaaaaagttgcgagtgacggtagcttttgcagtttttgctgggtgggggactaggcattaggcacggcagcatcgcaggcaaaaacgcatcgctgcgcctacaagcttcgcgtgaagaactgcacggtgcatgcgagagatcacaagggccgccgtggtttgtgcgtgtgttgccgcggagaaagagattttttttttctggtgtactgtgtgcatagctgtaactgtactccgtcggtaaaaaaaaaaaagcaaaccatggatttccgtgtccaactttgactgtccgtcttatatgaaatttttttataattcgtattttcattattgttagatgataaaacatgattaatattttatacatgacttgtctttttaatttttttcataattttttcaaataagacggacggtcaaacattggacacggaaactagggtttgtcttttttttttttggaggagggagtacgtttgctggtttattacacacagtgagatgcggtatcaacgggtgaaatttcactggctcttatagctactttaaaacacaggaactggaaatccaaaaaataaggaaaaaaacgtagaaagaaaaagtcaaaacatatatgagccccattacgatgctctatctactagtcaagactagtagaaagcaatcttaaccattgatatgtttggttgaagggttcagaactaattacactaccacctcatctaacgataatagaaacgtagagatattattataaaaaatatatatggagaggtataatcgtcatttagctgtggctagaccttttttttcttctttttagctttttttatggaatatgagtgatgccaatgtaatggatgatcacaaatcgatctagctaggaaaacaaacataaatgacaaagttacccctaatcactgtattggtaaaatactaatttatccttaataacaaacgattcagattattttatcaatagtataatactatcattagagagcaccagaatatcgctcctaatatatacaatcctaaggaattgaaacacacgagaatttttgtgaaacagtttgtttgcatacctcatatggaaaatattattaatatagagttgagaggaaaggtaaaaataccataagattcgagcttatgtttgaaatccttcaaaaaaaaagggaggaaattaaggacttctgtgagatttttagccaaatccttcaaatcaaatagctccataagattttaatcctacaaatttcatatgaaaatcctttgttccaaaataaccctttgtaagggaagatgtacatgaatttcgcacgaaacagctcaattccggtttccaattagatctgaatggggctaggtagttgatcagttgatggctggctgaaagcaggtggcatctgcgcggcctagggtttgactatcaatgtattattacagcatgaaagtgcatccatctcaagcaaagcaagcgctttcagtttcagtctttcagagaatgggaagttacagctttacatgttgactgatagacaatggctgaccatactgcaagctaagtccatttgtgagtgtgacgatgcatcgcgtgagaccgattgaccaaacaaaaggcatagtatgggcctgtttggcatagctccagttccagctccacccctcgtagagctgaagctcagccaaacagtttcagctccaccaaaactgggagtggagctgtgtggagctctctcacaaaataaactagagttatggagctgggtttagacagctccacaactccactccagactcaactcctagagctaaattgaggagttggagctgtaccaaacaggccacacttcaggctccaaaattcgcccaaatcatacccaaggggtacatttgcgatggctgtgaaagttgcagggctatttggctgaccaccttagggcctgtttagttcgcgaacgaaattttttggcgtgtcacattggatatacggacacacatttaaagtattaaatgtagactaataacaaaacaaactacatattccgcctgaaaactgcgagacaaatttatgaagcctaattaatctgtcattagcaaatgttttctgtagcaccacattatcaaatcatggcgcaattatgcttaaaatattcatctcgcaatttacacgcaatccgtgaaattattaattttccatatataatactccttgcatgtgtccaaacattcgatgtgacatggtgaaaattttttgtttggaaactaaacaagaccttaatttgtctaagcttgtcataatttgttttgactgacctgccaaagggcttggctaacaaaactgaatccatactttagttagttttaggcaagtttgccttctctctctctctctcttttcaattgcatatgggacgaaaaaaggaaatttatcataaatgtggctacaaatcaaacgtgtgtctatcttgatcaatttatctaacttaagctatggtaaacttagataaattgtgtctatcaagcaagcaacccttagtagtagtaacatataaagagcgatatatgattgtattgtgatgagacaacaacattacaaaatgttcactagggttctctctctagatgatggaaaaacctgatctttattttaacaaaagaaataagtaattattactataaagtttgcagcaccaacaactacatcccacattcaatgtgaagacaagaaccaactaacacaggatgaaaaaacattattcacgaaatcctatcgctaattaaatctccatccatgatgataaatttttgtatgactattgtcagcggaattcctgcatacaagctgaacattgtccttatccttctcacatttttatagttgggttcaaaaccaaagtcagtatgtgaccaaaactacactaaggaagcagtataaattagagaaaaatgtaattggcaaaaataaaagacatactaagatatatggtttgagttatgcagtgattttgtttgacaacagaggagctctaaaacattgaattaactaaagatttatcaacaaaggctgcattttgattggattctcggctaggctactccatcattgtccgtgagtacgtttcctgaagacccaaactactaaacggtgtatttgtacaaaaactttttatatagaagttccataaaaattcaaataaaacaaaaatatccacatttataatagtttctgaatgaatcacatgctaatgacccatcttatttcgcatgccggtataagcccaccaacaaaaaaaccgttccgaacgaagccaaccaattagaatttggttcatttccaaaatttcaaataaagagtttaaaaatatagatagctatgcatttacccaatttttcagccactgctaggcctgccttttcttctccccctttggggtgcataagtgcaggggatgccactctaacaagagacaaaaagaatgctctaccttggcctacccagccaagttggcttctccaaagcagcacctcctcctgctgctgacgctgcagcagcgccaacctctaggatttcaccaaaactcttttgctgaaaccatctgtgtgtgctactttcttcttccttttttttttctcttggtgtgctgttgtagttttgttggtcaattgcattctactttctctcttttcttttggtttcttgtggatgttttttccctttggaaaaagttttcgtactcctctgaatgttgtgtgtgattgtgctcctaactcgtctttccatgtcaacaatatccaaaaatccctttgtggattcgaccttattggcgtgtgatatgtactttgttctctgccaaacatttgatcaagatgatgatgatgatgatttgtttaagctaacacaaaaggttcagagatgccattcaaaggaaaaacaaaagaaggttcagagatgttcgtttggcacctttcgtaaagaaaggtatcggaaaatatgtctttctgtttctatttgaattgggactatctacaaatcattcgccataaaacgaacccaaacgcagtcggatttttctctactgctaatccatacctaacgactcagtggacctccaactacgtacacccttttatgattaattagggactagtacgtattttattttttaaaccatatgattaaaaacacataaaaattacaatgtaattattctataactagtaatgtaagtggtatgtaattatagtgtaagtggtatataattacattgtaactgtagtgtatgtggtatgtaattacgttgtaagtgtggtgtaagtggtatgtaagtgatatgtaagtgtggtgtaagtggtatgtaagtgatatgtaagtatggagtaagtactgtaagtacctcgtgaatgaattttaacttaattttggcattgaaatcattaatcctattatgctgagttggttagtcactctgtctaagaccgaagagaccagagttcgactccccaccactgcgcctgaatttttttcctttgcactggcgcgaatctcgatgaatatcgtacgggcaacaattcgactgttttttcttagaaaatctggcgacacatttatagcaaatccgtttgaatttctgcgatttttatgcaaagccacacattctttttttaaactaaaccggcaggagagctgccaattatatttttaataagcagaagtaaaaaactagacgggttataagaaaagaaaaaccaaccacggactggctgaacagttacacagcacatgccagaactcactaacagctgaaaccgctgacggagccgtgtattccttctgcacgatttccgctgctccaaaatcattcatatgcattgtgggaaacgatgcacgtggtgatatatcattgtgggatcgatgaaaaatatgactagaagatgatggtggagatcgatcggaaagtttggtgatttgaatgcacttgaaatcttggaacttgttcgtctttttagaatgactgcatcagaaagaaaataatggattggaggatgcatgttcttactgtcttgcctcctccagcaaaaaaaactaaacctttacatgcatgtgtagcgacatggtgatgacattgtttgatggtgttgagatcgttttatttcgtgatatttttctctttatttataaaaagagcgcacagtcgcacacgctacacatacgaataagccaataaggtaattttcgtggaacaaggagtggatattaaaagttccaccctctccactcgaaaatattcgtatttttgttgtttagcgaagaataagagttaaaaagatatccctgcattcactccaacgatcaatttttgaatttttaatcgcttagattccctcataatcacttaattggctaaaaaattcttagattcgatgcattgaaatcagtgtccagaaatacttatattctgtgtaaattttgattattaatatatatatatatatatatatatatatttatttatatgatacacatatgggactccatggtacccgggctccaaggtataaaacacacaaattttctcaaattttttaaaattttcaaattgtgagtatatacctaggtatatgaattcgattcatacaaatacttaataacaaaacaactcaaactcaactttatttcacaattcattattacatacctaacgaattatatgtttggatgttatatacctagaaccaaaatctaacgaaaaaaaaagttcaatctcagttcaaacttgtttgaacttgttagtaaagaagttaatgttcatatctaaacatttaaaaaaaatttatactcatttaaattggatatatactcaatttaaattttggagcccatactccatgtagcactagttaatttacctatatatatataaaggaaataatatatatatataatatattgaaacatactcgtaaaatggacgatttacaatatattaccactacttatagagttgtaggtagcataaacattccatatagcctttgaggctttggtgtagggtgtatccaaccggagctttgccttgtcggctccgggaaaaggctacgaacgcagccaactctacgagttatccttgcaaatttccaaacgtgatcgataaattcatagccacacaaaagctaactagcctcgtcgtctccaagaggattgttttgaacatttgatggtctcacctaaacaatcgttaattctatatttctacgtcatgttacgaatttatctgttttacccatccctaaagtacgtgttgaatagagaattaagaagcatttacatgtacatgcctgtagcgtggatgtacatatgcatacgcttatataatacgtgtacactcacctttcataaattgatatgcacgtatatactatctctagactaggatattttaagattaataaagtcacatggagtattttccttggtgaaacataggcactcatataaacgcgcggacacttacccctaaaaatataaatctgtacactgtacaccccccctcccccccgcgccccaaaatgagcacctccaaagaccgagtgaacttatctaaaggtttacgaagtcaccgtagacgtttcggtggtgaaaaaagaatcaaaccagcttgatcgtttctatatcacgaatgaaaagaaacacggtatatattaaatgtatcttttcattgaaccgagattttttctaatattagttttacatagtctcacagatcacctatacatttgtccacaaattttatcctaaaaattttatagatgtaattatagtataatcgtgatttaattacactgtaacatatatgtaactttcaaaattttctttgtaacatactatttcagtgaaaacggaggtcatgggaacgaatcctctcacatatatgcgcacaatggcttttttctttcttcacttgtataaattttgaaacaatttttttttcttcgcttgtacaaattttgaaacaaatctaactgttcaaaatcatgtaaaagttacatgcaaataatattatagttacatacaagttacagtgtaattacatccaagttacagtataattaaatgattgtactgtaattatatctgtcaaaatttagaagaaaatttatcgacaaatatatagcaaaattgtttctattatctaattttttttcccaaagtgaacataacccacaatgacacaaggaataagttcactttaggtccctctatttgtcacccagtctgattttcgtccctaaactgcaaaaccaggtataacccatcccccaacttacgaaaaccgagtaaacgaggtctctcggctgttttgataacggttttggctgacgtggcgtctacgtggctaatttgactcggtcttcatctgacgtggcaatgacgtggcgcttaagtggcaattcgatccggaaaaataataaaacatgtgggacccacatgtcagtttcatacacaaaataataaaaatggtgggacccacgtgggccccaatgtcatcctcactcctccctcttctctctatcctctcaatctctctctactctctcttcctaaatccctgtcccccctctctctctcctccctcccctactgcagcgagcggcggcggccggccggcaaggcgcgacggcggcgcgccctctctctcctccctccccttgctgcggcgagcggcgaaggcgggtcggcaaggcgcacactgcggtgcgccctctctctactccctccccttgctgcggcgagcggcggcggcggcgagtagccgccggtgcggaccagctcggctccctacacagcatttgatcggggcagcattaggactggttcaagaagcggcgagcaatcgggcgaagagagaggtggctcgccgatgcacagccgcatcagcgaactccggccgatgtcgcggataaccaggcggccgatgagcggcgacatgggtgtgttcagggatgatggatcgagctatggtttagacaacgacgtgccgacgtctgctgccgcgagctaccgccgccgggcgtcgcctctgagctcccaagaactggaggaatctgtagacctcccattgacgttctgatgctgtctgcctcccaatttcagcctgaaatacataaataagagagtaaatacaaattcattttgaaccctctctggataatctgtgattcttacagtcatataatagaattattatgtgatgtagctcggcagcatattgcacaagcagcttattgcccaagaactatcgtcgtcgtcgatggggtcgtcgggataccaaccgtccgaggcatcgtcgtcgtcattgtacgaatcatccggcgcggcgaggtcgccgttgacggacccggtgttccagagggacctgctgcaggcgctggacaaccttcggagggtcatcgctgcagttgagcagtcgtacggcgtcgaggcgcacctgcaacaagccggcatgcttcccaagagcgcgtcctgcaacgacgccgacgccggcggcggcgacgcgtacgcagcagtcacgcggcgcaactcccgcctcatgcgccgcctcgagtcgcagctcgtgcaggcgctgccccgggacggccgccgctcgccctactccatcggccggagagagggaagggatagagagaagaggggagagagaggatagagaagagagaagagtgaggatggcatatggggcccacgtgggtcccaccattttttaattattttgtttgtgaaactgacatgtggggcccacgagttttattatttttccggatttgccacgtaagcgccacgtcagatgaaaaccgagtcaaattagccacgtaggcgccatgtcacccaaaaccactatcaaaaccgtcgagggacctcgtttgcccgattttcgtaagttgggggatgggtcatacccggttttgcggtttagggaagaaaatcagactgggcgacaaatagagggacctaaagtgaacttattccatgacacaatgccaccacagcaaagtcaccacaatgacacaatgccaccacagcaaagtcctcgcctagcccaacctcccaatgccaacccgtggaccaggcccagcaaagaactacgtctcagaaaccgcctttgatgggcccccgtaagacagtaaatctctcggcccaaacctagcatcaatccggcccatctcagtcagtgcatctgggccacgtggcgcttcgtttctttcctcccctacgtgcgtgtcacgttagtgaacagtccaaaagcccaaaaaagctagcgccaaaaaatcaactccacttcccggtgcgatccgagctcggaagattccgtcctgagacactgacctgtgggcccgacgtcagcggggcccaccttgtcattggccaatccttcgcgtacggcccgcgagtgcggttgcgcggcttttcgcccaaggccgaaaagcaccttttctccttcgatacttttctcacctaggccgaaccctaccccgctgcacacgtggacgttggtgcgtggggcccatgtaccgtgggtcccacggatcagtggctcatattcgaggaggagttgcaatgcacggcgcgttgagcgagtcgagggtgtcagaactcagaggagcggagacgacgagagtcgagaggagacgagagcgacgacgcgacgcgctcgggtgagcgagtgagtgggcgaggaggcgcggcggcggcgccggggagatggatttcgtctgccccggcgatcccgcggtgagcttctcctaaaaccctcccaatccccttcctcctcgtcggagtcgaatgctggagcagcgatcatgagagtttttttttttggttttgttttcatttgaagtgatgttttttttttgggtgcaggcgtgggacgggaggcgattcaccccgtgtttctccgatttatatcctttggtttcgttcgagaaatttggtggtgttcgtggtctctgcgatggcggttgatcgcgcttcggcttcggcgcgtttgtgtttgcgtggtttattgtgttgtttaggccttaacattctacggtgttgggattgagcggaaatgtggttgcggctggtgctgccgttgtgctcttcatctccaggaggaacgcgcggagaactgaggtagtagatctgctctgtttattgccctttgtcagcaaaattcacgagtacaaactacaaagtcgtaggaaggaaatggataatcggtttttgaattcacaatgtctatggaaatcaaacttcaggagtacaaaggtgtaggaagtgatcactagcgttagcggggcattggcttaatttccaacaaattgttcacatgtttgctgcaatttcttttgttaggtatctgaagtgtgaactagtcatacaaatgtttgtttcatagctaagataacatcgtatccagagtaaaaaaaaacattgtatcagcatgtctcgcatgttggatgtgaattggtatttcatatagatgaagcttttatggttgcattgctgattgtttctgtttttggaatgacggtgttcagtaacagatatggttgagattataaacgggatagtggaagctaaagctatttatattcacaactgatggtatgagttgttaggaacttaggatagcgtgaacttcaagcataatgatgtttttgtgcacgaagtggcaaaaacaggggtcattcactatacttctactaaattaaatagaggccgagatccttttattgaatactacctccgtttcaagttataagactttctagcattgtccacattcatatagatgttaatgaatctagacacacatatatgtctagattcattaatatatatataaatgtgggcaatgctagagtcttataatatgaaacggaggaagtaacttatttggactttgaaaccattgggtttgctttgactcaagaaaatcttatcataattagtttcagcaatctagttcgtattctatgtttttgtagaaacaatacttgaacgttctttttcttgaaaagaacagtaggaccaagaaggtccaactattaatttattataaatgaaagataaaatgaagcactcaaaccatgttacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68267 - DNA, 1866 bp, Oryza sativa
tagtgctagttttctaataggatgtagaaatggccaagatggtagtgtcatcaagatatatgaaatttaattgtttattgtaacaacatctcttttttctttataatgcgagttatggtaactctcctctttcctgcagccaaagaagtggcgcctgaaggcacaactgatcagtcacaagtttcccatctttacaacaaggtacttatggaacaaagttttttttttttgaggggatcctctcaaagaaaagttttcctatgctaactctggcctgaaaattttcttgagtgacaacttcctatctatctatgatatgcagatgtgctttgtccttgaagacagtgctgttcctgcactcaactcgcatttcggtgacaaggcagcttcctccggtttagccaatagcctccataagtttgaagctgtatgcgaagacgttagtcgcatcttgagatcccatgaaaatggtaccactcccaaagaggaagttatgctagatgcaagctccaaagagaccacgtctccaaaagatccagcaaccgaggtgccttcgtcagcttccaaagaagctacgcctccagtacaagatccagtcatagaggcagtgaaggaggagccacccactgttaaggcggaggacaaaatggaaatcgatagttaatttgtaggaatcataacgataatatcgaacctttttcgtctaatctaatcgctaaactggctgtagcttttaccatattacaagttgtaaactaaaaaatcactctaagctagtctcatcctgtagaggcctggacatctccaggcctgagatgaacgattaccatcaaatctgtcgtactaaaggttaccaggttttgctagctcctgccccgctgcatctgttaaatgtttaactcttcactgtcgaataggtcacttgactggtttgccatcaggatgattaggcccattgtaatgaccctactgctaaagctgtgttgctaattgtggcattgtgatgtgatgatcccaacgctataaagccgtgtggctgattgcgattacgacgtaaacatcaggaccgtagggacaggacaaactagcatcgactaatcatgagatgccgtgattagtagttgggtcggaggccccaccccgagatccacacgggatattttaattggatcatcatcgtcgttagtccgtcctcatccgtgtgccattaacggtggcctccatcgtcaagctgccaacgtctacaggacgagacagagagagagagagagagagagagagagagagaggtggccatggaggtggaagcggcgcgtcggagcaagcggccgccgtggagtcgcacggtggccgtgcaggtggcgctctgcgtcgcgatgtacgcggccttcagcctcggcgagccacgcttccaccggaatcggggccgcggcggtggcggcggcgtggaggcttcgctgggtcgtggcggacgcggcggcgtctccttcctcagcgtcgccggcggcgcgcggccggccgccgagcaggcccgcctcctacggcaggtgcgcgcgttccctccctttctctctccacgtcgtgttcggttgtcctattgcctctgctccacgccgattgcgatgttgttcgtcgcgatggcatcatttcccgtcgtttcgcggcatcgtttcccgtcgtttcgcggtgtgctggatccatccgcgaaacctccatgagagagaggctgcactgcacggcgaccaaccgcgccgtgttcgtagtgctatcgccagcttgccattcgcgtacaatgtggcgcgtctgctgctacaccgcacgggaatgtgtctctcacagtcacacagcagaactgggcattgctga

SEQ ID NO: 68268 - DNA, 1119 bp, Oryza sativa
taagctccgaccggcagagagttctgacttctattcttgtactgccttgcctcacgctcgattaatgattgcccaaaaagctatggatcgtatctgtttttctactaacccgttattaccaacgtgttgtgttggtatcaaaggaagtgacagaaattccatgtgaactgcatgatgctgttcattgacaacaacgtttttcccttttcttgaaaagaaaaaaaaatgaatagctgaagaattgttctaacagcctactctgcatttgcttttctaatcattctgttttctgtgaagatggagagcatagcaaaggcctataaagtcaagtttgtggtggatgttgctcagctaggggaggaagacccactttggcaaaatgtaagcaactaacttgttctgacagtacactaagtagtaataggtacaatggagttttgagctggtccaagtaattcaaccaagggtgtgtttagttcacgccaaaattggaagtttgattgaaattggaatgatgtgacggaaaagttggaagtttatgtgtgtagaaaagttttgatgtgatggaaaagtttgaagtttgaagaaaaagtttggaactaaactcggcccaaatgttctgaagttccttctttttgtttctttcagggttccctgtacttccaggctctgaagatcccctggtatgcttgttgtttccgctttcttgctagcttactcgtcattaataaatttaacaatggcagtatggttatatggttgcattcttatgggtgtgttcggcaccccattttcccaaccgatctcccttgttttctgcgtgcacgcttttcaaactgctaaacggtgtgttttttgcaaaaagtttctatacgaaagttgcttaaaaaatcaaattaatctatttaaaaaaatagctaatacttaattaatcacgcgctaatggaccgctccgttttccgagagtactgggaactggaaatggcgaacacagccatatgcacattacaacgtgtaaaacttcatctttttcaggtattccactacatcatcccatggacagatcattggtaattttctgaagagagtgatgatgccatatgatcaaagtctagaaat

SEQ ID NO: 68269 - DNA, 1478 bp, Oryza sativa
aatgttcctgatttgcagaagagcctggacccagcttcggaagctcagcactagcagcggtttcactaataacatttctcttatccatgttaagttcaccactaccagtatcggctccaataacgtcttgcttgttttgcttctggttattatttttaggactgtcactatcataggcacgtttccgccctctgggagtacattgcacagtttcagacgacgttgttgttgatgttgatgcctgctgctcgcttgtgttgttacctgaacaagtggcattggccatgtcctcacaaactacagaccgtcttctagttctattgcatttctttttcttttgtacctttagtgaacctagcataacttgtctgggcccaagccacatgttcatgactggatatctcacaagtttctttgacttcaaatccacccttttaggtgtgttgctattgcacgaatcagctgcagctaccttcatggaaacttcagagctagtctgttttctggcgttgactcgttcaagtcctgatactatattgttctgcacaaaagccagaaacaaaatatacaaatcagcctatatgaaccttatggggtcaatcaaaagtctacaggatcatatgggatagtgacacataataagggtaatggtaccatacctcacttataggaagttctttcaccgttttgtcatcttgcttgatggatttttgcaagccacacaccttctcactggaaattggatccctgctactaggtacaacaccatttgaaacaatagcatcctgcagagttgaatgaacaaaacaagtcacatagcaaaaatattaccaaaaaatcagcagtgatcaccataagagtaaacataccttagttgggaaagtttgtgcagcaagccctgcccctgtgtcctttccatgggaagctggcatagaaaatggattttgatgctgggatgtttgtttatttcgctcagacaatatcgcattgccattgcccagggaagaggtatcggttaagccatcaacctttggttgcaattcctgcgacggaaccatggccactgcttggttcacaatcacatgtgtaagagatgcagatcgatctgatgaagatacctctctgtgaccagttgaagtaatttgcttagattgagcagataaggtagcaccatcaatttgaggtgcagaagctttctgtgtggaagccaggccattgttttcagaggctttaggagcttcagttttgccatctttcttcaaataatgctctcttgaagtcttgattgagttcccattgcttatgccgtgcaacctcttatcgccataaggagacgaggaaccgttcaattttgcttcaattacgccgctctggatcatatcactcagacctgagatcttttcaggtattgttctcctggctggcatattagcagtgatattatccttgcgtggagtcggattcccaactctgtcacg

SEQ ID NO: 68270 - DNA, 4972 bp, Oryza sativa
tttcctgcagcgttggcactgatattgcttttctcccccatctaagagctcttccgcagtgaaattttgaagtgccctcaccagagacgtggccttaccaatatcaaggctgagatccaagaaaggatcaaatttgttggagcaatgtgagcactgtgtgcatttcacctggggcacatgtacatagccaagcagtgatgactatgaaattgggacttcccatgaaattgccagctccagtcttactgaacaatgtacagatcatacctgacttcttaggcggccaccaaatattttgtgaactaagctcttctcatatgcactaggagactcacttggtactccagaaggtagacaacatttatgcatggattcaagtaaattaaccattaactcatgtgcatcctcctgccttgaattgcggaaactacgggagatgcctattttgtagtcaaagattccaattccatttctttaaaaaaactagaagtccaaaatttaaatcaataataggtgctcagttaagctaaagaacattgaaggatacagcgcaagttcttgacaatctgtgatggcgtcactatttttccagttgactgtagagcagtcttaacatggttttgaagagcacatagtgcacaaaatccagcagtacgaccttaagaaaggggaaaagaattagcaatagaaatatcttgtcgcaaaattaagtgtttctctatgcttacttgaacatgacagaccatagaaaacatgcttgcagttcatacagaacatgttacatagtgcagaaatattggtgcaacaccaatctagaaaaggcatgatcagttcatactcgatacctcatatattgttctacggaagaccaacgtaactactctttataagcaggattctccccttcttatcattcttatcctttttcagcctctttgttcaagtgttttattattgcatgcacaactaatgggtctaaactttgaaatagaattaccaactttttcacgaatttcttaatgggcaatacctgtttatgggttaaacaacattcaacctgaagaagtgttgaaattttccagtaatgtaaaaggaataaccttgagcctcttgcaatgtaggtatcattatctagggcagttatacagcaattacagaattactagcctaggctatcagcatagcttaagcatgcagccatataacttgatttcaaggtccaggctcaacttatcgtatgacataaagaacattcacttcagttcagttactactaggtgtggaatttacatgttcaaaagtaacatcataacattggcatctcatgcaacatgccaaatcatccggttgaaaactgtaacaatacttacatgaagacttgtgcttcccgctctgcaaataggccgcaaatggttctgtgtacgtcaagcattgcagcaccgagttcaggtagcaagtgttcccaagattttgcaggccagcaccctacatcacatcaaagcactccaatttaagaacccgggaagaaaaattacaaaataataaaacgcccaccatactaaaaccccgataaatgccagaaccgttaactagatactacactagctacgatccaaaaaaaaagcagctactaatccatattttataaactaatacaaatcgacagattccgtggtaaaaacaccacgcattgcagctccacccccaaaacccctaacaaaatcgcggcctctaagatacaccaacagaattacacagcttcgtgcactcacaattctcccgaggtagatcctggcgacgctgagctccggatccagcccaccgccgaccacctcccccttctccgccctcctcgcctccccctcgccccccgccgccacccccaccccttgcgccgcccccgccgccgctctgtcacccgcgtcggggttcagcgtctccatccggaacccgcctcccccgaccgccaccaccgagtgcgacctcctcgcgaggtggaactcgatcctcctgtgcagcaccccctccgccgccgccgccgccgccgccacctcaacctccgccattcctagggtttcaagccccaacacagaagcggaaaccaaactacacctcaggacagacagggacacgatgatggatgggtatcggacgaatcaacactccactctgaatttttctgcgatttttccgggattaaactcgcgcggattcgatcgatacgggtgtgggtaattggtgcggcgcgctgtttttttttttcttttctttttttttttggttcgctcggccgccgttcgagctgcgggccggaagagagggggaggagggggtgggatgggggagctataaaccctatacccctagcgagtggacggttaggattggacgggagggaggggcggggcgatctgggacgttggatttttttgtggagcacgtgctttgattgcgctctggctggtggggccggagcgggaagaacgcggagtggctgtggctgtgagccatgtgagagtggtgtggctgcgggttcagtcaaatcgtgtgtggcctacatggctacatcaacctttacccatgagtgctccattgctcgtatttccttttttttttactgtttttaaaatcatgcacccttcgttaaaaaaaacatttattacacatttcctattacaatgaatcttgtattagaaaatatctcatccaatatttagattggttttttaagggagtattcgtcttcattctggtgcttctcatccaacgtagaagctcatgttctcttcgtgtgtaggtaatggctaaaggatccaatccacccatatagtcaatctctaattatatgagactaccccgtatattatcattaatctattcacccattcaatcttcaattatatggatctgggcattttaaagcatgggtgtcagggttatggataccacatacctaatagtagttgactaaatctcggcaggatccaccacataccatgtcctatacggaagcaaccttcggatataggaggagttccggataaggaaagacaaccatagttctacatggaaacgacaaggactactcggattgtatccatattggtttccctagttctacttggacaaggggacacctatgggtataaatacaatacctcctaggaggggagaagggacacccaccagggagaaccaacacaatcaacatacacccaccagggagcaccaacacaatcaacatacacccaccagaagccacaacatacaagcctacatatgccaagacaagccgccggatatcgacatcagagatatgcctagatcgaccctatccggtaccttcagaggccgcccgtagggatctagcactgtctctgataacgtcgggcgcgagctcgaggaggaaggctaccctgttgtcgactacgagtcagaccttcagaccaccatgtcgacaacagttagataggctaccccacatattgtactggtgtgattatggtgaataaaaagcaatatcggctccggccaacaggatgtagggctattatctaatagctcaggggcccgaacctgtataaaaatccatgtctccatctcttttacctcagtctcgcgtatatcctagcaccaacgatccccatactgtgcaaataccgtagtcgtgacatcatgcaccctccgttaaaaaaaacatttattacacatttcctattacaatgaatcttgtattagaaaatatctcatccaatatttagattgttttttttaagggagtattcgtcttcattctggtgcttctcatccaacgtagaagcttgtgtgctcttcgtgtgtaggtaatggctaaaggatccaatccacccatatagtcaatctcattatatgagactatcccgtatattatcattaatctattcacccattcaatcttcaattatatggatctgggcattttaaagcatgggcacattattaatatgggaaaaaattgttaatatacataagttgataaaatgtatcgatatgcataaactgataaagataacggaaatcttagtggattcctttatgttctaaaaaaaactatcaactaatgtctcctacttccttcgtttcatattataagactttatagcattactcatatttatatatatgttaattaatctaaacatatatgtgtcgctagattcattaacatatatatgaatgtggtcaatgctataaagtcttataacctgaaatagaggtagtacttatttatgatactagtggaatcaaatcttgccggtcaataattcttgtactatctcttgattattatttttttcgtctcaatgaaaattgttattatgtggtattgtccaaaatatcgtcatcgagcctttttatttgagaacaagctgtcttaagtgagcttttaatggcggcagtgtagtcacatatatagctccttcaagccaaactctatgcttgaacatattggttgtttctgaattgacatcctatttaaaatatgaattccaaatgtgaatactagagggaaccaaaaaaaaacttctcttttgttttgtttcctaccagtactattttaccgtgttagattagacaatatcacaataggcaacatatatagaaaaagtggtacatatcgatgaaaatgtgcggttatccgaaaattcttgctacttgtgattagactttagtgccagttttcacaaacaactggtagttatatgaaatttactttgttttcctactttctttttctacatttatgatatattgttatcgttatcttttctaaattctaatagtgtgatctttttttcgcaaacgcctaatagtgtgatcataaaattatttttttaaaagaattaactgaatgaaagtatttttatggcattaattccactgttatcattgtgtgatcataaaattattttttttaaaagaattaactgaa

SEQ ID NO: 68271 - DNA, 7098 bp, Oryza sativa
ccagaaaactgtgagatgaatttattaagcctaattaatctatcattagcaaatgtttactgtagcaccacattgttaaatcatgacgcaattaggcttaaaagattcgtctcgcaatttcctggcgaactgtgtaattgtttttttttgtctacatttaatagtctatgcatgtgtccaaatattcgatgtgacagcgtgaaaaattttgtttggtaactaaacatgccctcaatataagtgcaacttagtacagatgtacttcctccgtcccaaaatactgctacctaggatagaatttaacccatcctaggtagcaacattttgggatggatgtagtaatatattctactgaatataagggagcaatctacccatcggacgtccgatgacccaaaaaaaatcagacggtcaaatgttgcagttggccaacaggtgaaacattaagttatatatggtgaaaaaaaattcagcaactgaaacatttaaatattttatgaaacatggtgaagatatatgttgaaacatgtcgctgtcatgtatgaaacaagtattaacggatcgaaacatatgtttttcttttatcaaaatataatcattcgatatcttgttgtaaagatttaattaaaacgaatacaatgatgtgatcggatcatagattggataagtaatttaagagaaaaatcattttgaagcttgctaaaatatatgcatgtatgtatggatgaggtggagagagaggagagtagtggcagttagtttcaggaattttgtgaaacacactgaagatgcacgttgaaacatatcactatcaagtatgaaacatttagttttaacggtttgaaattcatgtttttcttttgaaataatataatcatatgatatcttgttgtaaagatttaattgcaacgaatacaacggtgtgatcggttcgtagatcggataagtaattagaagaaaaaatatttaaagagaggagggaaaaaaatgaaaagaaacaggtagcatacatgttacagtgaggttcctccgatccatcaggctttttagtagggtagacgaggcgtccgatatttccgtttcgtcggacgtgtgatacaaagcattttctgaatataagacaaggttatacttgcattgggacgtagggaatagaagaaaacaaattctactgaatgttgcctatatctgtgacctttaaattagacccctctctattctctgtccaaaattgctttcctagctacaaattaagagggtctcattgcaaactagctaggtttctattaaaaaggcaaaaagaaaaaaaaaccatattattactatccccattttaaatatataacgctgctacataaaacaacccgttgttaattagctttcatttgtgtcggatcctgactggaacaataacacacataggggcaccgatgagccccctatcactgccgattaattttgaaatagcacttatgaggttgacgagctgcaaagaaaaagattaattcgagccagctcgttcaaatcaatacatagacgcatgcccagatcaataccaaatgtccatatcatcaaatccaagtaaacatcaatatttcacagatcaatacacatcgatgtacacactcacaaataaatatgcacagatcaataactgagaaatccaaatcaacatcacatataaaaactaatcgatgtatgcaccaccacaactacagaacctaccgccaccgcggtcatcgatctccctcttcttcagtccagggtccctagatcctctggtctatatgctccttcgatcatcgtcatcgtcgcattaggtcaggcccgcctcctccacctgctcgtgttctcctcattagggtggaagaggtggcaagagggtcagattgtaggcctgagcttggggggtgggtgggggggggtggatttggcacccatgcgaccttctccaccatatggatcggggtgccagcgtgaggagaaaccctagtggagatggaggaaaaagaagagctaggtagcgagcaaggaggtcgctgcctacgttgatgcttcaggaggagctcgtcgttggcacctatatacgttaagaagcgcgtcgacaacatagagatgtagggcagtgaggttagaggccaccgctacctgtgggctcattggccttgctattctcattctcaagctgattgacgtcataagccaagttagacgtcgtcgcgagttggagagattgaaaaaaaatggagaagggggagaaaggggagatatttaactatttccattcttagatgtggcgattaactatttgctatatggacccacatgttatagacatatgaggtcccacgtatcattgacatatgagtaaaaaataattaaacaccaaatttaaaagtagcaaatagttaaatgccccgggagagagtgagataggtcaacgaggggagacttgagatcgatgtctacgggctcttgggctgttgacttggcctgagatatggttcggctcgctagctagttcctcctatcagtatcagtttacctaaagtaactaatgaattatcattaattagtgccggtttataataaaaacggtacaggtaaaacttgatactccactagtggtgccaatttacggacactactgaggactcattactgcaggttcttagtgacactaggcacatgtatgtgggacctaatggggcatcatcgatgaggcgctacttttagatttgatatttgactatttcttatattaaaaatactttataagtaccatttatgtcattgtgacgacttactttctcattaaatttactttaatcataacttattttttatttcttttaataaaacaaatgcttatacgtcatctcaaaaatcacattggcatatatttaaaaccgagagagtagcatggggagcattgtaggaatattcatcattaattaccacaacacttattggcaacttagagcaggtacaataatgggcgataggagatccatgtaggattttctgctgagctggaggagagaggggaggggagagggcgcaagcgggcgactaattagtcgcccggctgtacgcatggcccgaggacgtgggcccgcctgtagcaagcgatgcacccgtgctactcgtcgttgcctgcgtcggagcgtccaagtccagggccgcgccgccatcgtcgcgcacgtccgcgtccgccgccgctgccgcctttgtccactgcgaccaccgctaccctcgtccttgtcaaccgtgctcgtcgcctctgtatgccgctgccgccgaccttgtccactgcagctgtcgccgccaacttcgtccgcctcggccacggctgccaccgtcgtgtcgttgccctcgccctcatcggtcgatgttgcggctctcgtctaccgtggccatggagagcaagtaaaagagagagaccaagagagcacaaagcttggattgagttttgaggccttgtgcttatgaatcagcttgatggtttgcccggttgcttcacttctatcttccaccgttccgcgtgtagaaggccagctcaacgccggtcgccggacgacgagctcggctccggtgacccgtttgctctatccccagctacacgggcagcgtgagcctgcacgatgagctgtttatattttctgattgagaaaatagaataacatctttctctagaaaaattagatagcttaagcgaagtagtagcatacgtatatgtatatattgttctgtaccgattccttccatgtagatgagcagatgtatagtacaaaacagatgtgtatatagccataaatttgttcatctttttggccatggatgagcttggatgcatagttcctgagaagcaatcgccggcgagaacaggggattaggggagagagagagagtggggatagaagggagattaaaataaaatttcttgtacagtgtgggccatagtagtatagcttgattattgtgtttactggctacagtgttacctatagctgagatgaatcaaaattagagtaagcagctggctgcactattgaccttgctcttaaaaactaatttatatatgggtaaaactattatataaatatatgttatatatacgctattagcgacttaaaagccaatgctaaaaaataaattatgataaaaataatcaaatcaactctaaagtttagattttagctgcggctaataattaataagagtgaagaccacgcgctgtgaatctagatagatgatcttcccctgttccagcatatcatgggagcacgtacttcccaggccggccacaacaatatttggtgtattaattgacttaatttggttgaactgatataagccaataattattaatacatgtgtgtttgaatatacaatgaactcatttgacactattcagtactccaatcctggtacatacgtatataagtacgttcatatgaattaatacaatagataaaattaagcaactggacgtatagacgacggtatagtatactgtacacgtatacaatatacgctcgaatgagcggaatctgggtacagtcgccaactgccaaaacacaatacgcacattaattatattcacacgtacgtaattactttctctgttccaaaatgaagatatttttaaggttgacataagtattaagaaagtacgtgagaatgattgaaggaagtgtgtgattggttgaaaagagaaagtagctaggtgaagaagaatgattgtgattggttgagaagaggaggtaggtgaagaaataactttattttaggacaagacactgtgctagaaatagctatattttataacgcgccacgcatgtatagatcatcgatggggatctatgtatatctgtatatatatgtgctgcaatacgcacatcatatatatcgatcgtataaacataaaatgataatatatctgttctctgacgagagcttttactacccgtgtcagtgtatttattgaccggcctaattgagctacaggagcctgcaattttttcacttggaaaaaatgggacagaaaataattaagttgaactagtatacatggtatagtacgcgacatgcctcgctggatcactagctgtcgtacgagcgtacatgtacgtgaaaatataccatttggcctacgtgcaatgcgtacatatatatactagtacgtgcgtgttgttgggtgtgcagcgctgcaggccgcgcaaagtacaaattaaatttagtgacaaataaaaagaaagcaggagttaatattagaaacaaaatatgaaatttaaagttggctgtggcttataaatctatcgcaacgcaaccctataaggccatgtctagtgtattgttttagcatcaatttttcacactagctagataaaaaaaattaatggagaaatattatttctatactcttgaaagcttagccggcgatcccttcaatgcccttaagtatcatttgttaatatataaaaaaataaatatttgttatcattatctagaagtatcattttgctgtgaataatatatatatcgcacaacaaagtcatgaatttaaaaagtcatatacaacaagcttctacacttttaacaatatagtttatcaatttatgtgttcttcttccatgcacgagggtaaaattaacctctttcatagaaattaaacgatcaactaaccgtcaactgacgaaatgggtataaatgggtatgtaagggactaaaacaaaaatccaggggcattcaagaaagtgagcaatacttaggggcgcataagagattagctgaaattttaagagcgttaaagaattttctccaagaaatgatagcacctgtgcatgtacagacatccattatcacaatcccaataccgataaaaaccgctcccgagtgctatctatgaatttcgtgaaaacctttgataaactaacaagattaaatatgaaaaaatcatataaaaaatttaaattcattattaacttacccaaaaaccaagttgtttgtgttttttacttggtccagaaagtccggatttcacggtttccattgatttttttaaattcatactccctctgtcccattttaaacgcagctcatgagtttctgtggccaacattaatcatttgttttatttgaatttttttaaaaaaaaattaaaaacataagtcacgcataaagtactattcatattttatcatctaataacaataaaaatattaattataaaaaattcaaataagatagacgatcaaagttggacataaaaactcatgactacgcttaaaatgggacagagggagtagatatattaattccatggactaaaaaaaatatttctcacccttaccaagtttgctagtaattgcttactatgggggtgtttagatccataggtgtaaatttttaacgtgtcacaccgggtattatatagggtgttgaatggggtgttcgggcactaataaaaaaactaattacaaaatccgtcagtaaacagcgagacgaatttattaagcataattaatccatcattagcaaatttttctatagcactacattgtcaaatcatatagcaattaggtttaaaagattcgtttcgcaaattagccgcaatctgtgtaattagttattttttagcatatatttaatacttcatgcaggtgtttaaacgttcgatgtgataaggtataaaatttttgtgtgggaactaaacagggcctacttgttccttgcattattttttttgttaggcccactaaatgctactagcattgatgatagcaacactagagagaaagagaaaattcatgtttataatagttttaaatgtatactcgatcgtctcgtttcacctgcaatgaaaaaaagcttaagccaaccctcacattcaagcacagtactagagagaaaaagagaagatatatattcacctatactatttaacatggtatatatatactacccccatccatatatgtataacattggttagtttattgaactaaccaacatcatataaaaaaatggagggagtattaattaatgtgataacattaattagttttatctatactgaagacataccgttctgat

SEQ ID NO: 68272 - DNA, 5706 bp, Oryza sativa
  unsure (1)..(5706): unsure at all n locations
cgcaagttggtcggcgcacttatgcgtatggaaactctgattgaattttgtccggttcatgaattcgttttagtttatttacccctctattttcattaccaccatttttttcttgattttctaccataaaaaaatgggtctagctatacaattttcgatagaaaatccgttaagaaactatagtactacattggaattgccaaatgtcatttgacagaaaatccatctccaaatgttgcagattttgtgccatttgatgtactttgcgattcgtgctcctgcccttctttttcagctcaggcaacctccttatcttctccggcgctagcggcatccctaaactttggtagggacctacagattagggtctcggttggggtcaaggtggaagggggaagaggggggggggagtttgcctattttagagggatggccacgtgaggtggcagtccggcggtgagtagcggattgggcaggtggcaaggtggcgttgacactgtcgttgccgcgtggctggtgctggtagcgagggtaaagtagaaggacattaggatgtaacgtcccgcctcccccaggccgggcccacttacatctgatagctttcataggtcatagactgccctcacagaccaacacatatcttttctgcacactttgtcctcactcatgtgcacccgggttcccggtcggtcacccatccctgccctcacagaccaacacatatcttttctgcacactttgtcctcactcatgtgcacccgggttcccggtcggtcacccatcccaaattgctccaggccaagcacgcttaaccctggagttctttggagattggcttccggaaaagaagttgcaacttgttgatatgagtattctattaatcctattaagccctaggctgggatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgcctcccccaggccgggcccacttacatctgatagctttcataggtcatagactgccctcacagaccaacacatatcttttctgcacactttgtcctcactcatgtgcacccgggttcccggtcggtcacccatcccaaattgctccaggccaagcacgcttaaccctggagttctttagatattggcttccggaaaagaagttgcaacttgttgatatgagtattctattaatcctattaagccctaggccgggatgttacactccgttaagaaactatagtactacattggaattgccaaatgtcatttgacagaaaatccatctccaaatgttgcagattttgtgccatttgatgtactttgcgattcgtgctcctgcccttctttttcagctcaggcaacctccttatcttctccggcgctagcggcatccctaaactttggtagggacctacagattagggtctcggttggggtcaaggtggaagggggaagagggggggggagtttgcctattttagagggatggccacgtgaggtggcagtccggcggtgagcagcggattgggcaggtggcaaggtggcgttgacactgtcggtgccgcgtggctggtgctggtagcgagggtaaagtagaaggacattaggaggaggaggaggccggtggtggtggatccaacagtggggagtcaccgaagatggggaagagaacgatacggaggaagctcgctgccagcagcttgaggaaaaggagagaagggggagggggaggaggctcactggcaccagccagctcatgagcccgagcgacggcaatgctagggctacggtggcggaggcgacatagtcgtgatcttgcatggtgagcggcattgtgaggagagccaagagaaaggggatgagaacagggttttagggtttggttgccctgtataaatcttaaagcaatcgagtggtccagaatttacgaaattttttagagcgttcctatcaaatggtgtgtagatagtcccatagtacaatggtaactttaaatatttacattataactcgcacataactatgatataagttggatgtaattacattataacttattctaagtcacgcaacacagtggtggagtgtgtcgtgggttttaaccttgtcccctgcatgcgccgtttgatttttattttcttttcttgtcctgcacatgtttctcaaagcatatccaaatacgaaaaaagggcaagtttctcaaagcagattagggccttctcccacccaaatccggtggcggcggcgacggctcgacagtagttgtcgacgctaggccacgagcctcctcccacacggatccagcggcggtgactatcccccgcccgaatccggcggcaggagcggacgacggcgagagcagcggcagtgggagcggacggtagcggctcccgcgacagcaggagtggagagcacgacgccgatggcgggagcagccggtgtgatttttttttattttggatttttagttttacatgcagcccatgtaagcagccacatgcgaaaatcactattttcgcataccttctcgtgcagacaggtccggtcatccgcatgcaaaaatctgatttggccgtctgcaaaaatcctttttttagtagtgttcccctctctcgaatttttcgtgaattagaaacacaagaatgttacaaggaaaaagttcacttcttcagaaattctcttagaattcatcaaaatagagagaatctattctataccattgagtttgttatagttcaacaatttaccactaactttatttctttctacaatatatcggcgactttataaattattctacaatatgccattgggttgggcttatttttcaataatacctaaaatacccttatggacatataagattaacagttgatttatctcattagaagtttcaaaaaaatatgaaacttttatgtggcctccttacacagtataaaagtttgtatataagtttcaatttctttctatttatatttttataaaatataacatatatgttatatactatataaaatatttttttgtgttgttgtttttaatgtaaattatctttcatatgcaacataagatattttttgctgttatcttttgtgtaagctatttctctctggtataccacacaaaaatattttttctaaaaaaacaaaaataccaaaaaaaatgaaaatatgtatacatacttacttccctgttgtgtgaggaggccatataaaaaattttattttttttaactttttaatgagataaattaattgttaaccatgtatgtctctaagggtattttgggtattttttttaaaaaagagccccatctcaatggcatattgtagaacaattgataaagtcatcggtatattgtagaaagagacaatatctgtggtgaatcgttgaactgggataaactcggtggcataaaatagattctctcaaataggtatgcccatttaacttagctatgcatacgacccaaccatccgactaaggtacgactgaatttgatcaacagttgcaaatagctgtaacacacatatataaacatgctctactttaattgatttacggttgcatatctctagttgtaaggctgtatacatcctttaagagtagagaccggtttaatccattatctttaaaaaagaaaaattacgaattaccccccaaactatcgcggccgaccgaattacccccctgaaccacaaaactggacattcttcaccccaactatgcaaaccggatgaattaccctccccccttgatccaatctatggaggttttggtctacgtgacatgtggcagtccagtcagcattctatttataaaaatatcggacccacctgtcatactcttccactcttcctctctctcttctctctctcacgggcagcggcgcgagtggcagcggcaggcgtggctggtggagggtggcggcagacgggcgaacggcgcgcgaggacggacagtggtctcacggagcggtgccgtgacgtctcacttgggggaggccgcgacggcggcgggcggtgtgctcatcggcgtgggggtgggggtggncgcggcgccaaccgaggaccaccggcgcctccgcggccggttgcggtggaggaggtccccggcgcgagtagcctcgcaccgccagagatgcgggcgggggagatcctgtcacgtatgcaccacggcgccgccccacgggaagcacccgtcgttatcggcagcgccctcgtagaacccaatcctcctctcccgccgccgccccttctcctcgctggaggagctcgcctcggatccctcctcctcctcctagtcgtcgtcggtgccgtcggagtcggagtcatctccggagtagtaggtggagatttgggaggagatgacctcctcgctgcgggatcggaggcggaggatgagcaccagcagcgccgccatgctcggcccctggaacctccctaccccggtctccaccatcgccaccaccgccgtctccatcatccccacctccgccaccaccgcccaccgcccgtccgctccccgcaccactgctcgccgccagccgcgcctgtcgccgctcgctgccagccgcgcccactactcccgctcatgccgctgcccatttcctgcccctgcatcaccccttgagagagagagaggggggggcaggaagaggggaaggggaggtatgacatatgggtcctacattttttaaaaattagaaaatgctgactggattgccacgtgtacgctacgtaggacaaaccttgaactagcattcgtttggtattaaaagttcagggtgaacagtgtctgattttcggattcagaggtgtaattcggtcgaccgcgatagttcatagggtaattcgtactttttcctaaataaaaatatagcaatactcttagctaagctatgtgaattctgcactatatacggtgcccgtatacaagggagcaagctatggacctgtttaggtgagttttagattctgagaagcagttgtttggtagacagcttctgagaatcaggaaaagctctgaaacccagtttctccagcttctggcttcttagttcatttttcagaatatgtaactataaattctcagaagctgtggactgtttagggcagcttctagcataaacagcttttggaaaaagctgcagctttccaaagctgcagctgggatcaagctcccccaaagagggcctatatctacaagccagctacaacttattaccccgcctcgatcgtctagctcccttccttccgggcgttcgtgcaatcgtgcgtgcgcacgatactacacggtacgatcgatattacaacgcgcgcttgcatgatcgccacattaactgcatatatgcatcgatatatcagggtgattcggggatcgacagccggcgatcacgcgtatccgcgcgtaaatgcatcccatcccatcccatccatcgcacgctgtactcaccaacccacgtaccatccatcgatcgcacgccggaatcgtcgtcggaggacgacgacgacggagacgacgccgcacctgacgc

SEQ ID NO: 68273 - DNA, 4259 bp, Oryza sativa
ttttcgcattcatttctcaggcggtctatatatatatattccttttgcaaaggttttgcatttgaaatgtttcaaattctgtactagtaatttcagtataaaaacagagagaggggagcttaatttggtaccttcagttctcaaatcaaagtcaattcaaatctacagaagaaagcaaatctgcgccgcattgatcaatgatcatcactacccctgatacgaattccatatagctttgttgtacaagattttgaacagaaaccacctttcaaaaaggttgaacagcaccagacaacttcacaccagcattcaaactgctagccaatatttgagcacacacaagaacactgcatctctgcagctgtagcaatcaattaaaagatcaaccgagtagacagtcgcattaacaaactataaaactgtgatgagatcgacggatatataaccaccagattcggtacgtacgaagcttccagctgctcatggttttttttttaatcatctgagaaagagatccccagtttttaatccctgagatcctactgggtggtacaccccagaacattcatccccctctctgcagtaataatacaagttactgtagtagtagtacaaagaaaagtatcatcagcagattaatttgtcgatctgggtgtagtacttgtatcatcaggctttgatacggcaacatcgtttcagtttttgtttcttgaaaagattttgattctgaaatacagtactaatagtagtagtacttcgtatgttttagagtagaaatacaattcgagaattttgttttgtgtcattgtgtgtccacctaattgaacgaattgtcgctgtttaaatttcataattcatttatttatttttgtgagtaacagggcagcacctctatttccatttctgcaactgaagatcacaatgtaccttacaaatgactgttcaatgtcgtatataaatagacagaagattgctctgacatttcatcaacccttttctaccaaattggaacagaaatgtggcaaaataccaaattccgacttgagatagaaattttgattagtaaaccaaggatgattttcccacactgtcagccagacaaaatgttaagctagactgaaatgtcatgaaaaagaagtcaagatcaccaccatgatttcttcttcttttttttctaacatttcaccaccatgatttctcaatgagataaatcaacaaacttcagttttcttctgtaatcaaatacaaacagcatcatgcatgtcctctaatctcttgcctaataagcatttgccttttccacacactaaggtgtactaaaaacaaaaaatgcagagtgtagttgtagttgtagtgtagtgtagtggtggaaactagagccacattcacaaaagtctcaagctgacattaagttggaagcttgtgggggtgtgaggtccacacttagcaacaggacattgtatcatatgcagccttgttgccttgtcaccagtcatcagtccactcatccccatgcccccctcattctgatcctttataaatcagccacccagcaagacattcctttccaacctcactcaccttgctctagctcagctagctcttgctgctagtagcttcagctttgctactgctactaccactactactactactactttcacctccaagaaagtatagattgcaagaacaatttctgctgctgttgttctttcttgctgttctttctccttgtgtagttgtgtggtgtggttgagctgaggtgtagttaggacagtggctggctttgcttgcttgattggtcacctgggaaggtcgctgtctctgccttttgttttctttgccatctctttctttctgggctgctttcaccttttgctttccaacctcttcttgccatcaataatgatggaggagtaagatgagggcttgttcttgaagtctctccaatctaatctcatttcatcttcatcatctccacccggtccaaatccacctactactgtttttcttttgtcccttctcttttttttcttcctctgatcttttcttttttcaggtgttttgtttttggcagtaggtgcttgctatcttttcattaggctttggattttcctctcgtgttctttagtctcagcctattagaggtttgaggaaagttttccatttcttagctctttttgcttccagcttcttgggattgctctgtttcttgctgagaattggctcgatttgggaggcctcatcttgtgttagctttcaggttttcttgcctgaaattgaaccgattgggtaggtttttaggtgcttcagtttcagttgctagctcgtcaggcttgttcttgggctcctgccttgaattggggtcaaattgggatgcttctgggtgctttgaggatggaggagaggaagggattgatggggagggagagggatcaattccccgtcggcatgcgggtcctcgccgtcgacgatgacccggtgtgcctcaaggttcttgagaccctcctccggcgctgccaataccatggtcagtatttacagtaaccgcagctaattgtacttccattatcagctatccatgatgctcaacttgctggtttttttgttcgattctgcatgttaatgacagtgttgttcttttgcttctgcttgcattgttcattgttgtattggagtactgtagttttcttagaaatctgaaatgtcactgatactagcatacttggcacattttagaacttctgtatatcttataaatgcaatgcaatatgcctactatggtgcactgataagagctctcttatggtgatttttaacagtaacatcaaccaaccaggctattactgcgttgaagctgctcagggagaacagggacatgtttgatcttgtcatcagtgatgtccacatgcccgacatggacggatttaagctccttgagcttgtggggcttgaaatggatctcccagtcatcagtaagttcagattttcattttttccccttagtacaaacaaagttctagataggaaggatcagctgttgtgtaaaaatgtcttagctgaatttgagcaaaagaaatggagatgctaatcgggtataatgcctgcagtgttatcagtaaatggagagacaaagactgtgatgaaggggataactcatggtgcctgtgactatcttctaaaaccggtccgaatcgaagaactaaggaacatatggcagcatgttgttaggaggaagttcggtaatcgtgagcgaaccaatcttgatttctccaaagaatgcaataagccgcaaagcgcggatactgatcatggaccataccaacctacctgtggttcttctgatcaaaatgggaggtccagcaggaaaaggaaagaactacacggcgaggacgacgatgaaggcgatgataatgattatcaagaaaatgatgagccctcagctgcaaagaagcccagagttgtatggtcagttgagctgcaccgaaaatttgttgccgctgtcaaccagcttggaattgacagtaagaaagcaccccccccccccaccccacttttttgcctttctgtaaatgtccttgcaggtttgcagcaaactcatttatgtttgtgtcctttttttttttttacctcactgttgatgcacaagctgtaccaaaaagaattcttgagcttatgaatgtggagaaactcaccagggaaaatgttgcaagtcatctacaggtatagcatttacttccatgacaaaattatctgggtgccttttttttttcttttctttttatccattcatgagagctcttgaattttgctcaaccgtcatcctttacatgttcttctgtaccttcagttgttgatgcgtttttacttcagtttatgaggtcgtccatcattcattcattcatcaggcctgcacaaagtgacagaaaatctcttatcattatacatgttgcaaatgctgatgctgcacagcatcgagaattcaagattccaccacatggttgtctgaactctgaaaaactcaccattttatcacatcatttactcaacctgcacagaaatgtagtacaacaaacttcagatcaggattgatccacacagactgcacattttcttccctgatgcaaaattatcatcgatcccgatgaacaccatcgaatcaaagcttcatccaccatttgatttcatcaatgaaatggaggagtctgcacctgagcacacacggccacacagcatatgtagctgggtagaccttcact

SEQ ID NO: 68274 - DNA, 6560 bp, Oryza sativa
  unsure (1)..(6560): unsure at all n locations
cgaggcttcgataagcaaatctcgaaggagcaccgattgaacccctcgcaatcggcctattggcccaagcccggagaattacatgaccttcttgtgtgaatttcatggcattgccaagaaggttgtcaaggatctgcttgaatctcttactatcaccgatgatgttgtcgcatttcatgacagagaaatcgcagggatcccagatcacttcgatccctttggtgatgccgacaacattcgccatgtccacggattcttccaaaacgtctgccatgttgaactccacttcctccagctgcaccttccctgattccaccttagttgtgtctagtattgagttcagtatatctgcaaaagttatagcaggtcagtcatgaggacatatattgataggtccaacaaaattactcctaacaaagacttagggtgtgtttgaggagaaggagattgggggagattgggaagatacgtaaaacgaggtgagccattagcgcatgattaattgagtattaactattttaaatttcaaaatggattaatatgactttttaaagcaactttcttatagaaaatttttacaaaaaactcaccgtttagtagtttgggaagcgtgcgcgcggaaaacgaggtgctttctcaccctatatcacacaaacgaacgcagccttagaacatactcctaacaaagataatatatttatatgtgtatatacattcactggtgcaaaagaacaaaacattgcatttacagttattttacatgcatgaaaattacatattacacgcaagttttaaaacataaatatgttgtaaaataagttgtaataggatatgataaattcccaaaacatgtgacctaagcaacaaaaatgattttaggatacaactttaaaggcctctaaagcagctctaaaaataagttctaaaattcaaatttgcctatggcttataactcatcgagtagccaagcaagcacactttgacagtgtaaaaatcttaaaaatgagttagcgaagctaacctaactggagtgctaggcatgtatggtccgtttggatgtaaactagtaaaaactataaactaataaataatttccaggatattactccctccatctctaaatatttgacaccgttaacttttttaaatatgtttgaccgttcttcttattaaaaaaaattaagtatttattaattcttttcctatcatttgattcattgttaaatatacttttatgtatacatatagttttatatatttcacaaaagtttttgaataagacgaacggtcaaacatatttaaaaaagtcaatggcgtcaaatatttagggacggagggagtactagaatttatctactcccaaatgcttacagctgcagatcaaggacatcagttaactgcttgaccataatctatactatgatcaagatatgcaaatggcataaataaataaagacaaaattaatagaccaggcccagcaaaaagaataaaaataaaataagagaaaaataaatcacatgaaaaaaaagtacgtagcaaagtccaatttaacaaaatatattgatgtttaaaatctttaagtttgacttaaaaacatgtccaaatcaattgacatgttctcatgattccagcattctggagactgatagcaaattataccccctccgtcctaaaatataaaagattttggtggatgtgatataacctagaactacgaatctgaatagacttcttgtccagatttatagtactagaatacgtatcatccatctaaaattccttatattttggaatggagggagtacactttagcacttctcttcaaaaattgaactaaaaccttgacgaaccatagagctaaagtacccaattgataatggagcaacaaacaaacaaaatcttgtcggcaacacaagaaagcataaaacagtaacaacaaaagaaaaacaatacgatcagtggcggatgcagcgcccggccaccacgggcaattgccctggctccatgcgtacaacaacactgctccaatgcatatgcagcatattactcattaataatatacttaatcactttgtctcttaggttataatggagattaattagatgaaaaaacagaaacgaggaaacaaggaccaaaccatcaagctgtagctacagagaccaaacaatacaacttactcgagtagcacctatgttcaagatatatactagctttataatctaaattatcggcgataatatattcttgcctaggctccaaaaaatttctagatccgccactgaatacgatcaggggcggatctacagtattagaaccggtgtcaggcgacaccgacgactttcggtagaatctatagcaaaactgcttaattatccatatgttataacaccatgatctaagtataattagcatactatgacaccgatagacacgttatgacaccaacgaatcgattttctagatccgtcactgaatacaatcattattattatttttgttgttgtgcttaccaagcagcttgttggtgcagagctccatctggttgaggttgtcgacgatgttggggttggcctcggggcgcgacacctcgacgagcccggcgacggcggcgagcgcggagcggatgtcgtggctggcgctggcgaaggcgttgctcttgttcatgctcttgcgctccgcctgccggagcgcgtccctgtgcctcgcgaggtcggcgcccagcgccgtctccctcgccaccgcccgccgcagcgcccgcgccatcagcacgcacgccaccgtcgccgccgccgacgccgcgcacgccaccgccaccatcgtcacgccgccccgccggaacacgcccaccatcgcgctcttccggagcaccaccctgaaaccctgcaacggcaacgcacgagccaatccagagcagcatgggttaattagctagactagctcgatcgagaaatcatcgaagcatgcatgtgtgcatggacgtacgtacgcagctagctaggacacgcacgtatgaaattttatgaaatttgaatttgttgttatggaaatatggagatgatatctgcattaaggaaaggaaatcaatcaaattaagtatatgatatctcgtcttccagatctctttaccgtatattactatgtatacatccttattggtatatatgccaacgctggtttggcaccagtttagtttgcttgcagtattatgctgaagtgaatttctaacatttgaaagttcgaaaatataacaggtttgaaacattagggaatgttcaatggtagggtacaatataagattatttagtagagaccatgttcgtattaaagctaagataacaaaaactctaaccattagttctcaatacatattttttttcaccaaatgcaaccatgttttcattttatagaggctaatagtctatgtaaaatgctctgtctcccatctttctcttttccatattaacaaaaatttctaattaataaggctaagaacgccctccattaaggattatcgtatatgccctttagggcatgttcaatggtagagacgagtatggtctcttaaacaatacaatattatttagagaccctgtctttacaatagttgagacgacaaatgctctaatcattaattcaaaaaatattcctttggttaatattctttccattttcttaccctcatgcaaccatattttcatattatagtgattaagagtcgttattaagctgttgtcatgcataacaacgatgttttgtctctcctctttctctttcctccatgtcaacaaatattcctaattagcaacgctaagagaccactattgacaaccattgtacatgcccttagccagtttatttgaaaaagtaaattaagcagcgactatgcacttaattaatgaggcagatcaatgtactccggatagatagaaatcagattaaatcaaattaaattaaattaaattaaattgcctcacgcaccatttgtactccggatatgtcaaagttggtgcacgcgaatctgtacttgtcagacttgacaccgtgcacgtcgagcttgggcggcgcgtcaatggcggacgcggtgcacttcacgctcgagaacaacgccatctcctccgccgcggcgccgtcgccgagcaaagatctatatgccgccggctccggtgctggtggtgcggcggtggcgccgccgttgccggcgaccgcgtagtacatgcccaggtcacggagctgcctaaggccggcggcgccacggaggacgacgtcgtcgacggccacggcggcggagaccgcgccgccgccgccgccaaccggggccgagaggaacagcatccgcacgccggggcgcgcccacccgtcggcgagagacgcgccgccgccgccgccgtcgagcaggagccgcgtcacgttgggcggcagctgctggtgcggcgccgccgccgtggcgttcccgacgggccggccggtcgccggatcaaccgcctgggtgaaccacgtgccgttcggcctcgcgaacatcgctctcgcctcgccgtcgccgccgccggcgcggtagtaggcgaaggcggcgccatcgacggcggcgtaggagatttgagcttgcagcggtgcatggagaaggccaagaacagcttgggtcccacctgcaagtcagacacggacaaccatgcagtacacgattacaaaacgacatttgagtgtaatttttacagtaataatgttgttgcttacataatattattgttatttcttagtgcaaaataaaaaaaataaagatataatgatattggaaacatgaagagtttaagcagcattaatatactgaatcagtacagatatcacttgctgatattntgctatatanttcatatatacnagagacaagaaaaaatcanctgagattcttattttaaagaggagatatccccgttaaatgaaatcgacaagaataccatttatatcaaggttagtcaccgcaagaaaattaataaaacacggttttaatttcttgtgtgtttcttaaaaaaaactaaaaataaggataaaaaaaatgacaggtacatacatgagaaaaggaagccatgttgccctgaacatgcaaggtgttggcaatggtgaaaactgagcgatttgcttcaagaagaggtcgcatgttgccggcgatgtgcatcaaagccgaatccatggcgcccttggtggcctcacccatcacctctgtcatgtacatcgtagaggagcagaaggtgactactgtgattgtcatgcatgttgcaatcacagcctgcacacatatgagaatgtatgagaaagataaaattggggataaaacgcataatttcagtattcttcggattttccctgtgttagctatacttattaacaatctagatttatagtcccctaagtgacaccgaagaaagcacacgggtaccaacagatatcgattgagaattggtaacgctcctgccctctttaaagggaagtccaaaacaaatcgttaaaatacatatttttatatttaatatgtcgggatcctatctcttaacatgaagaattttaaaatagcgttactgcgcgcctttggggatatggtgtgtgggtggatgggcggagagtgatgaggatgctacacacgcggataacaaatgtttcccgcgtatctctgcagatacttcatcataaacaatatatatattcatgtgaatattccagcctccacatatatatgaaatcaaaagggagataacctataagacccagaaaaaagggagttgttccttaccaacgggaataggatccagaagtagcagcaacggcgtctccatttgctaacttcttctacctccctcatggtcaaaagagagcacaatctgtgtacttgggagagcagtaggaaagatgagctttttatgacacaacaccttgatgcattgtactaccattttatacatgccaaataggaaaatatatattaggaaattttttttaaaaaaatgtttttctcaataccgccaacggtttggagaatacgtttggtggtattcatgtatagtggttttcatgatatttaatccgccagtagcccaacaacgctagaaatgtcaaggtgtaaaagaaaccataaacactaagatctccaattaattgaggcaaattttaacacttattagaacaagtttaatagtatagccaactactagctttaattcatctatagccaatctaatagctcatccatacaatagttacatactatactattaatatatggtcacatctgtcatacacactgcgtctaatatatggtcacatctgtcatacacactgcgtcttggagtctgtgctacagcaggttacaaatatgtagcccgctgctattctcgctccttatttatcttcttaaaatatatttgcagctggcttatagcctgctattgtacctgctcttagttgtagtacatacgtgtgggacccaccacaggtggcattagttgtgataaactccaatgctcgtggacgtagtagaaaataaagtgggtcccaatagcatctctctct

SEQ ID NO: 68275 - DNA, 718 bp, Oryza sativa
catgtccgccgccttcggccggcattcccgtctcatatggcccctctcttcctctctaatctatttcttttcgtttttaggtcgtcccggtcgccgtccgccgcgtgtcgacctccctccgtcgctcctcgtcgccggtcgccgccgtcccctccggtgaggacttcctccccttccctttcctttcccgattccccgtgcgtcgccgccgcccgcgctcgccgtcgccttcggtcgctgccgccgtccgctgccgccgatcgctgccgccgcccgcgccgccgcttgccgtcaccggtggacgcgcgcgcgtgccgccacccttgccatggccggccggccggccttgtgccgagccgagccgagccgggtgccgccgccccgttccttcccaccccaagccgctgaccggtgggcccgcgtgccggcgcccttcctccctctcccgagccgctgaccggtgggccccgcatgtcggcaccgccccctccgtgctgacgtcagccctgggatttattgcgcaataaatgatttaaggtttttcttttatagtaatagacacagtgaatcttctaaaattcataactaattcatccgagctccgtttaagcccattcaagtctcagtaaatcaagaaaaatgtgtagaatccactaaaaatggttttgttccctgtttcagtagtcttatagcatgtttgcaatgtttgccttgtatg

SEQ ID NO: 68276 - DNA, 726 bp, Oryza sativa
attcctgcagccccatcaaatgaactgtgcaatggtaacctgtcagcagaaaatccaccatctattggaagagcaccctgctgggatatactagaatctcccaaattggtggaaaccccaagagtcctctcaagaagtgctgaactagaaggcggtatccgtatcgatggcggcatgctaactttggcttgtttgcactccaagagttcttgtggtggcaatgaactgcttggaactctttggagtgtgctggacaaagtgttggtcagagaactcccagaaaaaacatcagacagaccattaccttcttgatgaatccagttctgttgaagctgaggttgcccgatcgccgcggtcaagccttgtgctagatttgcctgctggttttcttccaagcaatggccaactgtgacatttcctgtagaagtctgaattgtgctggagggggcagcaagctcctgaagtccgaaagccgcggcggcgctagttcgggttagcaggccatgtggattgaaagatggaagagcagcagaaggtgcaaaaggttgatagctctggagtccttcaaatgctccaatatgcaagaaggagggatctctgcctccaaagcagcaacaatgctggcttgttgtgatgctacagcacctagtctcttgaggtaaagcctgtacttctgcatgtcacatgaaaatcaactgattagatatggacttgagtttttaaaca

SEQ ID NO: 68277 - DNA, 1043 bp, Oryza sativa
ttcctgcagcccctgggccaaggccaagaggctatatagcttgtgtaatggcgtgttggagtacaagtcagtttcgacctggacgctgtctggacgagaggagcaacacctcgacccggcagttattacgtttaacggatagtgatactaatggctactacaccctttggtccccagaaaagataatgcgaatccctgttttaagagttggagcgtgaacatttttgcgtgatcttatctggcgccgtcattgttcgtgtaatcatttttgggccaacgtggcacatgcgaagctgctgttgtattaggaccccgagtaaatggtattaagcgtacgtacttgtttttgcttgaaattgagctatgtgttgtttttttacctggatgaattacgcactgttttctcaaataattgtgtaaaattgtttagttgaagcgaacaagacatgttttgccaaatgttgctgcatgtgagaacctagaaattgttcataattctagtgtaaaatgaactgatccctgaaattcctacaagagttgtatatatataattcattcttccaaacaggatcttgatgcttaatttgtagtataacattaagcgaggtactgtgtgtgggggtatcattaacttggaaattcaactatgtaccaagaaggaagcaattaaattaacatgcaataattcttccagatgattgagctccaattttgaaaccgaagtagtgaaaattcgagatgctgccgaccagtgaaggtttcccgtgcagcattgatctcttcaattaattaaagattccggattcctccatcgctgaatctctcgcaacttaacaataacttcttgtctatacgtattaatgcaacagggtctctactccactctccacatgcatgtgtatttgcaaaatgcaaactagtatgcgtacgttcatgcacggactcctacgtaccccaatcctagatacacatatttgaatatcgtggcgcttgcaataagtgacagtcaattttcaacccacataattataaattagcatccc

SEQ ID NO: 68278 - DNA, 4222 bp, Oryza sativa
aataacgaatctatataatatgttcagattcgttgttctaggtgatgtccaatctcaatatagattggttctttttgggatggagaaagtacaccaattttttatttttatctcatatgtatcaattaaaaaacctagaataccatgattttctcaactcaaaatataattatattttgtctctttatctattttcaatgtatttactctctatgttttaaaatatcgatgcagttattaatagtaaacttattccgggataagcaaacgtagttaaaaataaatatattactcctatatgagacagggcgtgtaatagtacgggtcgtggttttggggggtgttactgtgggtgcacgcatgaatggccatgctggctagctaggtacgtataggtatagtgtggagcagcttggaaacaatcacacatgatgcaggaaggatgggagattctaccgttggcgctgctgccctggccgtgctagtacatctgacaccgtctaccgtgcatacgatgcggatgcaccgagacaaaattttaccatcgcctacggcaaaactgaaacaaaatttttatcgtctacggcaaattggtttcgattcatagtctgtgtagagctagcacgtgctcgtcgcgtactctcgtcatgcatgcaagttattaaaaaaataaatttaataatatagttcaatactgcacattgtctcaccagcgctgctacaaaatcctatctatgaaataaaaacttgagctaattgggcatttataagaaccaaataaaattagtggatatccatgaacggtgagacaatgtgcagtattgaactatattattaaatttattttttttaatttttttattatttatttcggcatgcaaagaatgaggaatcatcaccttataaaggataaatttaagatttttttcccatgttgtttctgccgttctacgacatgcctcttcagttttgacatacacacaattatctagttcaaacagactgaccaaaaaaaaaaaaactacatcaagagagttgaataccgatcgacattattagctagccttaatttgtcgctaaacaacctacaaattaaacctatgcacgtacgtactatcactacagtaactaattaaaccgaacactttcacatgtgtttagattaagtaaattaatcagcaccgtatgatagtactactcttgtaccaacagtgttacaggatcgtgtgttcgtatacatacgacaggctggttaatacggcctgttgcgagattctaatctctgaccaaacaataaaccactcttgcttgaaacggtagtatacaatttgaatcttggagtcaaatgcaatacatcattaaccatttctactactctagtcgtactcctagctacttgaacacttggagtacgtactggtgccgttcatggggttccattcaattcatcgacggatgatcggctcagtttgaatttttcacatggtaattaatcgccgttttagtactaatgagagccctttaatttggtgatgccacatgtgatggactaaaggtacgtgtttgattattgtctcctggtttgagcgcaaattatttacccagtttgcaacgcaaggttaattttaggatattatggctttccagtaaaaattttgaattattttgaagattagctgtacgtttaacacggaattgcagacgaatttattgtaattgaattgcatataaaagagcccaaattaatcttgctggaactatatacaggaaatatttctgtattgcaaatgtgcctagctaaaaatgttcctacatgatagtaccaagggaaaacgtttgtatttatttaattacaaagaataacaagccaaacccattttttttcaattacgcgcatacgtgtgcaaaccgttacgcacatacaccgcacttaaagagataaattaaagaccaacgacaactctcagacctccattggaagtgcactcgcgtgtatgtaatattcgtgggcataaggatctgaaccgtactttccaaaaacacgccaaagtttgagtagaagagaagctgaacatggatgatcagctgtacaatgatagttacattcaaattcaaaagagcgttgggctcaattcctccatttcaaaatgcgccacaattttgattcgataagtagtagtatttattcttgcttctcatagtaaggatcacaaaacaacaggcttaacctcatcaaaatcaaggctgctcaattacgcactactccatccattctaaaatataagagattttaggtggatatgacacaacataatactacaatttagataagcttactaaccagattcataatactagaatgtgtcacatccactaaaaatttattatactactctgttaaaaaaaatcaaatactatgtttgaatatagacaatatgtgtccaaattcaaactctgagtttgatttattctttttgggatggaggggtattttagaacataagagtactacaaaacaatgcattggatcaagcaatcagctatccagaaaagcattcagatttaattagctcttgcaatcaagcaatgtcttgcacagttggcaccgtccgatcctctgatccgacggctcgaggcagctagctccagctcccgaggaagatcctgccaacctagcagtgcagctctcttttccaaacagaacaaaacgacggcgacgcagtgctgcactgcactgccgtgtggtgtactacgcctatcctacctaccaccacactgcccttcactcgaaattccctgccggtgcagcccctgctctgccctgctgtgccggtgaggcagccacgcgcgggcggtgacagtggtcgatcagtaaaagttgcagaaatttttcacagaatgacagtgcccctttttgaaacgcaaaaggtaaaaatggaagcttttgtaccagcttcttcccctgttcatcccaacatgggttgctcgcgcccggagttaattcccccctccctgcaccctcccaatcactccccccgctgggaccatccgtcgatcgcaaattagcggttcatgcaacccaaaataatcgcattagaaccagccatcaaacttcaaattctataatatggatgatcatatttatgaatattccctccgtctcaaaataaataagtgtagttttacagtgttcatgttcaacttttaaccattcgtcttatttgaaatttttttatgattagtatttttattgttattagatgataaaatatgaatagtaatttatgtgtgactaatttttttaaaatttttcaaacaagacgaacggtcaaacgtcggacacggttccccacgactgcacttattctgggacggaggtagtattttttctagttggtgatataaccgtcgacaggaaaacatccgtgatgaattcattaattttaagatatatatgatggccaatccttcgaagttattcatagaagcagaatttacgtgtgtctatttacaattgtgcgtatattatgagcgtctgtctttgtattgtgtttcttgaagagagagagaaaaagatcgtatcgattagtagtagtagcagcacacaagcatttaatcttcttttgtgtgtgttgttttttttctttttttgaaaagaaaaagattggaaaagatttgaacttgctgcgatggcgcaaggtttgccgcgcgtttccggggcgtgctagcgatggactcctataaatacgtgtggattttctcgccggagttatcacgagaattcgagttgctctgtgttcgacgctagcttcgatcgtgttccgcgcgggcggcaatggagggctcagcgagggttggtagtaggatgggggcgatggaggcgctgccgctgcctccgccgccgcgcctcgcggcggtgtcgtcgccgtcgccggcggcgtccatcagggcgcacctcgcgagagccgccggcgcaggcgggggcgtcgagagctgccagtcgccgcgctcgctgctgtcgcgcatcctgcagcgaggcggcgacggcggcggcggcggcggcgggaagttcgggtgccgggtgcggctgccgcggcggtacagctccacctccgccgccggcgccggcgccgaggcgaaggacaccgcctccgagcaggacgccccggccagggtcaaggtcctcgggagggcgccggatctgtcgctccacacgccgcgg

SEQ ID NO: 68279 - DNA, 3650 bp, Oryza sativa
caacacctcgccgcaggagcacggttggtcacgccgcgcagctccacgcgcgcgcgctctagcacgtcccgtgtcgcgccgcggcgcgactgtttggcggcttggcgcgacgcgctggcgcgctggcgcgcgcgcgcgcgcgggggcgcagaaatggcgggaaggatgtgcaggagtgacgcgtgggggtgggggtgtgagtgattgtgcgtgcggtgtagtaaatgtgcaatgatcctgctgtctctgcggcgtttttcagaaattttttttccagggaatccaatccaatccaatccaatcgagacgcattcatgtgtccactgtaaacttgtctctgcaaattctgttggattctgttctttgcattgcccatgctgctgctggtgtttctcgttgagattggccaatacttgctgaagttttcccatttttcctgcacaaaagtttgccctgagagtactcataactaattcataataaattttgaaaagttgaaaacattgatcttttttgaaaaataatgcatatatatttcgtatgatatgcaagatttgaagtaaggatgtttgttgttgtttcaaactcttctcttgatacaactatgcacaggtcttttgcgtatgccggagaaaaaaattccatttcaaaaatgatactcgtaatttttcagcgcgattgattcgtggcacaaaaccacactgatcatctgcaattcgtgaatgcgttctaaattcagggagggaaatgtacatttgggaccaggcgagatgaacattatctcgatgagcagtaacggttctgtgctgaattctgaatttctgatcgaatttacttgcaggctgcagtttgcagacgccatcagtacactgcggctgcattaaccccagcaggctagcgatcgaaagggcaaactggcgctgtgaaaaaactgaaaattcagaaggctgcagtgaacagtggcagcagtaagaacacgagggtagaatagaaggtttgagcagagcagtggcaggcaggcagcgcgtgcaaaactgaaaatgttcaggcaaattttgtgataaaaactctgcagaaacgaaggaaacagtaggcctacttcagcgagtttgcaggctttgaatttggatttcgcgtttgaagcttctggtccagctgcattgcagtggcacagtgccaggctctagattttcgaggtacaggctgggacatggtggccgaaaattgtacgtaatttgggatttagtagtactgctttaaataactgaattcaaacttcagggtctgtagggttaaccacggaccctggctcagtgttttagtgaaattcagatcataccctcatttggacattttgttctagatctacgatctaacttttgattactttactaagccctttttatttgggcttataagctagcttatgaactgacaagccttttctgtctaaacgtgcaggtgtttttttttcttttggcttttcgaatgtgcactttcctaacttcacctcgctcgtttgtcatgcaaacgttttctaaactgctaaatggttatgatttttgaaaaaaaatatataggaaagttgtttttaaaaaatcacataaatccatttctcgcataaaaaagctaatacttaattaatcatgagctaatgagtcattctgttttacatgcgtgagagattagtttccatttcattgtgccgaacatagcatttcaatcttaaaccacaaactatgttggagaatcttttttgttttatatttttttagataattttttttgttttatatgagatagaggtatgactctactattaaacttagtattttaaatccacgtacttgtaaaatatacttcctccgcttcacaatgtaagtcattatagcattttctacattcatattgatgttaatgaatctagataaatgctagaatgacttacattgtgaagcggattaaaagacagcttaagtcaccaagaggggggagttggaaatttgttgtcacctgttgaatgttattaaaagacgcgaatattaggagaggacctaatatcaaataattagaaggggtgaggcttcgaactcaggtcatctagcccactaccttgtggagctagccggaagacccctgacctttctcacctgttgaatgttattatttggtagcttggtgcaaaagatactagattgaattctattttttgctatgcagagaattttgctgtgacaatcttttagtatgctcaatctgacaaatacaaatattcgatgctattgcttgattcaataacttttgttctgcattccctcctagagcatgttcacgtgtatctaaagaacatgttaaacatgctgagcaatacataattacacacaagaatttttacagtacttgagaagttgagaggtatgtaccaaaattttcgtacctaagtatcggaggtaccaaagaggtcccaaattgagataccaagaggttccaaattttataatagtaaatgtagaaccttctcgagaaccctaaaaccactctaattacactgtcaattttttctggtgggctaaattacacagtcaaatttggcccagagacccacctcaccaaccaaatcctacggcccagaagcccatacaagttttcaggctctcggtcccttctcgtgccgtctccccgccgccgccgtcgcccagcgccgcgcctccccgccctccgttgccggcgacaagcccccgcagggagcgggctatctggagtccaagctgcagcctcgccctcccgctccgtgcgccgggcagcagcaagcgccgccccaagccctagcctcgccgcctgccaggtgcctgaagccccctcggcccgtgctccccttcctgtctgcttgtcggattcaccgattgtagcccgcaggtagttagctagatcttgcctcattgtgaatttgtcaatttgtgcatgtaagtttaatttgtggtgccggttgtatgtagtctgtagaatcgattctagtgtggtaatactcggtagtttaatgaatagcttggctacttcagcgctgaatctagtgagaataagttgagaaacaaatccgtgcggtaaattgttggaaaaatgtttagccacatgattgagtgcgatgtcttcttcagagttatgtgagcatggtgtaatgaagatttacttgggtggctatgagaaagcttagagttgagtagcagaaagcttagagttgagtagcattgcattcttctatttatgattaagatccatatttgtaccaaagtacttatgttttttttgtttagtttttttggcaaattttgaacttcataattggttttagtcaattctaccaatgtaccgtgttgattattgattgtttgcttagtaccctacagtactattttacaagggaaataacattcaattttgataagggggtctattgatgcacagggaaattactactgtgatgtttctagaggtgcaaatattttacttacaagttacaaccatgctaatagagatgagcttatggttgtcagatgtggtaacctaatcttttgaataatatagtgtttagcttcatgaaatttctttttgcagctgttgattttgaattccataaagctttctttttattt

SEQ ID NO: 68280 - DNA, 2099 bp, Oryza sativa
aatgtggactggaaaacagttggtggtggttcagtgactactgacccaagccaaccagttgttaaaaagcgtctcccaaagaaaattagacaagttcctgaatgctattttctgcctcggcgatatttgccttctgcattggcaatctatggcgctgtgtgtgctgctggagttggcgcagggatgctgcttgaggtttggataaacaaaaagatcaaaggtgcattcttgttttatctggtggcaggaggggccattcaactcacgttcttggaacactgctattttcttgaaagcttatgatgttggattatacaattgaaaacattactcttcttttgtcttagataatgttggattgaacaattgtttgttgcctgtatattttgtacatatacttgctcttcttacttgctgatgcagaggacagtgccattgtctgggaaatgggcaaatgatttgattgctacctctgaagagttctccttgctcttgtgttcagctgctaaagctgcatctcagaaataatcctagctatattgattcagattatcttttgattcccagacaaagtaaaactatcctttctaatgtacggcactgccttatatctacattcctgatttcattttgaatgctagcattacagtatggtgtaacaggcagtatcagaaataacggtgttccagaacgagccatttctgtttgacattatcagtagtccgtcatacgaattaattgattgtgtggacagtagtgattacatgctgtgatggaaatataaaaaaaatcattagagctgatcggagtatctctgattccttttcatgtgtggtgataattcgatagaattcaatacatgatatgccatattacaaagttatgaagtgcgtcctctgctcaaacaaaagatttgatatcttgatatttgtatggggaagcctccagcgtatctacgctagtaaacatattttgggggttctcaaatcctccccgtattctgaatatgaatgtaaacttgcctgcaaatgaataaaatatccgtgttttatctcaagaaaataatagaaaagcatttttgttttccaacaaaaatggatcctgtagatcgaaacaaagggcagctatagatgcatgcctcgggaaaacagaactgcgattataaaacagaactgtagattctaaacattatgaagctgtatgcattacagcagatcaatgaagcttttctagcgccaagtccagattagcttcattgattaacgcttcacagatccgcttcacagatcgggacacacaaataggcaataagggtgtgtttagttatttgggtgtaaagtttttgaagtatacggacacacatttgaagtattaaatgtagactaataacataacaaattatagattccgtctgtaaactgcgagataaatttattaagcctaattaatttgtcattagcaaatgtttattgtagcatcacattattaaatcatgacataattaggttcaaaagattcgtctcgcaatttacatgcaaactgtgcaattggttgtatttttacccctctcctgcatgcacgaatcttgatgtgtgattcaatgtttagaaatttacaagttgagtaaatttcataaaactatagatattttgacaaaaatcacaaaagcacagatttaatatgatgtattacaaaactacagatttaacgataaatttatctcaaaactacaaattaaagctgaaatatcgtaaaagtacatattaataacaaaattatcacaaaactataggttaatattaatttaatcacaaaacttgaatatttatatctcaaacatatattagtgctaatgctttaaacttaaaatatgtagttttgtgataattttattgttaaatcagtagttttgtgataattttattgttaaatctgtagttttttttgatacatcaccttaaattttgtgataatttgactaaactacctgcaattttgtgaaattaaggggaaaaaactgtcgcaactaatgtttcaatttctaaggaaaaatctgttatattttcgtttagaaagcattgataccgggctgcaggaat

SEQ ID NO: 68281 - DNA, 1182 bp, Oryza sativa
aaagttgagaagaaaaatggaaatgttgctcaagttccatttattttttggttgaaacttgaaagaggcagtaataattgtaagatgatttcgtgaacagtgacaggtttgacgtagctgatttgatctgtcagatttaagcacgagccagatcaagcattttctgctgtcgtgagtaaacatgtctagaattctactagtactaattttaaatttttaattaagttcatagaaatatagaatgccagagaggagattgagttggtagtgggaagagagtggcaggcaagcatgcatacacgttcggcgatgctgtgtgggtcggtggcttgccctctcctcgcgcgcacccgctgctgccgcggcggcgccgtgccaccgccaccggaggaggtgaccggcgccgtgcctccgctcgccgccggccctccgaagctctgccccgacattgatcctcccttgaaacgacgaagaggacaatcttgatgtttgagtcgtagagattaattacagtggcaagttcttgagcgatcggcttgcttacctggccgaacggcggctgcccggcgccgccgctgccgccgtgcacgccgaacccgttgaacagcgcgtgctcgcctccctgcaaatgaaagagaaatctcgtcggagaaggaggagaagatggtggtaaggaaggagacgagagtttccaagaacgtgggagcacgcacggcggcggcattgggcgacttgaagccgccctccatctcctcccgcggcggcacgttcgtccggtccgtgaacagcggcagcggcgagaacgcgccgctcccgtcctcctcgccgccgccggcctgccggtgcagctcgctcagctgcagcatcaccggcttctctcccccgccgccgccagccccaccgatctggtgatgccggaggcgggacgcgagcagcgccgactcgtcgaacacctgcgacgccgccgccgccgctgccggatcgacctcccacggcgacttccccgccgcgccgccgccgccgccccccaggtcggcccacgccgacggcagcgtggagagcatctggtcgaagaagtcatcctgcgtcccctcgccgccgccgccggcgaccgtgtcgcggctgctcggctgcatggaggcaaagcttagcttagcttagctgaagctcaagctgacaagc

SEQ ID NO: 68282 - DNA, 1078 bp, Oryza sativa
ccaaacacgtgaagtgatgaaacatgatgagatataaattccgttttttaaacatatatatgatgcagttgatttttaagatacgtttgttcattcattttattaaaaaaatacatgtaattaccatttatttttgttatgacttgacttatccctataggttatttaagcattatttatatttttttttatatttgtacaactttttgaataagatgaatgatcaagcatacgtttaaagtcaactatatcatatattaaaaaacggtaggagtactccatactgaactaataccgtgtgcattgagggaaggtgggtctaatatcagtggtgtcctgcattgggcctgctcctatttggatgagacaactgtttatattttaggcaaaaagtagagattaaatcacttcattttaatctaaaatctatgctttccactagaatttaagagttattatagccatgccaaacaaaccctaaaagctcatgtagctcatctactgggcatcctaaaaggaacaggtgtccctataatcataagttagcttgtaaagttaatgtagatcatatactgggcaggctacaaggaacaagtgtcccaataaccaccagttagctcgccaaatcatgtcaatcaggtcagataatcactaccagatgagagagcgaacgaatatgttatctggaggccctaattttgccattgtttagttccaaaaaaaagaatttttaggtgtcacatcggatgtttgactgatgtcgaaaggggttttcggacacgaataaaaaactaatttcataactcgcctggaaaccacgatacaaatcttttgagcctagttaagcagtcattagcccattgtgggttactgtagcacttatggctaatcatggactaattaggctcaaaagattcgtctcacgatttttatgcaaactatgcaattagtttttatttttatctatatttaatgctttatacatgtgttcaaagactcgatgtgatgtttttgggaaaaaaaaattaggaactaaaccaggcatgagtagccttatttttgaaagtgcaacttacag

SEQ ID NO: 68283 - DNA, 967 bp, Oryza sativa
attttgatcagttcatcaaaaaatggcttgtgctcttatcagccaagggaatcaagatatgtattgctggacgatggtcgcaaactctgcctggagtgccttgattctgcagttatggatacgagcgagtgccaacctctttatcttgaaatacaggaattttatgaaggcctaaatatgaaagtggaacaacaagttcccttgcttcttgtagaaagacaggctttaaatgaagccatggaaggagagaagactgtatgttgaccaaagctggacaatccatgattctcctgtttttcactatactaatgttagtaaatattttgtttcctgtggaaaccagggtcaccaccatcttccagaaacaagaggtttatgcttatcagaagagcaaactgtcagcacggtgagaactattctgagcatgagatgaatggatcttttcataatttaaattctatttcaattgtattggtctgctgtgttctgacttctgactgagttccagcatttatttttaatattttagatattgaggagaccaagaatggctggaaataaagttatggaaatgataacggagccatataggttgactcgtcgatgtgaagtgactgcaattctcattctttatggtctcccaaggtgaaccacttactatctgtttcataatgccattgttaccttgttgctactcttttaatatcaacaaaaactaggaggaatattcgaatttataactgatttgaaataatatttctttctgtgttggagaatacattcttctaaaaaatgttatggattcactgaagatattctggactgcatgctgactctacagagttaatgggaaaagatattactcttgtgccttgtcactgtagcttttgcagtacaatatgcaaattatttgttgtgttatcatttggttcttctgtattgggacctcatgaagtacattgtcggt

SEQ ID NO: 68284 - DNA, 1951 bp, Oryza sativa
attcctgcagccctaaaggttcaaagcagtattgaaacctcaaaagaactaactataagtagctttcaacatttaattttccattaagctaagaaaaccaacaatgaaggtttttagtcaatgaatataaagcagtaacctgaactggggttcccgttaagagaacacgatgcttagtatgatactctttaagttgaccgaacaacttggaatctttgttcttcaaacgatgcccctcatccacaatctgcaataaagcattaccaattggagaaaagtcaatcagaacttaagagcaatttaaacattctccagagaattgaagcgtatagaaagggagatggcaaaagaagtaccatgcattcccattctatggtttttagaacagtagaatccatattgatcatctcataagatgtcaaaaggacatcaaattttattcttgattgtttcttgtcttcattagatggagatgatttctttttcttaagcttcttaggtttctctttggggtagtaaaattcatacttcctaataatttcacgagaagctgcagatccaaaatacattacctggcaaacatgaagaaaaaaaataagtcgaaagaattatgagttagtataatccacgtacaacattataaattagtataatccacgtacaacattcatttgaggtgcccaagttgcaaattcacgctcccaatttcgcaaggttgaaaggggtgcaacgaccagatgaggaccaagcttgtccactgatagagagcccaaaaaggcaatactctgtatcgttttacctgcattatttttgtagtgataagtgtactcacttggtcaagaccccaatacagcataccataaaacactttcattcttaacagtaaaaatcacttaccaagacccatctcgtccccaagtattacacgtttattatggtaccaagaatagcgtaagaagtttaacccttcaagctggtagggatgtagtgtcccttcatgtaaaaaatgcaaaataaaaaacaaggaaatatgtagtcaattagaaataaaaatttaattcccaggaattattcgtgttttaaatgcagcataccaccagagagaaacttcgggctctccttatattgacgtatctcacgagtgacactcttgcacttgtcagtagacttcttcctcctggactgaatctcattgaagcgttcaatctgaggctgaaagactgcaatgtcggagtcattttcccaagtacattcgtcgtatgttagttccttccatttcacatagtactccctttcaccagtagagctttttcttttttttcacaaaatatttaaaaaaaagacaatcatacagtcagcctttgctaaaaattgatgggtgtaaagaagataataagtgaacactaagattggtgaaactaacctgacagcactatgaaagtaaagtggaatgatgttattatttctcgttaccacatttaattgaggaataacatgacagcaatagggttttcacacggtatcaaattaccttcaattggaaagtttgtcgttgagtaataggctaactatcatggtaaacattataaatggagtacatattaccactaacagcatcaatatatgcatccacagtaacagtaataactattaacctaacacaaagctacatgcatgtgtcagttaccaaagaaaggctggtctagctggtcatattatcataatattaatagcaacaaaagcaactaattatcagccagtaaatcacatcccttctattgtcacaactatacaaggtaaaaagatcaagcctcgcatagctttgttcgttgtatccatacctggtagcaaggatcctgtcaacagtagtccactcaggtctaattgcagaatagtcatcatcagacttatccgttgaatccatttgcttatggaagttattgagtctagt

SEQ ID NO: 68285 - DNA, 4797 bp, Oryza sativa
tttccgtaagagggctaacctgaaaataacaaatgaggtgctttgttaccagcggtgtcaatcattaagtggaacggagtctactgaagaagggaaatgcatacacattcagggcagctccatttatcagatgtgatatttaagcgaggaaccaaacatttcctgtgaaatgcataagtacaagttgaacatggtactagattgtcattttctccacatttctggcaagcatcttctttctgcacacacaggtgaataactacaaataaatacaggaccattaaactgaaaatagatatatcaagaaatacataagcatatgaaaattacaggaagttaagaaaccaagccccgaaaaactgaagctccactacacatatgagaaataaaaagccaagtacaaaatcaccaaacgaggaaaaatggaaatgagaatgatgatattggcatgctcccttttgtttaaaaacagattgaattaattttcttacaaatctcagcaaattgccaactcttctagtttatgataaaatctttgaaccaacaaaataatgtaagtttagctatcacgacaaggacagttagaaacaccgtcatcacctcttatcatccaacaattaaacttggtatactaaggcatcgtatatttctcaggatgcacactagagactgtattttttcataatcccgaattagtagctgcttaacgtagcagacagatcaggcctaaattcaaatttcagtaccccatcggtaccaagcaacaaactcattcaaccaaatcacccactggctttctcaaacaccagccagccaagcttaacctatcaccgccaaatccctaaactaatcctcccgcttctcagcaattaagccatttcacaaccgactaccctagcaaggcagccatcaaattccccaaaaccagaagctaaaatcctagcatggcagcagccaattccacaaaaaccacagaaatcagagccaattcagcagtaacagctttagaaatcagagcaactgagaccaaaaacagaagagaagagaatcagggcccccctgatcggccgccataccgcgtcctcccgctcgatccgctcggtggggccgtcgctgtgccgatccctccccttcccgcccccgccgcgcggcgggaggtcatcgtcggactcatcgagcgtgtacagcggccgcttctccgaccgcacccgcagccgctccaccaggctgctcatcccgccgccgccccccggaactcccttccggatcaaaaccctaaaaccacccaccctctcgccgcgccgcgccgcgccgcctcggagttgggggggctagggtttggtggtttttgggggtagggagaggggagcgtacttatacccccgcgtgggggagggggagggtgaggtggcgcgtggagaggaggcggcggaaatggaaggtagtgacggcgaggggaggcggcggcgaggcgcgtgcccctcgtgtgggcggtggaggaggcgggcggcgaggggacgcgtctctctctctctctttctctgcgtgtgctctcggactcggagagaggagggggaggagggaggcggtggtaacggccactgcggcaagggatgtccaggggcagtggcggttttgcgattaggctcttgggatataagacaaattgcgaccggattgttgtaaggagtaggatttatgggttcctgtgcttgtttgggaatcatggacctttttgtggaaatttatttctcatggtgttgtacagttgcaagattgggaaatcttgttttcctggtgtgaagttatcaaaaagtaaaagttgttgttgctcttttttttccacgggtgtattaattgttattgaggtttgttatattaggtggttgtccggaaataaatatgataaatgttgagatgagtaaatagaacataccttgaaagaagtattctttgtgttatctctattattttagaatgggagttccatctgtccctcaacccttctcatcctgccaaagttttgttctcttgcttaaaaaaaccgttccaccaaaagaaccagttgacccacatggaaaccgtcaattgagaaaatcaaggataaaaaactaaaccatgtgaaaactttgaccgccctttacaggatcatgctgcccttcctagtttggaaaaaatcagaaataaccatatagtatttgtaatcactatggtatatacatatgtagtaagttaatagcataaagctattcaagcaaaataggaatgataattcatacggggaagcatcactagtccatgacccttcccatcgcacgcaaagttcggttccatcatgtacataagtaaattgctccacccaaataaacatgttgacccatatggaaataaattcgttgagaaaaaactggaataggaaaaattaagggcttgttcacttcattgaaaaaacaattaccaaatttcggcattaccaacctttggttaggtaaggcgaagattggtggtgttatgtttgtgaccttaccaaactaaaccacatgaaaaccgttggtctggcttttcccgatatccctttgctcttcctatgagaaaataaattaataagtatatatatttttaatcactactatctaaatacccacgcattgcaacagattactcaaaaatagcaaaaaaaaaaagtgcgtccatgttgaacaaatattaacagacttggttgaaacgagtttcttcatcttacaaacaaaaacaaaaacaccatagttagtgtaccgaaacaagagtagcggagtaaagacaacaaaattactccacacaagtatataaaaaagctagcaaagcactctcacatccatgtctcacatgctagtggtggtggcagactcactactcaccactattgtcttttagaagtagtatatatataggatacatatggatagttccgataagaaaaactaaaccacatgaaacagctagcatgccctttccgttagcaattttgtccttcctagctggaaaaaaggaagaagaaataaatatatacatttataatcactacgaatatgtgtggtattgggacatattattccatcaaattagggatgataattcttgcaattccaacatgaaacatagtgtgataaaatgacacgatgatcctaccaaagtacctgagatgttgggtgattgaaggaggatgtagtggagattactttttaagaaaaaaaaagggaatatgaggattcataacgagcacaatgaatagtaaacagtaaggcaataaatttcttttaaaaagacattgaaactacgcatctgacgagggtgtcaagcttcacttagagagcaactaataagtcaacaacaaagggaagcggtttggcagtagaaccatggatacgtgacttcttacactagggttcgaaaccttactgggcatatatattacagtgtacaattatggttgcaataagaatatagtgaggtcaacaatttaccactagcctttgtgtctttgagagtgttataagcccatatgcacctaggggtagttgtatttggcgtagaggtgagttacaacatattgcagcaactgaaataaggtaagttttgtctcaagaagcacatagagatgactacagagaactttttgaaggtgacaactttggagttcatacgagctttttaccgttacctatgtaggttcaaatttgtgtggaaaggatgggcaatgttgggcattactcatacattgttagtttgatactctgaacaggattcataactttagggtagatcgcaaatgccatagttcatagtacttcatactctacatggtcttgcacacgagtagaaatcaaatttgaagtgctccgacatgtaaagtcaatgggagaatagctactttagttcctaaagtttctctgtaggatctatttagtttctaaccttataaatggtccaaagaaatccttaaactttatcataaggcctaaaatagtccttgggtccaccaaaatcatcatatggatatgtcatatcatcattcatgtaaaatctatgataaattgtccaatctacccttatgtatatcataaaaaataaatataagggtgaatttgacataatcataggaaaaaaatacttcttttttttcacccttctgaggtatattttttctcatacatataccatatatttttgtaacttttttccttttgtttttttattttcctatgcataaaggtaaattggacaaatcatatagattttgtatgggaaggtgacatggcatgtccatgtggcgattcaggtggaaccaaggattatattagcccacatgacaaatttaaagaactagtttggacaatatgaaagattaaggactaaaataatccaggagcgaaactttagaaactatattagctattctccctaaagtcaatcatatcctctacgcgtttaagcgttttgctctgctgctgaagacttagctacatttatgaactcgaggtctgcaacctggcagtcttggcactctagttcagtgtaacatgtgaaaagagaaccaagagttgctctgtagaatatgtcaaaaataaaataccccctccatccctaaatatttgatgttgttaacttttttaaacatatttaaccgttcgtcttattcaaaaacttttgtgaatattatttaaaaacttgagtagtagtagtatatttaacaatgaatcaaatgacaggaaaatagttaatacttatttaaatgtttttaataacacgaacagtcaa

SEQ ID NO: 68286 - DNA, 1701 bp, Oryza sativa
cccattagcaaacggtgcactgcaattgtagtacacattgatcatagctgcaatagccaagagatttatactagaaaaaggtgttctgcttctgctaatggttggagactaatcagaaactacaagctcagcactacaatactatccaaacttccaaactcagcaaaaagaaacaaagacaatggagacgaagcacacgtcggggatcacaaacaagcttacccgttgagcaaccaaacttgagaggagtagttcgatgggtcttgctccgggaagcagagctccacctggagtgcaggttttcccgtccatttcccgcagtctctgcaggggtaaagcgccggtgcgccgccgccctgcccgggaatccgatgatcgaagaagtagacgccgccctcgaagccggggtactgatccgtgttgtacgatctggagcagccgcgcccgacgaacagcatcctgccctccagcgagggcagctccctccagatgtatcgaaccacgtcgccgtcggatctggagcagggatccccgacgaacagcatcgtccggccatccagtaagggcgcgtcgccgtcgccgtcgtcgtcttcctcgggctgtgccatccggaacaccttgaacgccgacgtggactctccgggacgaggagagcacctcacgaccatgagcagctctccgctggactccacgaggtagcgcgccacgacgtgctgcccgtcgtagccgcgcccctgcgacgagaagcagcgatactcccattgcacttgaggcggcgcgttcgcttcgtcatcgaagcccggattgcccacgacgatgtgctgcccgttggtgaggaaatggaaggctccattgtggcgcacgacgtccaccgcatcccagcacgcgtcctccatgaagaagcagccgatgaccaccttatcgtcaattcgccagaacgcaatcttctgccggtggtggcccggtacgggagcacaattgttgacgaatccggcgaccacgcatccatccataaatgggtccgacgagagggtggcggcgttgatgaacagcgggtcgcgcgggcgcagccgcttctgcctaggccgcaatacaggctcttcgcggtccaactggatccagacggggagaacgaaggtattcggggtttggtggagattggtgaggaaataatctcgataaccctgagctcgaggatgagcagtggagacgaaggcccagccgccgtcgtacgagccgaagtagcaagcgtggcgaatccactccgggacgaagaaggggtgggtggcgcagtcgctcaggacgcaggagaaggccagctgctcggcgagcggcaggatgagatacggcagcttggggggcgggagcaggggcgggagccgctcgaggtgctcgcgccatggtcggcagacgccggcgaggtgcacgcggttgtacacgcaggggaggcggttggcgatctcgcgcacgacggcgtcggtgaggtccgcccatggcgggaagtcggccatgagagacggagacggtgggggagggaagaggaggggaggttgcggactggggtggagaagaagaagaccagagggatgggaaggtttgattcctcttgtagcttcgggaggagggagctgtgtctgtcttcggagtggattaagggttggtttggtttgttgcctaaataggtcttactaaattttgtca

SEQ ID NO: 68287 - DNA, 1536 bp, Oryza sativa
gatggcgccgctaatctacccgttcgctccccgtgcgactttcccttttctcggcgtcatctcactctccctccagggcttggcacggagcacgacgtgacgacgaccccgttcttttgcgtcaccgccctcgctttccaactaatggcccaatagggaactgaggcatcagcgagcagccatgcaagtggcggccgggcgcgccacgccgcgcgagggaaagcgagcgattgatgcgcgctgctgggctggctgatggcctctcgggggatctttttgttaagtaccgcaatttcaccacatgtcgatcgaaaccccacaaaggggcacggggcacccaattgaaacgtgttgccaattgtggccgtcgcaaaggaaagtcaccgttgggagctgacacgtaggacaggatcgatcgaccagcgaccgagcagggggtagtgttaactttatgttgggtcgctgttgaggtctacggtctccgagaaaaagcgtctggagatgggatttttttttttgtgtgcgcgtcgggtcaggtagtggaccaggttggttgggaatttggggccgacccgatggatcgaccgaatagtttgtgctgaccaattggtggtctgcttataaatatactctatatagaagcgtttggttagctgatcgtgcgatcactcacaagattttgttgtcatatgcagctcaattagctaactaatccatgctaactaagcgtgtgtgatctaacgctgattaagctgtgtccatatgatcggtacggcccgtgggtaataataatttattaatttgtcgttctgacctgcattgccaggttcgctggatccgggcgctctactccaacttcaccgagttcaccgcggaccaggagcggctcatctccctgcagcacggcggccggcggttcgactacgtggagggcttcgtcgtcgccgccgagggcctaatcaacaactggaggtcgtccttcttctcgccgcagaacccggtcaagctcagctcgctcaagcaccactccggggttctctactgcctggaggtcaccaagaattacgacgactccaccgccgtaaccgtcgaccaggtgcgtgtccgtcgtgccggcgcgatcgcgcggccggcgccgtctttcctgattcaccaataattctctgcctccccccctgaccgcccatttgtttatgacgaaatttcttaattattcctactggagtagtttagtactctaatggcagggcacctagtcaatcattgggccatgtttttagttagttatgggcggtttagtcaagctctctagtgtaatccaagcccttgatgattgtatgattgcacccacatgctgagcacagtggatcggtggatcttgcaaacgtactagtagctgtctagatcttagtcccactgacaaaacatgcactattttatcgaccacttaattaatcaattattacgcagtactagctattaccactagtatagtactatacgcaagtgatgaaaaagaaagacgaagtagatcat

SEQ ID NO: 68288 - DNA, 1408 bp, Oryza sativa
gcaccgccggtggccccatcctcatctaccccatgaacaggcacaagtaagcagctcgccacactcatgcccccatatactatatccagccaatctacctgtcgtaacagtaatccagtagcactcgcgcccgcagcgtcacatgaagcgcggccgtcctctcacatgcggcgcaacacgggagggcgcgggcaggtggccgatgggatgcggcgtgcgcgcccgcgcgcgcgcgagagagagcgtcccatgattggcgcgggataaacaaatatacctccagatgggcagcagattgcacaggatggatcgtgctgccgccatactttaattccgaaacgcagccgccgcatctccggtgactggaattggccgcggacataccgcgcactagggcgacagggccctattctaatcgctgcgtggtggcgccatgccaatgctaggaacagaacagaacagacggggggcgggcgcatcatcagtcaccttcaccgccttgcgccgaccggttattctaaccagggcgcgcgccgctcccgttcccaatcgcctttccacggcaccagttgttaagcttcgctagtggccagattgcacatatgtgttgtcgctttcacattagtacttaacctgaaaggacgtgtcgatcagaatcagcacagatcttgctgctaactgttgttgcttttcctactctgctccaatctttcctctctctttttttttctcggtggatttaaatactaaagagaacttgatttgcgtacgttgcaggtgggacccgaggagctcggtggtgacgccggaggaggacgtgttctacctggtggcgttcctgcggtcggcggtgccgggctcgaccgacccggcgcagagcctggaggcgctggagcggcagaaccgggagatcctcgagttctgcgacgaggccggcatcggggccaagcagtacctgcccaaccacaaggcgcagcgcgagtgggaggcccatttcggagcgaggtgggctcggttcgcgcggctcaaggccgagttcgacccgcgggccatgctcgccaccggccagggaatcttcgactcgccgccgctcttggcggagtcctgaaacgaagacgatcgacgaacaagatgatggctagctaggcgcatgtaattagtaagaatcataacaggtgattagttagtcttaatctgatgtgtagattcctcgccccataaaaaaaaatctgatgtgtagacaattctgtacagagggatgtatcagtttcatgcaaaatgtgtgcaatgtttttttgccggtaaaagtcggcgtctgcctccagttcctcttcgaagcgtcgtagttacccaaggacgagatatctcaatcactgatccatcaacaggttcaggccctgttccgcat

SEQ ID NO: 68289 - DNA, 2598 bp, Oryza sativa
ctgtctagctatctcagttccagggtagcaccctctgctctataatcttgtagagatttcgtggcattaattatgtttcgagttgttaattagattttcaatccagccattattagtttgcgcaagtgcaaaccggcctgcaggctgcagctagaatctccagtttttaattaataaagtaaatatcaacataggccgaccaatccgtgctactggatttgcgcacagctgcacgtgtacgaccgacgaacgtgcgtcgtacttgcgagagtgtataccttcacatatgttcaaccatatagtaaactccatattgtagcatatctatttttacaagcaatatataacatcattgacttttatatatgttttatcattcgtcttatttaaatttttacaaatatatacaaatataggtaatgtttaaagaacatttcaatgataaattaagtaagaataaaataaataataattatattttatgtttaaagaacattttaatgtttacgtgcgtacgttcgtagtagtgagtgtacgtgcgttgtgagtgtctgcattgtactgtgtaattcttaaaaaaaataataatcatatttttttaataaaataatagtcaaacatattttaaaaataaacaatgtcgcactccctccgtcccataaaaagcaacatagtattaagatgtgacacattttaatacaacaaatctgaacatataggatgtgtcacgtcgtagtacgaagttgaatttttttggacggatggaatatattataaaaacggaaagagtacaatatatcttaggtgtagctatatttatggcgccatatttttcatcaaaaaatagtcggcatgtatttatattgtaagtccctaaattacatatgtaattttagtgtatttacaatgtaagtctcaaaattacatatgtaagtattaaaattatatatgaaaattcaaaaattacatactaattacatatgtatgtggggtataaatgaggtgtaactactgtgtaagtgactgaaaaaaaatcaactgtaacatatggcgccatatttctagcaactccgtatatctttagttttcgcataagaatacacgtatatggtcggtacaattatgcaactccgagggcaaagctagcgctgctgcatcacggcgcgttaggtcacgcaatgaactggataaccaaatctcatttttcatggcgtataatttccaaaatctcgatgaaagtgactggagtactatatgctagtagcaagtagtacgtatattaatttattttctatactagtacagctagctagggtgtggtgcagtgttagcaacatttcttgccgacatgtacacacttgaactcctatggctatggcgttcatttgagtatctttctgcatgcagctgtgtaaacattatctgtaattgttgcgtacgccaataagattagtttgtgctattattctctacaatcatctctgactaatctgtcaatttttctactgtgctactgcgaggaattaatgcacggaatgatcatcgtgttttcttacgacatattgctggtggcggggtgatcgtcctcacatcctgtgttgatagatttggctgatcagatcgactagtcgtttccaaatactcttttactaattggtacagttaatcgttaacatcgtcgtgcaggaaccccacacatacatacatacacacacatatatatatatattttttacctcgtttttcatatatagcaccattgatattttaacaaacatttaactattcatcttattaaaaattaaatatagaaaactaagttataattaaaaattttgatgattaattaagtcacaataaaataaatgataatcaacggcccctactaaaaatgacttttttgaatgggcaccccaatagtttacggacggatcataagtgttcgtgtatgtaaaaatcgaccctcatttttccatacagctccttaagatattcgtatgaaaaatatttttttcgaacagaccacttaaaatatccgcacatgaaaataagggtattttcacatgcgggactcttatctcacccgattgcaaaaaatacccctagaagtttcccactcctttttttattcttcactctctcattctctcccccccctcacccccactccactcctctcctctcccgctctctctccccatccggcggcggcgggcaacgatgatggtgagggcttcctcctccccccctcctcctctcccttctcctccatcccgacgttggtggagggttcgggcaacaggggagggaggaggaggggcgcgatggcgtggattcgacggcggccaccctccccccatgcaacggtggtggatcgacattggggaggcactggaatggcagattcggctctggctctagctccagcaacaggagcgggcagacccggctgcccctagccggcttcgaccaacgacggcgacgacgaggagggcggcggtttctagggttatgttttcgtgatttctagtttctttttttcggatttctatttttacgtgcagacgacataagcacccacacgcgaaaatcgtactt

SEQ ID NO: 68290 - DNA, 3438 bp, Oryza sativa
tccgcgagaccgaacggtctcgctcttccattgcgcgaaaccgcgcgctctcttgccttcgcggcgcgataccgcccatgacgtcatacccacctcggtttcgcgcaacggttgtgcgagatcgacagtatatttacacaaaaaaatttgcatcccgaatattcatgaaaaaaaattgaatgcatagtatatttttagttttaattctaagatgtgggccctgtgattctatgaagaggaccgaacgtagcaaccaaagcagataaacagtactactccccggcggcccggcttaatgccccggatatggttgcagttgcgcaaggaaatcttatgcgtgcgtgcataaggatcgtgtgcccgtacgtgcgtctgttcatgtatgcgtgtgtgcgtagtatatatgcatgaatatgtcacagtacgtaatgcactcgtaagcgttcattctagctatatatacccacatcttacaccatgaaactatctcgtttcaaaatattcctctcagcaaaaaggtcgttgtcaaaccttaagtacttgtgtggtcgtattcctatatattccacacatcctccggtagttttctttatgtagatgtttaatttaaatttgtactaattgggattggacttttctttaagaacgaaatcatatgggcgtgggcacgtaccaccttgacagacaggcacacgctgacagtgaaacggaaatcctaatttggatcggtgtacgctagctcgcgattaacatgacagacacgtgcaaattagtatatatcaatttcccagaataaaaggtaaaaaatcacctacaaggctacaaacacgtatatagtcggatcaaaataatcatcgtgaggtgccaataattaaggtaacggtgtggagcaagaacccaacaaaaccaaaaaccagacacggccgtacggtgacatcagaagagatgttctcgctagctacgtgctgatcatgcaggacatcgttggttcgcttgcatgtgcaatgccgggtgacacgatcgagatgtgatgcgatgctatctcggcgcgagttaatgaggatgagccaaaattagtgctcgcctcatcatatccccggaatttgactgtttgaaacgcctgcgcgcaggatcgatcggctacgttgtctgtacgcgcgcggcgttctcgcgtgacgcactttggcagatccatcccgcaagagatcatctcgatcggcgcgtcctctcctccccgtgcgggccgggacaaaccgtgtcgcgtcacgtattttatctccgtatatctcacggcctgcagtccggctctcgctcgatcgcccgtccgtgcgtgcatgaaaccaccatcaacacatgctcgtgtcgatcgatctgtataccacgtaccactacgactacgcaacaacacatgagtaggtttttgctctcaacatgttccgttttttcccactagaacgtaggttgtgctagcttttaattctggcacaaggttgttgcagcgatgtgcatttatgtgccagtaccgaccatgtgtaccaaactaatcggattgatcgatcgatcggtccaacgcgcgaggtgccggcctgtgcacgcgcctatccattggccgcgccgcggaatcgtacgtaccgctagctgctgggctcgatcggtcgatggaccggccggttccctttcgttgtcccactccgccggcgacaactgtgcatgccggaccgagacacgccggatcctcggcctgagccagcggccggccggggcggttccaccaggtgcatctcctttgatcgatcgatcgatctcctagacatcatcgttgttagtgatcaaagatgtgatgggcggtacgtgcagcattgattgctcggcgtgacgatctctccaatcggagcgatggagcggcacttacgacgagcagagacgggacctcctccgtgtcattaggaaaggatcgcacagtggacagatgatgacaattgacagtctggtaacaatgatgatatccttatattaaaaaaaagaagaatgataggtgatatatatactactacgtagcatcacagtataattgaggagaaggattttaatcactcaacggccggtgagccgtccagaactacgcatcgatcaatcaacgtcttttaacatcgactaaaaatgtttgcgtgccacggttactagcgacacgaatatatcgagtatatagtggagtactacgtgaagggatcaaatcaaggtggatgaagacgtaccgacacgccatcgccttcacgttattacatcctaacgctgtgcacagtacgtgcccggtgcccctcgatcgccctcgtcttataaatgcagaagttgacgcctggcgtacgtgacgggctgaccggcatgcatgcatcgcgtgtacacaggtgagggccggccgggagctagcaacgcactcgggacggcgcgctttaacgcgcggccaaattaagcagcgccgcggaacacacaggactcgaccgatcggcacgggcgggcgcgcgagctaggtgccgaggtggcgacgtcgcatgggcgcatgcaacgcccagcaggcacgcacgcgagagacccgaccgatcgacaaacgtgcgagcaattcgatccgtgggcccgaatcgggcagggggatctctcgcgatatcgatcgatagcgatcgagcgccgccggccacgcgaaacatgcacggtcgttgattagctacgagagcctacgactctagcaaggcataggcacacggaccactggcgccgcgccgggcgcgcgcgcggtgccgggtggccgatcggctagctataggctgctgcatgctggatcggaagggaataatcttaggtcgactccagatcgacgacttaggtaagcatatgcatgggaatgtccgtttgctgctggatggtccagtagatggtcctatagctcgcaacgtacgtactgccattaccagaaggaatggaatgcgatcgatcggtcgatttgccggaacactgcaattaatgctgcatttgagcaagttcaatagtatagccaactgttggctctaaatcatatatagccaatttaatagcccattcatataatagttatctataaaaatatacacattattaatacctagtcttacctctcatacactcataatgtattagagttcgtgttgcagccgacttcaaatctgtagcccgatttcttctctctcttctcttttcttctcgatatgtgattatagctggcttatagcctgctattgtacctgctcttatgctcttgcgacttgcgaggccggtttttggttgctattgacttgatttttagtctttaatctattttttttccgtttgaagaaaaaaaataaaagcattatttatcctttttattacatagaagatgcacacacatctcaacacacgcgttcaaag

SEQ ID NO: 68291 - DNA, 1205 bp, Oryza sativa
ctgcaccccgttgctaatcatgacaaacttctcccaggtttgctgttattatgttggctaaactatcttatgtgttcctcacagtatttaatcacacccttaacacatttcaggatggagccatttcgccagtttactatagctgtgggtaatcttgatccaaagaaagttaaatattcaggtgaggcaatctgtgattcttattgtttgaattaaacactctgtttcagagtttaactaagtaagtttgcagacaccctgcacaaattctggaagaaagaacatgactggggatggaaaaaatttatggagttgtcaaaaatccaagatggtttccttgttgatgatgttcttgaaatcattgctcaagttcaagttatcaggtaggcagtttaccaattttcaggattagcacctaaaagagtaaaatttgtttgcagttctatatgattgaaataaattgcatatctatggccttatatgtaaagcattccacagatatgcttttagatatgtttttcctatgtccctgaaacacgaaagatcacttcatttaattgttcctacgatgcttttgtgctaagatgattttgttgggggcatttatgctctccataattcaagttttactcttcatgtgcagtttcgacttattgaaatcttaactgtaccctgttgtgagctgtataaacctttcttttgtttttattgcatgttgcaacatgttatactgcgatttattcaaagatctctctttgttaatgcctctattttctctaattatttaagtcctagcttctatgtttaatttgtcaatgctcaactatggtgtgctcagaaatttggttatatacttataaattgattgctggacattcagtaactgttctcttctgcttttcaatactggagggagaaagtggatcgcccatttcgttgcctcgatcgcccttatcgacgagaattactccgtgtctatatgaccaatatagagcaaatttaccgacgctttgttgaagagcgcagaagtaaactttgcaagctcattgaggacaaaatgagatggtccaggttatacaattaaagttatcaacatcctgttatcctttcataatgattaagtatctgtgcgcgctcgcgtgtgtgtgtttttaaaaaagttaatactaacacatgcatatctttgtttgtactggggtgcagga

SEQ ID NO: 68292 - DNA, 1104 bp, Oryza sativa
ttcctgcagcccaatcaggctcagggcatcaagccacagtgcagtagcatcaccgtacaatctcacaccccgaattcagtggtggaggcgtggagctgaaagatttttttttagctcgagcaaacttcaatattttctatagaaattttatcatcaatttactcatcaatactaaatttaattggagtttttgccgatgagaccgggcagccaccgcctgcatccctggtgaaagagggatcgatcctgccatatcgcagctctgttcatggtgcagagaagacaaacattttcttttcggcacgtcaggcatgggaacgacgctttcgtccttgctcgactcctcgcgacgtctcttggtagagccaaaaatgccaaacagccagccactcgcgtagtcgcgttcgcgtacgggggaccggacggacgggtggagcaacacgggtgccatgtcaaaggcgagagacttcgccgcgtgggcgcatcaacggaaaagagccggtgaacctggccgcgttcccgccgctgcatgccgccgaagccgtcccttcccttgccggcgcctgttgcggtctcgctgcttttttcgtctttacgcatcgtctccgcacgcaccaaagctgggcaaatttgctgctcggcagcgggcgggccatcccgttgatccgcccgggaacccggcgtttctgttctgttcggctccgcgcggcgcgcgtcgccactcgcctgattttcagttcattgaagtcttcggtcttgtgtaatgctaaagtggacatgctccgtgccttcgtgacgttgcactgcctgacgggtcgatgagcagcttaagtgcatgaacggaagaacggaatttgcagccacggaagtaggatcttttgcagtgtggagttgggtagtatagtaccttggtactgtcaatagtttgagtactagttgtagtacaattcgacctttgatgctgtttaggagtagtgcaacaacctagaatactactgtatatgtgaggccccaacggagacaggagttacagtaggcattgctggtatggtattggtcaatggaccgacgggccaaaacacgtgtatcaggggctgcaggaat

SEQ ID NO: 68293 - DNA, 1506 bp, Oryza sativa
ttcctgcagccctggcatttgagctcactcgatcgcctacataaagagcgggatagcttcgagctacggcatgcaattcgtctccagcgccctggcgacctagctagctccctcctccgccattgccacagaacacaccttggtgtcgtgcaatccatcgctcatggcgctcaccaagctttcctgcctcctcgtcgtcgttttcctcgccggcgtgacgtcgacggccaccggagccaggtacttcccacagaacggcacggcgttccgcgagaacatcctcgtgctgcccaccgacctccccgcccaggccgctgcgacgaggttcgcctccacgcaggccggcgacggcgacgaccgcgcgctcgctctcagcgtctgcctcggcgactctgcgccggcgcagtaccgcgagagcctcgccgccgcagtcgcggacgtcgtcgcaggctgcggcgccgccagccgccgcgccggcgcctggctcgacgggtgctactgctacctcgccgccgacaccaacatgacgacgtcgcccagcggggggagttccaccggtggctcgtcaccggagacgtcctgccgttcagcgacaacctgtacgcgacgttcctcgacatgagcaacggcgtggcggcgcggatgctggcgacgacggcgacgcaggcgatcgacgtcggagcagccacgacgacggggctggcggggcgcgtggtggcgcagtgcgccgcgggcgtcgcgccggcggactgcgtgcagtgcctggagggcgcggcgcgagagatgccgagatgcttccgggaggcacgtcgggaggagcagggagagggcgtcggcatcgtggtgagcgacgactgcgtcctgcgtttcgacatgacttcttcgccggcgcctcggacgtcaaacacctgtgatgggacttgcaagctgttagccttcgccttcggagcagcactagaatgatcgtgtcagtgactttaatttgtgctccctccgtcccaaaataagtgcagttttagcactgttcatgttcaacgtttgatcgttcgtcttatttgaaaaacaattataattagtatttttattgttgttatatgataatacatgaatagtatttatgtgtgactaatatttttaatttttttcataaaattttcaaatacgaatggttaaaatactggacacgaatatctatggttacacttattttgggacggaggaggtagtagtaataaccatcgctagctagcttgatggaatcatggtgcttgagtggtagaaataatataatgtctgtctggggggtagaatggttgcctatatgttagcaacttagtagtactaccatgtttctagtgctttcggtgacactattctagccggttgtgtgtttctctttgtgatttgcaatgctatgctcagctagctgaatatatatgccaaattgtcaccttgggaactaaatagagctatgtgatccattgtattgctgggaaaaatatatgg

SEQ ID NO: 68294 - DNA, 807 bp, Oryza sativa
gggacttcactaggtagcgcgccttgacgtgctgctggttgtagccgcgcctgttcgatgggaagcagcgaaactcccagtcgacttgaggcatagccgggaccggacaccaatagtggaactccggtttggccacaatgatgtgctccccttgggtgaggaaatggaaggctccatggtggtgcacgacgtccaccgcatcccattccctgcgcgggttcagtgggccgctgaacaagccagggaccaccggatcgaagatgcgccagaacgcaatcattggccggccttgtgggacgggaccgacgttgatgattccggcgaagacgcatcgtccgtcgacgtctggatagaatgagagggcggcggcgacgatggacaacggcaacagcgctccggtgtggtgctcgatgtgttggagttaatttatttctagaacataccagcctactctctaaccctctctactactcgtgaaactaaagtcaaggttgaagtccttgctctgtaaattttctagaacagtgtagtgtgtagacatgcatgatgtgattttacagtagtactagtaccagtgaagtttgacaatgtagtagtactacaagtctctagctaggtcctgaagcttcctacatgtcggtttatcaagcctataaatagaaagccagtgcatgtgtatagactgatgatggtgtgctgcccaacgtacaagcaagtgtactgttcagccctcaagcaagcaagtaaagaaaccagttaaaactagcacaagcttctctgctcctcttctctgatcccctgcttagg

SEQ ID NO: 68295 - DNA, 1646 bp, Oryza sativa
  unsure (1)..(1646): unsure at all n locations
tgcacccccttagctgaaatataaatatatcatttgattgatatttaggataatgaacaactagcagattatgccgtgcaaatttacacggactagacagcatctccagcagagcccctaaactaattaacccctaaatagtttttggggtgaaaggagaaaaattgagatccacaggacggcaggaccgctattaaagcccctaaaatagaaaggcaccgaaatctctgtccatagccctcaatcctagaggctctacacccaaccccatctctttttctttttggtgcgtgtgaaaattccctagcgcgcgcttctcccgttgttctcgcgctctcactgtgttgctaccctcttttcttttgtcgtgccgccggctattatctgatcaccatcttgctaggatagtccaacgttgccctgtccgatgtcgttcgtcaacctacgtgatctccacactgacacgtcgcaggtcgttgacctcatgcgtagcaactctagcaatgtctcgcgctagtagtcggttgtccggattgaaccattcatgtttgtagtatatgttattttaaaaaaatcatataattcttgtgaacttgcatacgtgtgtgattgtgaaaattgaattttattatgcattttgcaatgttgaaaattttgaatttaaatttgaattatggtattcaaaattataaatttgaatacggttgaattctacgtgtttgaattattctggtgttaaactagacataaatataatgtgcgtactaaaacacacacacacagagatggagcctaagaaatggggtttgtagctgaagatgggggcaacccccattagacctttagaggctttacaatagggggctaggggctgttgctggaaatgctaattggacttattgtacaacactatttaacttttgattccataaatataattatatttaatctatcttgtcaactcttaacttttaattctataaatttaattgcaatttatatacagtcgaaacgtggctacgaaccacggtgtcgggggttcgaatccctcatcgcccacagccttccaaagggttcacattctttggctctacctatctattatagagtaaatagctcttttcacaataagagttatccatacagtgacagcgtttaattatgaaagttggcctttcgtggttcaaaaacgcggaatctcgtctcaatcatcatttgtcaggacttttcgggggtaagttctttggcttggacaggaccccagtagtcctagccgtaaacgatggatactaggtgttgtgcgactcgacccgtgcagtgttgtnnnnnnnnnnnnnnnnnnnnnnnnnnnnnnnnnnnnnnnnnnnaatgaaacggctcattcttcaacaggcacgcggtcagagatcactttcccctcccactgcttgggagctcagcactgtttcacgttctatttcactaccccctaggggttcttttcaaaatctgtacgattttaccaatctaaattgagcaggtttccatgaagaagatcttgttcaacatgttctattcgatactggtaggagaagaacccgactcggtattcttaaaaaaagctcctcggtggaggagtagaagcgttggtccccttcggtcaagtg

SEQ ID NO: 68296 - DNA, 2405 bp, Oryza sativa
atcagtctttagaattgatcaagattggcacccggccaacaactttcaaacggccacccgggccaacaactttcaaatggccacccgggcctagctgatcccatcagctgcagattttttaaacatcgaacccctttccacaacagcaatttcacaagtagtagtcaaacaaaactacactaggaatcacctcacatccgcccatgaccgtgggcacggctgttcgaacagtttgttaacctctgcagagggggtacactttacccacacgacattactaacccggatcacccagcccgtgtggatcagccacgtcgggagacctccaagctttcatgacaaggcattttcaaagccgacacaggtttaccatatgccgacgagaggggtcccagaccaacaacagattaggtcccagaccatactgtgccaggaaacccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaaattcatttagttcgcaagcaccgacccaggtgtcgggttttccaagtcttttgtaaaacccaagttttacccaagaagtttttcagattttaagtttgaaggcgatcgtcgatactcgtgcagagtgcacgattttcgaggcgcaactgggtggttacaagggaacatggtataacaattaacaaaggaaggatcaaatgcaacaaactaggtaggtccgacaatctgccttgcagacgggacaaacagattaagtgcgatcctatcaatgcataatatttttcaagcaacatgattaaattcaaatataggctcgaaatgttcaaaggtggcttgccttgctcgagatcttgagcttgatcctcgaaatcctcgcactgcgggtcttcgggctccgaaactacgcgcagaacgggacaactcaacaaacggcgaaaataaagccctattaatgacctctaagcatgccattagatagatcttaagatttgagggattttggaagttgaacggagtcaaacggatttacggttgggaagatattgaatttctaatattattggatttttggtctacaggaaaaggatttaattaaatcctttttgaaaaagaaaagaaaagaaaagaaaagagggagggaaattacacttccctcggacggctagggcgcggcccgagagaaaaggggcggctcggccgagctaaatgggccggccggcccaaggcggcccaaggcacgcgcgcgcgggaggggaggagagagagagccggtggaccgggctcacctcgcgtggtcccgagtgggacccgcttgtcagcggctcggctcaccgtgcggagggagcacgcggcgcggcgctaggatgggggagagacgcggtgcacgcgcgcggttcgcggaggacgcggatgcggcgggcccacgcgcagcctcacggctcgcggtggaccgcgcgcatggggagggagcggctaaccggggtcgactcgacccggttttggccgagctggcgccgacgtggcgcctacgtggctgccacgcgggccggcgggaggtagacgacgacgccggccgaaacggacggcggacgacagcggcgagcggcggagcgaaccacggcgatacaggcgaaagcgagcacaccgggtggttgcacaggacgaggggagacgagccaactgctcggattcgccggaggatgcccgacggcggcgaattgcggcggcggcaaccggcggcgggagaagggggaaacggcgacgaggtcacgaggggccgattcccggcggcgagagcatctacgcggctacgggaatccgatgctagcgttggattgggcggagctgcgccgagcgaggccggcgacgagcggcgcttccgagctcgggcggcgacggcggcgagcacacggcgagcggcggcaacggtcggggcggcgccggctagctacggggaggctactcgtgctactacccgagtctaaggggaggagatggagcgaggagggagaacggggagatgcactaccgtgcgggcgggcgcagtgacgagaggccgacggcgcgggagtaatctctccggcctcgggccggggaagaggaaggagtgggcgcgctcggagtccccttccgcgtccttgctcgtgccggctcctccgacacgcgcaacgacgaacggcgacggcgaacagagcacgggaggcggcggcaatggcgtggaggcgaatgggagaggaaaggaaagggggaagctt

SEQ ID NO: 68297 - DNA, 879 bp, Oryza sativa
tcgggcgtgatctccgcctctcaagggtgaggccccgtcatcgtggagacacttctcgagctattaagggacagttcagattaatgtcatttttttaagtaaagtggctaaaaaaatatttacatttagggtccctttgaatcacaagaatagaaaaacagaggaatagaaaatacgtaggattttgacaggaatataagtgtaaaacagatgattagaaaatacaggaaaaacacaagaatgaccgtttaattggaccacagaaaaaacacagtaatcggatgaaagagatagactcaaatgaatttttccaagagtttgaacctcttgctaacttttctccaaaatctctataggattacttattacataggaattttagaggatagaataggattcaatcaattatttcaaaagcttccatagaaatattttccataggattaaaatcctccaaatctcgtatacttttcctacaaatcaaaagggcccttagattgataccaaactttgataaatacatataaaatcctgtcaaaattttggtaatattaacacagtttagtaaggcttattttggctaaaatctaaacagctcctaaattggataatgtaatccgttttttaaagaaaattttctttatcaaacatttattaatttttttttaaaaaatactagtattatactttctaaacttactttcacccgtcaatctatcatccatgagtccgaatatattatttcccaacttctatttatttgtttttcacacttatgcttcccgaactgataaactgtatttttaaaaaaatatatatatatggaaagattgcttcagaaaattgtattactctattttaaaagttatgatacttaaa

SEQ ID NO: 68298 - DNA, 937 bp, Oryza sativa
attaaaaaagaaaattgttggccactgtatagcgtggagcattgtaaatgctgttagagcaagtttaataatagagccaagtatgagcttatagcttatattaggttaacatatatagtagatcagccataaggttatctctatttttctcctcctctctctatctctcacctttgcatttaatgtatttatcttgaagtatgtgaatggctagctcttgtataagagtcaaccctctttattttttaaattatctttcttccatataaatttatagtcggtttacagcctactattaaacttgctcttaatcgtcttcacggctgcatgagcgtgtgaggccgtgctagcaccggcgccagattagtcgcccacttttctctcccttctcaattttttcccatccatataagaataagatgatatgtcgtattttggagcatgcatgctgaatcagtttattgtatccgctctaagtaattttcatggtgtgattcgtgcacaggggcggatccagcatgggggcagtggtgtctcgagcctcactacaggtgtgaagactatgagaacctccacgaagaccccactaaatttttttaccatacgtagatgggttggtggactataactttatatagtttgctcagatcatactgctatttttttctggatccgctgttgttcgtgcagtaggtgcgggcatgtgtccaccaagtcggacatgttctgcttcgggccttcggggtcattgtgctcatgcgaagaccgatgccgccaacccccatcacggtccaaaattgctgagctacgtaagcacacgcctgacaaaaatcaagcagcaccagtagatactagtaccctgtagatgaaacacgcctcactacacgctgttacaaactgcacacctatagatggccatatggccgggctgcaggaa

SEQ ID NO: 68299 - DNA, 3040 bp, Oryza sativa
  unsure (1)..(3040): unsure at all n locations
caataaagttgcggtctccttctagcgtcttcaatcttttgttcaagtttgagatttcttcttgaagcgtgctaagatcagtcttccgactcactgttgaagaatgagcttctttagctaagaaaacgggctcctgggcctctcttgagctttcttggcattgcagtgagccatcatctacaacgtgcattttgttggaaaggtaatcctctatgacatctgaatttgacaagtgaatgttagtactgttgttggagtaggattgaagcttctgctccagcttcgtcaagcaatcaactatatatgccctctcctcttcaaagctcactaatgaatttataccacttggtgtggtaattgcaggagcttcaagaccagtttcatcaagcaaagtttcggcaatgttttcttcattaaaggagacctgattggattgtttctctgttggtccacctgcaaactgcatcctgtagttttcgagctcagcttccaattcctctatttgttgttccctctgagcaagtagctcgttagctttagcaagcgcatcactatcatactctgcttgttcttccatcatccgctggtaatgtaaagcttccatctgcatggcagccttgtcatcctgcaatctggtaatcatagccaaagcttgacttgcagcaatcgctgaagcgttcctttcttcttccagttccttgcagaggaggtgtatagattttcggtcaagatcaatctgtcgtctcaaccgttcagtggcactttcaccttccatctcacttacagtgctaccctccagtgactccaaaccagatgcatttctctcaattgaaattctgttcgtgatgttctgcactatcaaatcatcaccacgcccatacgcacgtgggctagggcctgggtcgacccatggagcctcgagtcctctggaagccgagagctgtgacagcagtaacctcaattcttcatttacactagaagaggaatcctttccaagaatcacatcagtcaaggtgggggatggcaagctactcttggcaccaatggcaagcttgtaggcttcattcatgctaatctgagtgcttagagatggtctcctttcaccaatagtcgcgcttgtttgcggatgttcctcgatgacattgagaccctgaaatacctcactgtttggtctaatagcctgtggtgatataggagcttcttccacaaaacctaaccaaaagggttaaatgtaaggaccagtttttgaaatactgttgcttgagggaaggtagaaatcaactaaccttttgctgtaggatctttggaatttgtattggaaggatctntgagtgccgcttcatgtgttaccatatcacaagtctgttcagcctccttagcataatcttcagcttcatcaacagcttcagaactagaattaacttgtgaaacatggtcatctctaaaattaactgaaagggaaaacaggtcggaataaagaaacctttcagacatatatcttgattcttgagaaatagtcagtcctgaggtacagccttacctggatcatcatcaaccaatgcacttttctggtgaaactctctacttgatgtaacagtaatttctgacctgtgaccttccagatcatctgacatttttttattgtgatggggggttagacgaacaggaagaaaataccattcagtttattgttaaactatgattaagatatacctattgtgctgttgtgctctgaaacagcaatgttttgttctagtgttgtggactgtgatgaacatggatcaatggtgctttcactcgctccatgacatgcctcgttgtacccaagattctgaggtgactcgacacttgatgcaactggaacttgggaaacattgacatctgcatgattatctatgctattaatctttcaaactgaaaaagaagttcagtaggagtcatcccagtttggggaactaacagttacctgtcaaacctgactcttctttgacagctaggggatcatgctggcatgtctgtttttctaatgaagcatcttctgcttccatttggccctcaccaatatactatcaggatgatcatctacaagaacatatggcaaggatatatcatatgagtcaccaacatcggtttccatcggaacattcatttctaatggcctgaccaactcagtggaagaagcagcaaatttctcggcagtggcatcttcattcaaatcttcctccatacaattggttttatgatggtgtgaaattttgccatcatcagcacagggagcctcatcctcggagccagatgtcatctgcagcacactgtatcgttcatggatggagtgatcactctggtgacaaatatctttatccaaagatttatccacttgatgaagtatggaataatctgtgcaaatctttggtgagcaaacagcctcagcaggttctagttctgtgatcattcgagaaaacattgtcggtctctgttgtgtataatgctgtgcacaacatgagcaaattcttgtatcatgggaatataatccttgattactatcaggtagagtggcagccattgttggctcatcggtgcggtcatcattgttttctacaagtgagtcactgcatctctcacacatactttgggcacctgcaagtttctgatgtagacggcagaaggccaaagatgagatctctgacttgtgagttttgcagatcaattccctgtagaagcatggtttctcattacccaggacatggtctagccttgagcagaaagggcacggtgccggtaatctgcagaggcgggcaaatctggtgaccaagaagcaataaaccgcatcgatgaacagcagcagcatcaagatccactcgagcaacaccgatgacagtgtggctgacaatctccgtaaggttggcatccttgtacccatctttgaacagtatgctcaattcttcacaattgctgtactcaagttctttagattggtgaaaggtggctggtgttgaaccagaatttctgaaggaatcaaaaacaaacttaatgagtgaag

SEQ ID NO: 68300 - DNA, 2731 bp, Oryza sativa
ccgatctgcgatcgcggcagccaggcaggcaggagcagagggcaaaaagagagagagaggagacggaaaaggttggcatgcgccgaccaaactcgccacgcctgagctatattattcccacccgccggaacgagccaaaaacgaagggaagggagacaaagagaggaagcaagtggagtgggggcggcggcggcggcgggggtgcgacgcctcgccggggcggggccggcgggcggctcaaccgaaagtcggctacgcgggccggcccgggacagcgacgccaccccggtcagccagccgaaaggtagtatggttggctggctcttccttctcgtctcctcgtaatactgtacaacatttgtattttggaacacgaaatttgtttagcccttgtttagttataaactttttcttcaaacttctaacttttctatcacattaaaactttcctacacacacaaactttcaacttttccattacatcgtttcaatttcaaccaaactaaacacaccctattcacgggagatgtgatgactactactccatcattttgtttatttgagaaataagctaaacaatatatttgtaaaggaatacttactatgtcaatataagagattttaatattttgcttacactgtttaaccattcgtcttattaaaaaaattagaattattatttttttgacttattttattatccaaagtacttttagcacaacttttcgttttttatatttgcacaaattttttgaataagacgaattgtcaaacagtgcaagcaaaatgtcaaaatcccttatattaggggacggagggagtaataatttgtaaataaaacttttaaatacgtgttttaacgatctaaaagcaaatgctaaaaaataaactacgatggaaaaaccttaaatcaatgaaattttaaatttcggctgataagtataagagtcaatccattttatgccatcgacaaagcgcgggtctacagtatgccactgacaaaactcagttctacaatataccatcgaatgactcattttcttccttatatgcaatcgacgttagtcaaccgttagtcaaccgccgttaaaagatgaaaaatgaccattttacccctagcataaaattgagattttgcataatgccatatcgcggtaaaaaatcttggatgataaaaagacaagcaatttctatttttcatcaatgagaataaatagtggatcatgatcagtgaaatcgatgaggatgcatcgtaccctaggggtaaaacagatattttcttgctcttaacggaatttgactaactgttgaccgccggcgatggtatgtaaggaagaaaagtagttattcgatggtatattatagaactgagctttgtcaatggtatattgttgaatccatgctttgtcaatggcatagaatggattatctttataaacataagcgaaaagataacatcgcacgagtttaaggttatgtgtatttttaattgtttggtgcaatttttttaattgaatcgcacgaatttcatgtgctccgaagagtgaatcgcgtgttaatatggtttgactgtactggtctcaacgtacctccggatgtagtcaacaatgatgtagattgttgtgctgccggtcgttgctcgcagactatggagttaatcaaatagtaaatcagctcatattacctttttttgcaaattagtttaggccgttttctatcgtacagtgtcctgtttcaaacagtataatacttgttggatactggatatggtattctatcagtatgaactaatatatattagtactagttgatatatatcagtatatataaggctgatacccgttgatgacatttgatatccatcggcatcggttggtgaaggttttattgtgagcgtgggacgcgtattgttgccgctcaggtgatgtatatgcatggtgcatttccctgcgattggttgcaagtggagggtgttaggcagttggctctcgatagtagcacctaatgagcaaccaaacctttctagttaatatattatgaactttcattatttttcaaaccttttaaaattgtaattttacgaataaacttttcctaactaaattttaaactctaaacattttgatcacgtcacatcgccttgtgtggcaaaataaaattgtcataccccccgctagactggtgtgacgaaacaatactcacttttggcagactggcgtggtcggccaaataaaacactggcacaccagtcagttcgacatggtctttttttgtcacggttgacgtggtcaaaatgttcatattcgaaaacaagttttgggagaatttattaataaagttaaaaatttaaatggttcagaaaaataaaaaagttccttagagttccaagtttagtatacgcatagactcatgtaagcatgataattgttgatatggaaaaatatcacctgatgcttcatacaattaaatattctagcacacatcatggtttcccaaaccaccgaggccggggttaccgcgcggtaaccgcggtaactgtggaaaactgtacgaaaccgtgcaaaatttatcaaaagttcaaattatttttaaacttatttaaatttaagaagggtaccatggtttttctattatcgtacccgcggtaagtccggtaaccacggtaaccgcgcggttaccgacggtaccataaaccttgtaacacatgcatatatgcatgaaacgtggtgaa

SEQ ID NO: 68301 - DNA, 1384 bp, Oryza sativa
cgttccgcggccggggggctcgcatgcaagcctagctagcttcacattcccttcctttccccgcattgctgcgagcgacgctgcttctgcttgcttggttcgcttggccgccgccagatgcgatcttctccttcctctccgatcctctccttggcctccttcctcccgttgctagctcgtgcatggtggcttcttcttcttcttgcgccggtttggtgatccttgttgcgccggtttggtggtgatccgatcgaggacggaggaggagcgcgcgggggatccggtgatgggagaaaagctgtgaaatgagatggtggtgatgcgctactccccgaggtgggctgctgcatcacagattgatgattgagtagaaatctattatactacgtcgtcttttcttgtagatggtttctttgtgctgtttaatctgctttttctgtagagctttagtttttattttattttatttttacatatcacgtagaaagattacaggcttttttttagaaggtgaaaaattgcaaattttttgaaagaacgaaaaattgcaaattagcgtagatgcatttttttactctttatcttggtcgtctgatccatccacggattcgtttgggtctagctaagaccgaaaggtatcaagaagctgggaatatctgcttttttggacaaaaagacacaacaagattggagtttttgcatctactagttcatttattaggatagttcgattcttgcatatgagtggaaaagaacttataatagactagtcttgactcttgactatgactcttatcagttagatggatgcccaactgcgttgttattatacagcagtataagaaaaatatgtacttttgtcatttgtaggggaactctaatttataattactttctaccttgcatgtatgctatgatatgaacagaaaattttctttttgtttatctgttaatcttttcaaagggtcctatttgatatgctccagtgtaaaagaaaaacagactcatgccatatgtcctgcaaataatcctattatcttttagctaaaaaaaaaatcctcttatcttatagtctactgaaggcatatggtggcattcaggtgcaggtgtaaatgcagtcataatattcggcatgagatctgtctctgagctggtgtggtctccggatgagggtttgagcattaaaattgcagcgtccagcttaagtacaaggaaaacttctcttcattggaatgcagataccttgagcatagtaatatcttcacctcaacagagtggtgctggggagagtggtcatatcatagatgctacagtagaagacgcagaaaagatgccatcccagttacgaactcgcagtgacagttcagcgagagtattcatgtct

SEQ ID NO: 68302 - DNA, 712 bp, Oryza sativa
aacattatagggtgtaaagttttgtgatgggataattgctagcgctgctgctccaacggcaccgaggacaaacggacggagagctccaccaaggcttgccgccggagataggccaggtgcatggtgaactggagcacgcagtcgtcgctcagcacgacggcgacgctctctcccagccctcgtgtgttccagcagcatctcggcatcgctcgcgccgagtcctgcaggcactgcacgcagtccgccggcgcgcggcccgccgcgcactgcgccagcacgcgacccgccagccccgtgttggcgccgtcgtcgaactcctgcgtcgccgctagcagcacaatgagtagctactgcctggtgttccggtcttgcctgcctgtagaaataatggcatatgagcgacagcatcagcgcgagcacgagcgacggaaatcagccagagccaggcctcggcacggcggcaagctgtgtcagcacgtagtcgtagggatacgactggcgctcgcggccccgactccatcgccgcgcgcccttcctacccggctagctccctgctcgtcccacgggcgtacttgcctgcctgcctggtgccggtaccccctagcctcctgtccggcgcaccgcgcacgcgcgacggccgcaacaggggagtcagggtctcagggattcggcgagttttgctgtgagtgctctcaaatattagcgagatgcc

SEQ ID NO: 68303 - DNA, 1627 bp, Oryza sativa
acattggtcgatcagcaggtcaagttagtttatgatcttagctaacgtgtgcttcctctgcattgtgtttgtttccccctctttgctgttttggtgagtgtgatggtattgtagtgctgagatattagctgttaattagcagaaggcagaactcctgttctagtacaaatctcttgctgatatgatcaatgtgtacctcgatccaagtgcatcgtttgctacatttctgtttccattttggatgattcaagacttggaaatagttgatacttgataacccgtcatatctatccttgtgttgccactgatattcagtgtggagatgtgcttatgactgtgtgcttacattttgcttagacgggagcacacctttactgatagacagatggcggtgtatttctttctttgcgttaagtggattatattttcatggaattcgatgtttggttatgcaattctatcagtatataaaggggtttctgagaagttcctgaagaaagtctgaacattgaggttctgtgctgaatgcagccttcaaattgtctgaatgttgatttattttatattctttgccattaattgcccacattttttttaccaagttttggttataccattctaaacttcctatgcagaactcaattctgcagaaattgcagattgttttctctatttggtgcctgcagattcttctgattttttactgttagcaggttacctgctaatatcctgatcatgttcattttgctggcagtaccatatttttttctgaattagtgcaagcaacatgcatcacccccacacagttaatatcctgaatagaccattgtaagttggaactgaacattgtcttagcacttcttcttttattttttttaaagaatcagcacgagattgtgctatttcattggatatagaggtaaaaaaaatacagcccctatggataaaagggaaactgtacacaaaaacaaagaggctattgctacgaagggaggaattctccaagccgccttgcacctgccatgatccaggttcttgtctcttcctttattttcgccataagattgggagccgttgtttccttgtgcttgaagatccgttgattcatttccttccaaatttcccacacaatgagtagggtcaaggatcacagttctttcttgggcacttcctttttgttgtttagcatgtcccaccactcttgaacgctttggcatgggtcccaatggttcagatccaattgctgataggcaactcagctggccgttagcctccaaatactcatggtgtatctacaagaggcgaccaggtgacataccgtctcgttcgtctcccgacataaggggcacaatccattgttttgccattctcttgcagttagccggtcggatgtccaaactctatttgtatcataagccacgcataaaatttgcatttcgcaggtgaccaagatttccaaatcaaggaattgtagttggtgccgacatttcctagcaattgtgtgtcttagcacttcttgctctgttgttatatgttataactgaacaacgccttagcatatctttatttctttcagtattgcaactgagcattgagctagcattaatttgttgcaatcctatgatgg

SEQ ID NO: 68304 - DNA, 2731 bp, Oryza sativa
atactttcaccagaactctaaatgtgcaacttagtctcttccacataaacatgccatgctaccccatacactgctcacctattaaggttgcctcctcgaattatcagatggatatgcatttcattccatgacattgctcttcctaccgtctagagcttgagtgcatatttttttttcgccaggcagcttgagtgtgtattcactaataatgaagcatatgactgttgagtaatacggtttcccctaaatgtgtaataaagatatataattttactgttaagcaaactcttaatataagatttcccaccttgtgagctgtccatctcacaaattctggagatatgcgactggtattaccaacctttgcagagaacagttacagtagcagcttcactggaatctttaatcctccggattaaaaacagtaatatactccagtgtttattcttaagcatattgagatctcaatcacccttaccccatagatacatattaagcatgtctttacaccaagagtttgttaaatcatcatcagccccctatgtactggtgcacttttataacattgaacattgtctttagcttcccaagaaggtaaacttatgagatggttgtgttttagattggccaatggccagaaggcctggcaagcatcattaagtcctatttcccctcaaaagtctagcaactgtaacttgtgatctccaaatacaagcaggtatgccaagtattagcacacctaaccatgtcaggtatgtgtgttcattccagaagaatcggaaaaaaaaagtccactgttggtagattaacataagcgggatgcttttgtcataccctggtgaaaatgttgtgctgtcaccaatttcctggggacattgattgacattttcattttctataaaaaaaatggaaaggagaactgatcaatattgtcactggcttcacaattcactatggggcattgattttaccatattgctatgatgctatctgatgggttgaatagcgaatttcatgatgtgtatggtcctttctgatctattatctctttcatgtatttaatgaggtttatgtctatcttactctgtaactgtcaaaactcaaaactgctagtttctatttattgggctccagtttggttaggctctcaggtgtactaccctatgcagaaattgcattttttttctgttgcacaataaaacatcatctccgtgcatttttgtttgacacaattgcacagcaactaatatagttgtctactcagtgctctaatgccaattgagtatatttcatagtagttaatcactgctacccaccagtaactgtcttttctttcagagaatcactgataagtgataacactgttagtgataaacttttctatgcaaggctcaatttacctacgaaggttacattccactgcactatgtacctaagcaaggcagcgcaccttgcatgcatcatgtggagagctagtactccatgtcgtcgcactgttcttctttatctggtttaagtaaccatttggctttacaatcccaaatttgaacctctcttcctatgtttgtccatgcaggatatctggcgtcatatacattccctaatgccaatgcgtgatgctgctcgcactgcttgcctgtctcattcctttctatgttcctggagtgctatcccaacctcaccttcaataagtatgtgtttagacccaaagcatttacgtatggaggggatatcagccacagaattgactctattctgggaaaccactcaggcattggtgtgaagacattgaagcttgaattatctggtaccgcatatcacaatcttgacaattggcttcaagttgctgttacaccaggcattgaagaactcacccttatggtatgtagactggagataacgtacaactttccctgcgcacttttatctgatggggttcggaactcaatccggtatcttgaacttggcttttgtatcttccgtcccgcaactgaacttggccccttcagaagactaacaaagttgcatctgcaatacgtgcgtattacaggggatgagttagagtgccttctttcaaactctcttgctttagagcagttggcactcattcactgcgatcatataatttgcctaaggataccttgtgtgctgcagcggttcagctgcctgagggttcatggatgcgtgaggctgaaattgatagagagcaaagttccaaatctctccactttagaccttagcggaaaggcggaactgttgcttggggaaacattgcaaatgaagaacttaagcatgcgccatccaaatgttgtctgttatgctcgttctgagcttccatccagtatgccaaatattgatactcttgccttaagctcctatgatgaggtatactctaaaactttgtgttgtcgattagcaatgtatgtgtatcacatggcttttgaataattgatctgagacgtggcatattggttgcgcaggtggttaatacaccaatgctgcctaccaaattcctctacctcaagcacctgaccatttgtttgagctccggaaccttttcgccgtcctatgactatttttctctggtttctttccttgatgcgtctccttccttggagactttgaacttggatgtaaagctctgttcatcctatcctgcaaagttatctggtcactgtgtcaggtcaattgactatactttggtttcatcttcaggtaacaaatgatccta

SEQ ID NO: 68305 - DNA, 1666 bp, Oryza sativa
ccaccctctcgtcggacccatttatggatggatgcgtggtcgccggactcatcaacgatcaagctcccatacccggctaccgccgccagaagattgcgttctggcaaattgaagatagggtggtcgtcggctacttctacatgggtgaagcgtgctgggatgcggtggacgtcgtgcgccacaatggagccttccatttcctcaccaagggggaggacatcatcgtgggcaatccggtcttcgctgaagcgggtgcgccgccccaagtgcaatgggagtatcgctgcttctcgtcgcaggggcgcggctacgacgggcagcacgtcgtggcgcgctacctcgtggagtccagcggagaactgctcatggtcgtgaggtgctctcctcgtcctggagagttcacgtcagcgttcaaggtgttccgaatggcacaacccgaggaagacgacgacgcaccctcactggatggccggacgatgctgttcgtcgggcgtccctgctccagatctgacggcgatgtggttcggtacatctggagggagctgccctcgctggaaggccggatgctgttcgtcgggcgcggctgctccagatcctacgacgcggatcagtaccctggcttcgagggcggcatctacttcttcgatcatcggatcgccgggccgctcggcgacgcgccggcgcagtacccctgcagcgactgcgggaaatggacgggaaaacctgcactccaggtggaccgcttcttcccggagcaagacccatcgaactacacctctcaagtttggttgctcaacgggtaagctagtttttgatctgtctaacaggtgcttcgtctgcattgtctttgtttctttttgctgagtttggaagtttggatggtattgtagtgctgagattgtagtttctgatcagtctccaactgttagaagaagcagaacacctttttctagtagaaatctctttgctattgcagctatgatcaatacaccgtttgataatttctgcttcccacttaattgcatgattcaatcattagtatattcctgttgcaactgattttcagtgcggacatgtgcgtatggttgtgcttatattttctttgtgaagtgcacatcgttttgactgatagatggtgttgtacctttgccttgcacgaattggatttctatggattctgatatttggttatgtagctctgtcagggcttttcttgaaaagccactgaatgaagtatgaatatcgaggttataaactgaatgaagaacccagaatggttggatcttgatttattttgtattctttaccatgatggatttatcaaatttcagtcaagctttgttatgcctctctggtgcctgcagattctgctggcttagtcaaatttcctattgacaaatcaattctgcagaattgcaggctatatttttcctctttggaacctgctgattctttatggttagcaggttacctgatatgtaatacacaagacacctctcaaaaagttgtcatacacagacgcaatgcttgctaattaagttggcatggtatcttaccctcatctgttttagggctcatgttcaacccgttcattttgttggtatcgtattttagtccgaggtaagtagtagctaaacattctcataaaccatggggctgcaggaat

SEQ ID NO: 68306 - DNA, 756 bp, Oryza sativa
ctgcacccctattcatgcaactagcattgtcaataatgatttgatgctaatcgagcgatgataaatgcagaagtatctatgagcagatagcacagaccagcatctgattttagggcaacaacagaaaagacttcaacaccacgttttcgctagctttggtgtcacatcaatttgtggaaaaatatcaggcataccccttttacctagattttaccaaatgggcactactgtctaaaatgctccagtatcccaaggtcttattcaacaaatacatgacagagaaacatgtgcactgttggttcaaactttacactcagcacaacctgttcaacaaggatttccccctggagtattgccgaagagaatgatacgttaagctgtggttgctggcatggcatggcatgccgcctaagtcataaccagtagaatgccaattcattctgctggattccagcgctcatgccaattaattccgcccgatttcagtaaaatcctatctttttctgcactagaagccacacataatgaagaaagttcctgatttgaccacttcaacctacctcatcgtggaagtaccgatttttttgcactgcaagcaccttatcaacaaattcccgatctttcttcaccaaaagccctagcatgagcacccccaaacaaccaaactaaccatcgcatcctccccactaaacggatccaacctacacaagaaagccgaattcgcacccagacggagaaaagatcaagcaggggcac

SEQ ID NO: 68307 - DNA, 721 bp, Oryza sativa
ttcctgcagccctgctcggcgagcggcaggatgagatacggcagcttgggaggcgggtgcaggggcgggagccgctcgagggactcgcgccatggtcggcagacgccggcgaggtgcacgcggtcgtacacgcaggggaggcggttggcgatctcgcgcacgacggcgtcggcgaggtccgcccatggcgggaaatcggccatgagagacggtgggggaggggagaggaggggaggttgagaagaagacccttgtgctggtttgattcctcttggcttctggaagcttcggaaggagggagctgcgtcttacggagtggagtactttttatactgcaaggaaatgggacggggaaggtagggccgtctgggcccacccactagggctcgtgtgggcccatattgccgataattcaaaaaacaaagaccatttttcatctcaaatcaaattacaacgattatacatttgctcgattcctataactaatccaataataattcaagaaacatatggctcatccgaagttaagaacatcctacgtttatgcgagtgattatgacaacttatggcattgactacagggctccacaacggtcaacttaactctagcgggaactttatcctcgatgtatcttccgatagccacaagcgctgtacgggctttcctcaaaatactatgcgcatggttctgcaccgttcaaatctttcgtcagaacaccta

SEQ ID NO: 68308 - DNA, 69509 bp, Oryza sativa
  unsure (1)..(69509): unsure at all n locations
gcccagaaatcacaccccccttgctgcaagaaaaaaccccacttcaaaccctaaaaatgcaaactcaacaaatccaactcgtaataccaaaatccctcacttacccgagcgttttggcacttgtaataccggcgcccagggttgtccgtgctccacgagatccacctcgccgccttggctggtggacggcatcggcacatcactgcgggctgatattctagcggaccaacccgataaggcacgggatatgccttcgactcacgggtagacgacgagccgtcgctcatcgagctcgacatctccgcgccgccgctcgccaccgctctccaagtcactgccgccgccgccgccgccccgctcggttcctgcttcgctagggtttcggggaatggggataacctaaccgcgtgccaaacatttcgcccattatatcctaactaccgccctgctgactcagcgctgaagaccgtggtcaatgcgccacgtaggacaaaaccggacacaatactgtcctgggaccaacactgacctggttttgatagttaggggacccccgatgtctggttttgcggtttgaggacgttttggtaactcgatgacaagtttagggaccttcggtgtactttttccaaaagggggccatgaaaaggggcaggctagacctgaacccaataacaaaatgtgcatgggaggagtttggtgcagcgcttgcagctgccatgcagtggctgagccagtatagcacatgattcgagtgaggaagattaatacgtttttttatcaactaaggctctgtttagttcacaccaaatttctcccccaactcctaactttccatcacatcacatcgcatccaaaactttcctacacacacatactcctaattttttttctaaactatcaactttcctcaaacttctccccaatttcaaaaactaaacacagcctaatttttttgtaaatattaataggtgtcaatagagaagacggcagaggtgaagttcaggacacggtcacccaacctactcgcgagctggcttcgctgctgcctcgatgttctgacggctgacacgcgtacaactgaggcgctccccttcctttttttcttgcaaattcaaaatctccttaaaatgtgtctgccttcaggttgaacgtataattgactgaattcaaatcctcttcaaactaaacacgacgtgtaacggaaatgcagaatccggatgttaacgggaagcagagtccggttgttcatgggctaatacatgtgcatcttgacttctggagcaagaatatctgagcagccagaaacacaatttactgactattaacaaccagaatcacaagacgtcttcttgatagttactactaactacttcatctgtttcacaatataagtcattctaacatctctcatattcatattgatgttaagaaatctagatataaatatggaagatgttagaatgacttacattgtgaaatggaggtagtagctagcaagaacaaacaacaaaaattaaaaaggccgataaaaaataatctacatccggagaggctgcaccgttgtagcggcattacgtcgaacgccaccgccgccggccggtgcaagctagctagcctcaactcagtgagcgccggacggcttcgctatccacatccatcgccgccgcattgtccttcagatcacatccccggaggcccggagtcagggggaaaagaatgaggaactccggcgtagggaatcccggcgtaaccgcaagcggcggcggtgcctgtgccggtgcctgtgcctgcttctggtggtggaatcccggcgtcagagggaacagcgggaggcacaccggcgacggcgtaggttcctctttctccccgccgccgccaccgatgatcgggtcgtcctcctccttgctccacccggccaccttcgagttcttcgacgacgacgacgcctcctcctgctgccccggtgttggcggtggcggcgaacgattgccgccggcaccgcccgctgctcctccctctaacgccgccatcgcgttcgtttcgattgcttcctctccggcgatgaataaagtggaagatgaactaaccgaaagtacttacacattacattatctctacgacgtggaaggagttttatatagttatctttgcgacgtaggagtttgagtcgagttagagaaagtatagtgtttgagattaattcgagtcaggtttaagatagactttgactttgattttcacttggttaagtttattagcttctgcaaattaaattgaatttgatattgcaaattacaaactgttcgtagattttattttcaatttttgaatcttttagttttcaattttaaaaatcaactctctcaaattttatttgaaaattctaaactttttgatcactagcttggcgaacaacatttgttttgtcacgccaccattactggcatggcaaggatttttccatgtcggctaggttggtgtggtaaaataacactagcacagtcaccattggtggcaggggtgaagctaggataaatggtcaccggggtcagtattaaccagggtttatgtttttgatcaaaactaaccagaaatcatgtaattttgatgttttgccgtgggacgaaaagtatattctgagtgaaatttcgaatgttttttgagacttcacagtaaaactagatcaaaacttattaaaatttggtaagaaaaatgtcatatcgctacattggaatccaacactaaatcggaaatatgtcatctagtttgtaattaatgatataagaatatacataatacaggacaaaattaatgacaatacattatgataaaatgaaatgtctacaaatctattaaaaactatacattattaatttgtaaaagacatcaaatgcaccaaagatcatcaaaaccactaatttcttgccttccgttctgctagaaataagatgatactccctccgttttaggatataagatgttttgactttggtcaaaattaaactactataagtttgattaattttatagataaaagtagtaatatttttaacccaagataaatatattataaaaaattattcaattatagatttaatgaaactatggtgatgttgtaaatattactaattttttctacataattagtcaaacttacagtagtataagatatcaagatgcgcaatgccggtgcgggacaaagtgctcgaaggaatacgatgacgcaacaagagaaactcgtggagttgtgggcttccaatgttatttttggatccaaatcccaatcgtatatgtatattcggctaatgtataaattataagtgctagctaatttattgtttgttagtaccgttcctagtcgctatttgggttttgacggaagaatcaacaatattaccggggtctagtttttctcttcactcaacaatattaccggggtctagtttttctcttcactggggtcatggatggcaaaataaagaagggtaccagaggttcgcaaaagatcgtcagggtcaactgacccctatgaacgagtgtagcttcgcccctgattggtggtgtgacacagtaacaacgttgtttcgttatgtcaccaaaaccagcatgattaaaatgtttagaattgaaaataaattttagaaaagtctatttctaaaatttataaaaaatcagggtacaaataatatatattctggattgtattcacgtccttaattagaaacttaaaatccacgcccccacaaaattaagtctatcagcacatccacatacagagcagagctaacagcagcagaaccagagtggcgatgaggatcgttgcggcagatgacgggaagctcctcgtggccgccgttgctgtcgtcgtcgccgtcaccgccgccgtcttcttcttccgcttggtcgggcatgggaggggaggatgccggaggcggatgcgagctccggggtctctcatggccaccttgctcctgaccagcaccgagttggtcaccccctgcacgttgttgttcacgtagatgttgatgctgcagcagcagctgccgctcgccgccactgacatggtcgcccccgtgctccggttgctccgctcggaggagcaatcgtctgcaacacccatcgccggcgaggtaggccggtcggaacggacggaaggttgatttctgaagctggagaaaacaagatctgcaacctgcagggatgcagtgcagcagcagtttcagttatatttggcatagttagtacgttgctgcatcaccaagaaaagcatagcatatgctactacgagcacagctggggaatcacactttgcctctgcggttgggctactccccaggctccagcaatggatgtcaagaaagagcgggttaattacatgtcgctttgcgcttatctttgtatagcgtcctaacatgacataggcacatagcaaatcaacggtcatttttgtgttctattgttgaataagctgcgcgatagaaggcccatttcagttgtcaatgatattactgggctggactgtggatttggagaaggtcagaaggctataagaaaacgccagcccattctgctcttctagtcctttctttccccttcacgacgttaagaacattgtcgttttttattcaaactttgaagcatcgccagtaaaatctcgaagcatcacacgaataaaaataaaaaagaacactttgaagcaccaccagtaaaagtttggagcatcaccagtagattaagctcatgcgaagtgcaaactagggtcggcacaacattaatatactttggatccacatctgtaaataaaacacgaggctatcgactcaaatacttagtactcacatgctgcagtcatacgggccgaacggctagctgatactaccagtaaaccgtgttcaacggaaggtagtactaatgcgttaggatgagggcaagcaagttgaacttaattaatcacagtactctacattttctcaattcatccgtgcacacattttatacttgaattcaaacagaaccaaacacacagcagcaaacatttgaactaaaaccaaaccaaacggtacatacatatgattacgaacgtcgatacagagaacagaagtttacatacggagagtatatgaacagcgttgttcgtgcattgccattgcatctagcagcaatgcacgagcgggaaacacaaagtgaagaaattacgagaaaatcaaagctcgatcacaccgagatatataggcagtcgtgtgcatgatggatggcatcgatcgattggccggtgtgtcggggtcaaattcagttagaccctggccgcggcggcgggcttgtggtggtggtcggcggggtagtcgccgccgtagccgccggcgccggcggcgtggttgccggagaagaggccgccgtggagcatggcgacgtagagcagctgcgtgaaggcgaggatgatgacgaaggcctcgagcacgcggaggcgccacccgcggtagccgccgatgtggatctccttgcaggcgaggccgaaggcgagcgcggtgatggcccaggcgatgagcgccgacgcggcgccggcggcgaggctgtgcgcgccccaggagcggacgtggtggacgccggcgagcttggaggcggcgccgaccacccccgcgaggatggcgaagacgaggaagtagaaggtggcgccgttgccggcgacccccgggtggttggtctcgccgttgatgtagtggttgagattccagctcgcgaacccgatcacgatcaagtacatgatcagattcagcaccagcagcggcgcgatcatcgtcctccctactccggccatctcgtatcaaaatcacaaatcaacacaaattagcaacacaattagcactggtttagctagctagctgagagctactgtgattaagtgaggagaaaacgtgctggttggtggagggatatataggcggggagaggggtgacacgtgtgggtggatggggatggcacgtgtcggcgtgtggcaaggggtaggggggacacgtacgcgcggggccacgccacggacgcccggcttctggtgatttccggagaggcgcgacgcgagggagacgggggtaaagaaagcgtaaaaaagtgcagcgcgcgcggcgtcggcgtgtgcggaggtggcgacgcgcgggcgggagatcgaggggaggagaagcagatggttccggactttcgccgcaagcgcctcggctcggggtcccagaggcggcgtacgtggcgggcgtggttagagcacccgcaatgataaagtaaggtgctatctataaaacatgtacatctcagcaatagattcgattaatagtaaaccaccttaatagtatatctacattggtatctataaatctctcatgcattgtctcgtttttctctatagactatctctaagttagtagatagctttgctctctctcttcatttaataccttccaagtagaaaaatatgctgacatggatctcttgtagagagcttatagataaccattgtgggtgtccttagcggctaatttaggctaaagtgtgcgtggttttacttactctggcgggtgtggcagcaggaggcagggttagctgcttgctttaggtttgatgatgatggtgttgctgcctcttttttgttcctcctttctttgacgcctagtgcaaatgtgcttccctgttttgggtttacgctgatccggcctactccgtacttcttatcgtctgcctaagtaatgcagcaatctggagtctgtactccctgcatttcaaaatgtttaacaccattgactttttaagtacgtatttgaccattcattttattcaaaaattttgagtaattatttatttttttcatatcattttattcattattaaatatacttttatgtataatgtatacatatagttttacatatttcacaaatttttttaataagacgaacggttaaacatatgctaaaaagttaacggtgtcaaacattttgaaatagagggagtacatcgatcctcagaatctttcgagcgcacatacgtggatgcagatttaaccatggtcgatacgcgccactaggccagtcagtactcccccatttgtgcattgacgaatttaaattaagaccttcaaccataaaatgcctaatcccttgtttgctgggttttaaatcttactcctctgtcaaaacaaaccaattatagatatgtatctggacaatatttatgtccagatacatcctttaggattagaatttttagatggatggaatacactatactagtacgagccaagcataatgagatcttctatccccatggggctgtcctgtcaaactggctatgtgatgtgcctatccttctaatcggaggctgttgcctctttgatattaaaaaaaaaaaccggtcagaggttcgttgctcacaaccacacatgcgtgcaatttgggcagtagtgggctagtggcgtacgtaagctgccaatttgggcccggccttttcgcggtggctcctgccgccgtcctgcgtcttctgccagagtgctgtaccatctcgacatccttttttgagaaatgacaacaatctcgacatctcgtagtctcttaggcgtgggaactggcatgtgtacaacaaggagtacgttgtgattttggcctcgatcagttggctggtgattactgatggccgttatgcggtacggagttacaaagttacaacaccaaaattacgctgtcatattgtttgtaggggtagcaaacaaacaccttggctaaaatgttgtccaacaaacttcgctgtcacattgcccaagttcgatgaatcggtcacgtcctcctgcatatgaaattgatctacttaatctaggttgcgagataactactttccataacaatggataccagttgatacttttccccattccataatataagacttgtttcataatatagagcatgtatgtatgcatgccattaactaggaaatttttttcactaaaatattattatttaaatcttctaccttcgagatatctaattttaatgggtgcatgcattttatttattaggacaatccaaattataaggtgataataattatttcttgattttttggttaaggtggttgtgtcttatattttcgaatgaaaggagtatctaacatgtatcggctgatatacatataagttactactcccactgttcatattataagccgtttaacttttttagtcaaaattctttaggtttgatcaaatttataaaaaaatagtagcatcaacaacatcaaattagttttattaaatttaatattaaatatatattgattatatgtttattttgtatgaagatgttcctatattttttataaatttgattaaacttaaaaaagtttgacaaaaaaagtcaaatatataacttatgatgtgaaatggaggaagtagctctaataccgatagtactctctccgtcccattttaagtgcagccatgagtttttatatctaactttaatcgtcctttttatttgaaaaaaaataaaaacataagtcacgcataaagtaatacttatgttttatcatctcataacaacaaaaatactaattataaaaaaaatttaaataaaataaacagttaaaattaagcacggaaacttatggtttcactaaaattggaacggaggatgcagtagggtgataggtataccaacaaaaatcaaacgttttaccgttctgttttttttttactgaggaaaatatgagaagcggataacgaaagcctacggcctgttactactgccgtactgcgacggcccacctagcaaacccgcgcttcacgactggctccactcacccccggcctccccgttctccgcgccgaggaataacggataacaaacgcttggattgtcgcctaccgcgacgccgcgaaccaatggccgcctcctcgctcctcccctccaccaccacctccccgcgccgccgcctccccttcccccccacccgcaaaccccactccgccgccgccgccgcagccaagcccccgacgacgctgaccaccaagccactccgcctcgcgcgcccgctcgcctcctcatcctcctccccgcctccgccgccgccgcccgaggaggccgagccgaaggaccccatcgcgctcgccttcgcccgcgccgccgcctacaagaaggagagggacagccccccgccccctccgccgccgcctacccctgcgccgccgccgcagcccccggcggctacggaggaggactcgaggtccagcaaggagtccttcgcgcgggcggtggagtacaggaacggcaacgggggagggctgggcagcggcggcggctccccgctgctcggggcatcgcctagatttggtgagtagagaggtgacgtcggtttggttgtttttcactcccgttggtaaaaatcattccaatccactaagatgatgaatgaattgatgattactgcattcacggatagaaatgaggaatagatggagacagacagaaaaactttttcaattcggatgatagcattctgagtctgtgtgtatgcaatgtccccgggtgatatatatggttgtggtttgaaaccttttgctgattgatgcatatccccgttgtgtttttactagaagcatgtggagtaatgcagtaatggtcactgtatataggtttcaattcctggaagccttttttttttctcttttggaaagtaggcacaaactccgttgatcaaatgcctagaagcactttatttatctgtggaaacatgtttaggaggattgcgagatggttagtccaagagttggtggatccctttgtcattgtgatcttgtgagagtatgtatcttttttttctctcaatacattcttgttttgaagaatgttaccgtttgtacttgcaaacctacaacttgaaaactttcgcatgttcatttgaaccatgacactgtttacttagtttttatgtaagaatagcatagaatcctcactgcgaacagttaaaaaactttttacattgtgcgagtcttcattaacaccatcatttttattgagtgttgtccatgacacttgcttttcttttaggtcaaagtacattttctactgaagatggtgcatttggtaaattcacaaataagaaagaagagtatgagtacgatgagactgactttttgggcctagactttttcgagaaaaagagttataaggggcctccaccaggtttagctccagcagctgatccttttccagataaagattttcctgaagtggagataataataggggaccctagtaaatttgggaagactcatcgttcgacagaggttcaaccagcagatgatagtgagcctgaggaaacctcacgctcaacaacagaagaaaagaaggaagaaaacaagcctgatgaaacaccaccttcaactgttactgagccagaagaggatgaagacgagtacaaaccgacagttagatcatggggaatgtttccacggccacaaaatatttctaaggcggtgatataccatattttctgtatctcttaaagcgttccatgtatatctgctttcagttattagaatctttttcatgtttgcatggtcattttattgttatatgttgaactgtgttcggaggacaatgattttttaaaatgaaactctaatatcctttttgcatacttctgttaaaaaaacaaaagattattgtgcaatcctctctttatatttagtaacttctcctttttgaattcccgtatgattgtaatgctacatttaattctgcaaattatacaacctagtggcaccaggctacttatctatagggaatcaatcaccacaagcttgtctatttgtactgcagagatccagcacaatccttcagaaaaatgtttcagttaaaagtttgccttaacaagggacaatattgacatatccaacatggctgcagaagctacctgcatatgatttataggccattatccaagaatgactgcatgtagactgtagagcgtaggagtgagtacataatatgtatgtgtttttttttaggttaatatgtatgtggtttttatatggactagcacaacctttgggacatacatgaagataatctgtgaaacaatacatttctgacgataaaaaacaatgaagattattcaagaagatgatatttggaactgcatttctttcccttgtttgattgagacaatgtatgtcgaccattgctgatgctatcataatgtatttgatttgataaaattagattagaatgcaaatatgcttacggtagtgccatgtttacccagttctgaattttcctctatttcttcgttattagtatggtggcggaagaaatatacgccttggtggagagactcgaagtgctgaagagaaggcagccaaggataaacgtaccaaagagctaatagctgcatataggaatagtcagaacatgatagttgatgcaaagacaaaggcagagtgcactgaggtacatgaaacatcatgttttgttaattatccttcattgaaaggaattgtcatttttattttatactactgtactagtgtactttatgattgacctagttaattccaagatgatggtcatatctacagacaggtgacctgataggtatcttatggacttgaacgtgctgattttaaaatcctttctgttagaatacccaaggaaaatgctttccccagatcacattcaagttttgaagtttggtgttagtgtagtttagagttgtctctgaatatatgcactgcgttagtatgatctataacagcgaactttacatgctgaaggccttgaaggaaggtgatgagctgatgaatactggaagacttaaacaagcattgccttattatgaaaaagtgatgcaggctgtggacttcaaggtattccattacgtaattggtaatctatcacatgagaaacaccatgataggatattttgtcatattgtcctgttagatgcattaattcggatacattttatttctcaagtatatgcagttctaaattttttgcattgctgcttcactgttatgtcctttcttatttttataccatgtttttttactcatgttgcgcaaaataaattgcgcagactgaacttcatggaatggctgctttgcagtggtccatctgtctagattcactctgcaggtattttcctttgtttttctatgtccttcccctgcattgatgtttttcaccacatatacacctgttttgacttaaatgcacagcaacatactgaatttcataatccctatttttactaaaactaggatttttccactctataaaattaatggcttctatggtttgtaattgtacgtgtgtgcgtgcacatgttcacatgtagctatgcaatggaatgggttaatttgcatattttcacatgcatagttggacttaagttgcatattttgatggaaacatcggtgccatcagtctgcttcactgcattttttaaatttgtgaagcatcttgtgttcataaactctctattttctggacatgtattccatgaaatatcttgttttgataggtccaaggaagccatgagcatgtacagcaaactcaaaaatcatccaaattctgaaatcagtaagaaagcaaacatgttcatgttcagctttcaggtaagcatctcaaatgcttatgcattccctctattgactaaagcactcaactaggctgaggacaatgcagaagttagatatatcatcttgacccatccttgaaaggcactgactatgagctaatcgtttttgctgtcatctgaaggcgatggacttcatgaaggtgaacagctcccctttgccccgtaacacgggctacgagaagtacttcgacaagtttgggggccagaagaactactacgctgccctagacgaacctgagatgggcatcgatcagatcatcccgtacatgctcttccttgtttccccaatattcttggttgcttttgttgctttgagaaaatccttccagttataaaagtcaggaagcatatgcttgaatgcttcaatctttgctccactgacgaattgattagtatgttcctcgaaacaaaaggctgaagaattgatatttgactagtatgcagatatattgacttgattagtatgtagataaaaatcaaaacttatttaatagtattgtcttttgggccggcgtaagccagctgttaggcaggctagtctgagagcctgtcttcagctgggctaggcccatgtcaaagataaaaccgtttaccaaatttctaaagtatttggaggtacggatacatatggcattctcattaagtataaagggttgtctgaatttcattttttaaaaaatcgaaatatctgaaataatctcgaatttatgtttaattctttaacttctaaattgttgtttcctttttttttaatgtcgattttaccactgctttatatatatatatatatatatatatatatatatatatatatatatatatattactagctccacaaagcaataaaagggggaaaatgcaaacaaaaaccagcgtgatacagtttgtatagtactggttttgaaggtacttattaccatttacttttttacagaatgtcaacactctgtctgtaattttctatgccacaattggttgccaattcagaccacgagcatccatccccttgattctcccctcccagtacagtatctgtgtcttttttctgtgcgcgtactagggctaccaataaatttcatgcatgttttttcagaggctaatgaatacatcatgttagtactctatgtgtcctataccgtattaccgtgttaatagtgttgttagagcagcaggcatttgagaggtgcgcagcacatgtacgtgcaggccggccggttggttggatcaaatctggcgtgagcgcccaagtctttgacttgaagaagaggaataatgtgccaatacactgccatgtgtaggaaaggctgcatagctttcagtaggcataggtatgcattgacccaattgagtaagtatatataaataaatggatagaatgtattagcactctctttgattttctaatatactatgatgttgttaactttagacatacataaaatcacttggtttattaaaaaatacataaatattatttattttgttgtgatttgttttatcattaaaaatctatttttgcgtatatgcaaataattttctaaacaagacaaatggtcaagtgttcataaaaaaaatcaataacatcatatattaaaaatagaggaaatattagaatttcaaactgatttaattgaactactgtgaatgaaataaatacgcataatgctcaaataaatacgtataaatgctgagaacggaacagtgaagaaagttacgggagttgtaaagtcaagggacggtttcaggacggttgacaatgccgcaaaggtgaaccgtggctgcttcttcttctttctttccttgtgggcacagcatctgccgaaaggcgtctaaagccgtcgtcatcgcaatcatccgatttgacgccctgattttaatatggagttttgaggctaatgatcctcgtgggtgctgagcctaatctgaataaattagggaggatcgatagctgcttggttgctttgactctggtatagtggatggaattttttaggagtttttgtattgatcggagccgttagcttttgctgtgctagcctcagcttcgtgtcctttgtgagcccgcttggatttgttaattttggttttaaaaccttgagtgaaagaataacttatactccctccttactcgtagaagttgttttggacagcgacacggtctccaaaacacaatttgacttcttgtttctataaaaatatttattgaaaagtgatatatgtatacttttatgaaaatatttttcaagacaaatctatacatacaatttctacattttcaaactcaacaacttgagagttattcatgatttatattcccaaggtttgacttaaacattgtcttaaacggcttcctttatgagtacggagggagtactagtactagtccgcgggactaaaactgttaagtccctatcacatcggatatttggacactaattataaatattaaacgtagactattaataaaaaaacccatccataatgttggactaatttgcgagacgaatctattgaggctaattaatccatgattagtctatgtgatgctacagtaaacattctctaattatagattaattaggcttaaaaattttgtctcgcgaattagctttcatttatataattatttttgtaagtagtctatatttaatactttaaattagtgtctaaatatagagactaaagttaagtccctggatctaaacaccaattgatagtgttccacacagccgaggaagtagctagcttccgaacatcttatcagctattaggaaaaaaaatgcaggaaacgaaagggaatgaagaaaattcctaaaaccaatcatagaattatattctagaaattcaaaatcaataacttatactagtagagcatatactccttccatcctaaaatataagaaattttagatgaatgtgacatattctagtactacgatcatatcctaattcttaatctgtgatgaatagccaaatagacagttgatttgtgataattattcaatggtagaaacagatgaatctttcgtaatattattttaatctatttttcaatttttcaatatatttttttgattttaaaatattgttataagaaatccatatatagaacgttttttttaaaaaaaatcatactttttagagacagctgttagggtaaaaaaggaacaagctattttacctggattaatctgagacagctctcggctctcaccaacaaaagccacttgtttcagcggacctactccgtacacacacaaattctgtctagtcagactgagacacattattactcgtcactgacacgcagtagtagttccactggtggcgttaaaaagaaaaaagggagagaaaaacagctcccccccggagacatcagacaatagccgttggaggtcgactcggccagcagaagcggacagagcgcgcacgagcacgaggccaccaccccagtaccccaccccacactctccaaattccccgctgatgaaaaaaatggccgcctcgcgctcgcccccaccgtgccgatgctgctgctgctggtgtcagggctgaggggagcagcgacgacccgggcaggtagtggtagtaggagccaaactggagtacggagcacacaaagcgccaggtgggttttgaatgcaagctgcgtcggtgcgtgcgactagccgttgcgagttgccttgccccttgtccaatttctcccgtgcccgtgcgcgcgagcctccgccttgtctcggcgggcgggtggtggcgcacgggaaaaaccaagcgcgggtgtcgctcgcggcgcgcgcggcgcgggggttcccaccggatcggacgcgtgatcgaggtgtcgtgacggcgccaacgggctaggcggtcgggtggagttccgcgccgacgagacgacgcgttggcttgggttgggttgggtttgcgtgcgggagccaacgcccaacgggagtggacgactggtgggtggagtcggtgtgtgtgtggatcgctcgctccagggggtggtgcgaggcgagtgcgacggagacgcggttttctgcgcgtgcgcgaaagctccaaggaatcgaaaacgggcagaaacatgacgggaaaaaaacgtggaaattggtgtgccattttataatcgggattgctaaaattatggcatcatattttcacttaatttcagttacttttacgctcctatttctcctatctactctttaaaataaaaacaacaaattactttaatcatatataattctcttatatatcatgtatttataaaaagagaatccaagaaatgacattgacaagcgtccaaatctaagaaatgcaatcaactacaaatatgagttttaaaaaatgctatcgtacaaacgattttgtcccaaaaatatcatcgttgttagggttccgtccaccccatgccattaaatacattgttcatcatatagcacttaacgacgcgggatggatggaaccctacggtgatggcatttttgggacaaaatcgtttatacgatggcatttcttagaactcacacttattgataatatttttttagatttagacgtttgccaatagcatttcttgggttatctcttataaaaatcatgatgtaagtattgaaactaacaatgtaaattatagtgtaagtttcaaaatttgtagtgtaattacaattgtaagaacgatctaactatttttggtgaaaaatatatcatcataaatatagctatttccccatcaatttttttcttttaccaaactctcccaaccagttttggtagtagtatctgtcaggagttggtcatctataagaccattattccacatgagtttccaaaagtcatgatccttttttggaggagaagttttcaatgattcataacctattaaaaaaacgacctcaaaaaagaatactcgtcctagattggtctaaatgaggccgaaggtgcgatgctgcaggatcaggagcacgtcctttgcgtagctatttatctggttgttggttggcagcagttagttggtnnnnnnnnnnnnnnnnnnnnnnnnnnntgaacgaggctttactacggcggatgtgtttgttgattaggacgtgcagtgcaattgtacaagtgctccatcaattccataatataagagatttcgggtggatatgacacatcctactacgcctatccagattcatcattatattagtctatcaagattcatcattatactagcatttgtcacatccacccaaaatctcttatattatagaacggatggagtatataaatgatgtactctctccgtccaaaaaaaaagataatttctggaaatgaacctggacaagcatttgtccacattcattcttagaacttgattttttatgggacggagggtgtatgcactaacggtccaccatcacttgttattttcaggagtacagattaactgtacagagccatcattttcgctcgtatatcagcagttgggaaggcagggcactggaccctctccttgtcctgggtagggatggcaattgtacccgtttgcccatttacccgtgggtaaaaactctattagagttaggtttgttctctattttatacctacgggtatcttattggatcaaaagttatgcccgatgggtagatgggtatgggtatgggtaatcactacccatgcccgctttgaccgtttacccgcgaagtctaacttacatgtaggctaggaacaaaatccactagaatacataagccacgttcttctacggtttcccttttatttcccttattatttctcttccccttactctatcgccgtcagaggagagacaccacaccgaggcggagaatatttgatgttttaagttcaattcaaacttagaagcttgtagactttttgttccactgcttttgttgtggcgggtaaacaggcacgcccgcgggcacaaggcgcccgcgggcaatgggcatgagcaaccatccttacccgtcatgtagtaatgagtatacccacgggcacaaataatctcatgggcatgggtatgggtagacactacccgtgcccgtcgcgccctatttccatccctagtcctgggtgttactttggtccttgaattttactacagcattttttttttgtctaaatcagtccttttaagatagcttttggggttaaaatggttctaggacgcacctttacgttaagttacgttagtaacagtgtaagacgactcagggaaaaaaaagccttgctaataatctgataatctcaatgatgaaaagactgttttctcatcgtgtctccatttgagactcaaaatcagctagctatgaatagggtgcagggccgactacgagtaaaattttattattgttgttgttgctgctgcaatggaagatgtatatgtgtaaaataattttttcatcatagctagacatcaagagcccaggcttaggtggtgtttggatcaggtacttaactttagcctctgtatttagacactaatttagagtattaaatataaactgcttacaaaattaattacataaatgaaagctaatttgcgagataattttttaagcctaattaatctataattagagaatgtttattgtagcatcacataggctaatcatggattaattaggctcaatagattcgtctcgcaaattagtccaagattatggatgggttttattaatagtctacgtttaatatttataattagtgtccaaacatccgatgtgatagagacttaaaagtttcagtcccatctaaatagggtcttagctttttcaaattagttgctccacgtttcaaatatacattttatcaaaaaagtttcctctaccgtattgtagaccacttattttaaattatttattaagtttatttattaaaatacttggtttatacaagtggataatctgtaagaacaatccgttcactaatctgttttaatatgatcccagacctttgctaaattatctggcatgtatgaaaaatgaataggtgaaatagtataattaaagacagaacaaattattgccaatagcaattgacaaccagattgatccagaaggcaaaaattcaagatctagtaaagtaaataaagttggttattgtcacaaatatgtttcaatcgatcttaaggatcattttgccaactagcattttttctttaacattgatgatcgtttcccctcaagagacctaacaatcgatcgaccacctcgagcatatctgtcaatgttatacctaattaaaccatgttttttaattagctggtttcattaggtaccactgcttgaatatgcgggtagtgtttgtacttgcgcaggaggtatatatgcattggttccccaagcaactgatcacacactgaccactgatgatttagtgatcagtggtcgcacgcaacttgggaacaaatactagactactcacatcacacaagctgctcgatcgttacggctcgtgaaaacgacgtcacgccatataccaagcaacagctgattaatcaaaagcttgtgatgagtacctcctaatattctctaaatcatcttaatgccaggcttgatatatataagaagattgctgaagcgataaaatattggcagttgcggttttggcttgggataagttagctgcacgtgtgtgcatctcacacgtactccgtatgagatgcaacgaacgattgatcaatcattctacacgcccggcctgcagttgcagagatgaggatggcgatgggatttgttagtgttctgcttgtccggttctaatgatttgttttatcacccctgtttagattccacattaaaatttttcaccctatcacatcaaatatttgaacacctatataaagcattaaatataggctaaaaaataactagttacatatattacgactaatttacgagacgaatcttttaaacctaattgctccatgatctaacaatatggtactacagtaaacatttgctaaggacggattaattatacttaataaattcgtctcgcagtttataggcggaatctgcaatttgttttgttattagtctatatttaatacttcaaatgtgtgtccgtatatctgatgtcacgcaaaaacttttcacctctaatctaaacacagcctatgtcatcaaacaagcagattcaatcatggagaaaacagaccagagaatgcagtactatggtcttttggattagatttccagttctttatgggctatatgtatacgtacgtgtaatggataaatgtccttcttccttctaaaattaatactccctaagttccttttaaattgatacggttgactagtttgacttgtttactgataaaaacttttgaaattacgatgttttgatgaaagcaaatagtgtagttatatttgtcatgcaaagtacttgaacaataatatgatatcttcttaagcatttataaaccttttgaaagaaagatgagatatccaagtttatatatgaatagtatttggtgtcaaataaaaaggacaggagctatggagggagtaaaaaaattttagcctatgaaaatgtttttaacgtcggtgcatgagtgtgtcggtgttcatgggtccataaaaacaccgccggcaaagttagtgttattttcacatgcaggtatcctaagacaaccagtaaattaatttttacaagcgtgccttgactggaggagtcctatgcattctcacaaggatacattattttagtatgtttgttaaagtaaggatgatgtatctgtcaaaatggtattcttagtgaattagacatgttatactatcatgaccatatattgtatttagaataatcagtgttaaatcaaacatgttatatattgggaatacaatgaattcattttttagcatttctaaaatgtaataattataaattttagaattaataaataaatggagttgtacacatcttggacactcaatttaattctaaaactccaaattaataattaacaagttgttattgacatagaatcttccttttaatttaaaccatcacaaaaaaatatatacttttaacatgttattagaattttcaatattaatttgtaatatcagtaacaatggcccgggcaacacatctagatgacgacttgcaaacatcaatgatgttaaggctctgtttgaggagaaggagatagaaaagattggaaagatacgcaaaacgaggtgagccattagcacataattaattgagtattaactattttaaactttaaaaatggattaatatgattttttaaagtaactttcctatagaaaatttttataaaaaacacaccgtttcgtaatttggaaatcatgcgcgcggaaaacgatgtccctttttcacccaatcccccagaaacgaacgcacctagaacaaacacataatactaagataacttcaggacatcaacaaaagatatagcttattagcttgtgcttggttaaggaatcagcaacaacctttttgttttcagaatagctaacaatagacttgtggaagattagtgtaactagatcagatatatgagtatatgatatctgaaaatcattgcattacgacatttccacgatacacaacagattaattgccgcacagccgacaataaccataccctttctgtttagtgaaagatcgatgacaaaagttgaaagttccgaacaagttaacgacacgtttgatatcaaaagcaaaagcaaaccattcgccaaaagataaagagatacatgacattaatttcttaaagaatattttcaaaaataaattcatgttgattgcacacggaatttcgctgcggcacggctgcaataaattaacgtgaagcaaatttgtgagctgtgacgctacagcatcatcaagccatcaaatggaaaaaggaaaagaaaataaaattagaggttgcattgggcccctatgtgctacataatgaaagaccaataataatccccgagaaagctactactaaatagtaccccaaatctccatcggtaaagtggatttacgcgtcagcatcttgcattgacgccccaataaagctctggggatcccctgagacgaacgttcgagagagggcatttagacctgcttatctttttgttaactttgtatcagtatcagccactccgtaccacggtaccaacggctaaaccatgtgccattagcagtaagatttatgtgtagaacaggtgaagttcgaattctctttaattaagtaaaattgtttactctttgtaggttgtcttaattttacgattactaccattatactcgatttgtaaacatagatatagttaaaagaacaataccagtaaaacttcagtatcagtagttattatcaatagttaagatgttactttttatctaataatactgttcattaaattgtagcttcaaataaatttgcttctagacttttgtcaaaccaccacgacaccgaacgtacgaagtagatgaatacgacacagcactaccgttcgtacaggaacaaaaccttcatccctgcgtattctttttagccaacatcaccatacccaaaagtcttaacgtcttaactgtgctcgatagtacttatcatatatattcccaagctgttaaattacaacaaactttaggaatgagtttatgaccaactaaccaaccaattgccctcttaaaatccattcaattaccagctcacaaaaggataccctccaaggttcatccacacgcacaaagttgcacacagagtttgaatccactgaagatccacagattcaaaacaaacttttgtgttttgtcagtgtccaagccttcccctcaaagatgccacctttgagccgcccacccactctccctccctccctccccttgctttccttgtcaattttgtactcccatctctctttgttattatcccctccactaatccatcaacaccttcttcttctttcttcttactccatctccatccaaacctctcttcttcttcttcttttgctttgcttttctcgccgccgccgtccaacccaagagagaagccaagagcgacaagcaaacctgcaagtctaacaagccaagaaatccgagagaaatcgatccaaggaggagggcggtgagccatggtgcggagcaaggaggtgcacaagaagcccaaggacccgctgatgacgccgccgccgtcgtcggccaagaagaggggtttccgggacgacggcggcggcggcggtggggggagcaggccgaggaaccgcgagggcgcggcgacgtcgctgacgccggcgtccgtgcctaactacatgagggggacgagcagctccgacgccaaggtcgggcgcggggcggcgtcgtcggcgtcgccgcggcggaggccggtgcgggtggtggcgagggggaaggtgctgttcccgaaggtgtcggccgccgccgccgccgccgccagcgccgggctgggcagggcgacgtgctcgtcgacgatgaaggaggccaagttccccgacgcgctcgacctcgcccccggcgccaccgacgccgagggccccgcgcgacgcgggtctgcccctacacctactgctccctcaacggccacgcccactcgccggcggtgccgctccggagcttcctcgcgtcgcgccgccggctcatcaagacgcagcagagcatgaagctcaggggcgtctccgccttccgcaagggcgccgcccaccagaggccggaggacaccaacggcgctggcggcggcgcgagggtggcgccgccgccgccgctcatcgacgaggaggcgctcggcgacttcttcgtggaggtgtacgccggcccgcgtgtgagcacggacatgagctgcagcgacatgtccctggacgagatggacgccacggtgaggaagatggagttcgtcgtcttcgaccggtgcggcgccgacgagtccgacgagaaggggaagaacgacctcgatgtctgcggcgacggcggcgacgatgacggcgaggcgaggccggaggagaggtttggtgccttcagagacagcacgtcggagtgcagcgacgcgtcgacctccggcgaattcgtcgaggagttgccgtggatcaggtaccaggggtatgaggatgatagcttggatggtgaattttcagacgaacacgggatcagagacgaggagatcactagagcagttgtttctgaatttcaagaagatcaagaagaagagggcacatcaggtagattgggagatgggtgcgaagatgaggctgctcaacaacaggaagaaaatgatgagcaaaacatctcagattttgcctgtgaatcggagatcgcgtcggagcatgaaggtgttgatttcagagttgaggcttgtgaggagcaggagagagtcagtgaagacaacatcctggatgcggcacatcaaaccgaggtttgtagagaacaagagatgcaagaagagaaaaactttgctgctgtctgcaaattggggattcctgagcaggaactagcagagacggcggataatatccctgatgagtgctgcaaagaggagacttcaatggagcaggacgaaggcggcgatgggaccaacatggagtctgaaagcatttcagaggttgccgagcatccgaatgtggaagatgaagagaacacgcaggatgatggtggatctgaaatggagatatctgaggagatcatctctggttttgggtgcgaagaggatttctccgaggaagtcacttcaaaatatgtctccgaaggtgaaatttctgactccggtgcgattgtttccctacatgttgaaatgcaaaaacaaccagtggagaaccatgcctttgagcaagatgacagcagcactgcagacaatgcatttcatcaagatgacagcacagcagacagagcatttgatcaagatgacatccgtgcagatggctatgatgactctcagaaggaattggatattggaatgagagaattcagagttgcctccgaagaagttggtattcaagaagctaatagtgatgatcctgtggactgcacagaagatgctaacatggaactgggtgtattcttgtgcgacttgcaagatgcttctgaaggttctggtatcgctcaagaaagcagccaagaaggtaactcggcatgctttaatgatggagctcaaatggtaccagatattaccacacaaacaacagaagatgcttctgaagaatctgataccgctcaagaaaccactcttgatgataactctacaccactcgctgctggtgcccaaatggaattggggattggcacaagtgagttgattgaaggctcttctgatgtcactgaacagtctggtattgctgaagaaacctgtcaagatgataatgctggatatttcagtgatgatgattctcaaaaggcaaccgtgataaccacatgccaattgcaagttgattatgaagaaaatgttattgctcaagaagctgatgataactctacaggtgtcagagatgatgctcaaaatgaacctgagcaaacatgtgaattggcaacatctgaagaatgtcattttacccaaaaaactattcaaaatcatggtgctctagaggaatccgtggttatcgcaagtgcatcagaagatgctcatgaagaatcagatcctactcaagatggtcatgaagaagactattctgtaggtatcaattctggtgctcagaaggaaggagagcttgacacaagtgaatctggaggtgcttctgaaggaactactgtgcatcaagaggatgatggacacgttaacaccacagatctgaatggcagtgctcaaaaagagattactgtctctatattagatgactctgaagaactttgcagtagtgaggaaaataatcaatcatccaatatgctaataccagagttcagcgataacttcagtgctgaagagccccagaaccaagattctgttgcaaaagaatcgtcccttgatgacatatgcaacgcattcagcgggatgcacctcaaaggagatgcatatcttgatcctactgagtccatgacttgtccggggaatagattgatcattgctaggaggaggagaacaccggaagaggaggaatatttgagaggttttaacccaagggctccaaattttcttcctcttgaactggacccagaatcagaaaaggtggacctcaagcatcagatgatggatgagcgcaagaatgctgaagaatggatgattgactatgcacttcggcgagctgtgaataatttaggccctgctcgaaagaagaaggtggagcttcttgtccaggcttttgagaccgtcctaccgcacgacgaggaagagaagaaaggcatcacaccaacaaggcctgtccaagcttgcaattgataattgtagaggtaagaatttttgacgagctctaatagttgtaacaaattcctaaatacattggcttcttacatgcccttttttgtttgtctattgcagttagtggtcgaactaatcaagatcttgactcgcgagctactaactcagtggtcgctgcagtattatcgccggagacctgcttgaagttgaatgagagaactacttactagtttactggaaatctctagtttgggttgtttttactgaggatctctagttgagtttcttaggagctcaaaactgctccacagggaaagataaccactcactgaatcaaacagattcttatctagttactgagctgcaaggtaacagctcaccagctaagtactgtaacgtgtgtataaatgtctcttgtgctagtgtctgatatttactgatgagtgatgactgagactagcaaaatgtttagggtggttgatgccttagacagagatgaatagaattcttctggagtgcagattggttctggagtatgatcatacatgtatgctagtactactaatgtgcatttgtaacataagcagctcctgataatcctgggattgccatgagtgcacattcatccattatgtccctactccctactcgtatgtgcttatgaaccaaatttctgaaatttggttaccatcgtcagtctacttcattaaccaaatttctgaaaaaaaaactaattccaatgaaaatcttgtaaaaattctgtgtttcaaaggacacagaactcctgtaaaattccggtgttctaaaggatcttgcgactgtaaatgtaaatgtttctccctgaaggccatactgttgttcttttgtgctcttgaaaggatgcttcaaccaatctaacaattgcagtctaactgtacagaaaaaaaaaatccagaccaagtcatcggaatctgaatgagataaatccatttcaagcagtctcaatctgcgttgacacgacaacaacagatgggcctaaatcgtacaaggagaggcgcaaacggcagccgaccatggattttcctgacgtgacacgaaaccaaatatcggcattactctctactgtacgctgcttatccaaggtcaccaagggcgtgttatactctgcacaatttgttttagtttcaatttgcatctattttgctgtcagatagtttacttacatcttcagtaaaaaaaaaaaacttgtaggtagcaacatcatcatactacaatctagtttgagttatgacccgacttgagcatttttcatgcatttcggatgcattgttcccctaaagaaaaggcaaatactacttttgtattgtgttatttcacatcttggtatctatcgaattgaagatatttgacctacacctcaaatccgtagtgagaactgagcagcagactattacagcctcgtgatgctgaattttcgttggcgtattacagcagactattagcattgttatggccaaagaaagaaagaagattcacctttcaatcgaaaaaaaaagagtatgcttgtaatagtcacaggcaacagaaaaaaaaaatctccaactgtctcaggtagatttgctttctcagtaccatgaagaaagctcatcagatcttggcatcatacatggacttctgctatatatttttcaggccatctcaaatgtgcaccggcctaaaattgatgctatgcaggaacaaaattccttctgatttactgtcgtttgtgtctttcaagccaatcatctcatgaattcagcatcaataggagtacttgctaaacctgaatatacttggcattcacgcaacaacgatcttagttactactccctccgacctataatataagaaattttgaagggatgtgacatttttttaagtactacgaatctagagaaaaaatatgttcagatttgtaatactagctaggaagtgtcacatccctccaaaatcccttatattaatatattatgggacggagggagtacatatctttcaagaaagctttatatagccgaccataatccagtcatctacagctttacatgtcgactgtctttcctctcctgcctcctggatgatacacagtgcttatcctcaaacatctaaaatgcaccatccgcggaattttcttgcacagggctgtgcaaatttcagttttcctttacaaagatacaagccgacggttcgtgatccatggtcggtcaaaaaaggggaatttaactatttgccactttgcagttattttttttctcttcttaagagatgatttcttaactatttgtcacttttacccacgtgacataccaacatggtaacctagagtgaaaaatggtgtgagactcacagacccactcgtcagtttctccctcccccttcatctctcccctactcgtccacggcccccatcgacgccagcactgccccgccgctgaccaccgatggccccacctcgcggtcgagtagaggtgggagtggaggacgacgagggagatgagaaggaggagcaccgtcaccatgggcggacgcactggaacgggtcagggtacgtggcgaggacgcgagatacggcgtttgcgacgtcgcaccagagaatttggggcggccgccgccgtcgtcggggaggaggtcagcgccgttgaggatgagcggcgtggaggtcgccagcatggggacaacacggcggtgcgggcgccgtccttgacggggaggctgcttatgcggtcttccccctcctcctccttctcgtcatccccatcgccgtaggcccaagcagcggccggtgacgacctctcacacaagagttgccgaggggttccaatggtgggaggtgacgagaggcctcacagcgtcggctacgaggtgacgccatcggtggtcggcagcggggcgacactggcgtgtagagcagcggatcggtgttggcgtcgaaggcagcgcaacagggagtggaggcctgcgcctctgtagctcggggtgggtggatgaggcggcgccatcggtagtcagcggcgaggcggtgccggcgtcgatgggggtggtggacgcggggggtagggatgaaaggggagggagagactgacaagtgggtcccacaccattttttactctaggttgccatgttggtatgccacgtgggtaaaagtggcaaatagttaaagagaccactttttaagaagggcaaaaaaaattgcaaacctaaaaagagtatttggataatcgccaaactaaaagtggaaaatagttaaatttcccgtcaaaatatggagcgacgctttggaaaggggaaaaatacaaatacccctttatgaatcactggtcttttcgatctcccccctacaacttaatttggtacaaaacactccctacaagttttttttttcacttccaacttcccatctcaggccccataggtctctgttgtgatgaacgaagttgttccttgacaccaaatgggtgtactttgacctcctttcaccttttgctctttgcatgcttttattccaccagtggtatgacggtaaaaccacgacgacaaacacgtacatactactggtgtattaaatcctattcctaacaagagaaggcacatgggacatctttggtcaccacactagagatccaaaaatcacttaggctgagttcggatgggggagatggggaacctaactctcctgtgcacggaaaatggagcggtccattaacacgtgattaattaagtattagctatttttttttttaaaaatggattaatttgatttttttaagcaactttcatatagaaactttttgcaaaaaacataccgtttagtagtttgaaaagcgtgcgcgcggaaaacgaaggagaggggatgggaaaaggtgcatgcgaacacagccttagcgtgatgagaaaaatcacccaaaaaaactagatacaggtgggaagtttgaagggaaaatagacttatggggagtgtttcgcaccaaattaagttgtagggggagattgaaagaccattgacttgtaagggcttatttggattttcccccagtgaaaaccatcgttcgtattggcttgtatcttgggtccgttagcatgcaggtaaagaaacaatggtaattcgtactacctctgtcttaaaataagtgcagccatgagtttatgcacccaactttgatcgtccgttttatttgaaatttttttataattagcatttttgttctgataagatgataaaacatgaatagtactttactcgtgacttatgtttttaatttttttcaaaaatttttaaataagacgaacggtcgaagttgggcgcgaaaaactatggctgcacttattttaggacggaggacgtatttagttaagtccacaggctaaattaaggcatgtatatagttgagtttgggttgttgacttttttggggcccatgtcgttgacttttttctccctatcttagccgtgtttagttctttagccaaaatttttgtaagtatacgtacacatatttgaagtattaaatgtagactaataacaaaataaattacagattccgcctgtaaaccgcgagacgaatttattaagcctaattaatttataattagcaaatgtttattatagcaccacattgtcaaatcatggcgcaaataggctcaaaagattcgtctcgcaatttacatgcaaactgtgcaattggttttttttccacatttaatgctctatacatatgtccaaacatttgatgtgatatttttggccaaaattttttgggaacgaaacacacccctaatcgaacaaccagctttcttaatccaacagctacggttcaactaagggcctgtttagttgaagggactaatccattagtccctaaaatcccaaacaggtgactaaaatggactaaaagtacattagtccattagggcttgtttggatctatggactaaattttagccctgtcacgtcggatgtttggatattaattagaagtattaaatgtagactaatgataaaacctattccataaccttagactaattcgcgagacgaatctaattagtctaattaatccatgattagcctatgtgatgctacagtaaacatgtgcgaattatggattaattaggcttaaaaaatttgtgttgggaattagctctcatttatgcaattagttttattattagtctacgtttaatacttctaattagtgtccaaacatccgatatgacaggaactaaaatttagtccctggatccaaacaccaccttagtccctgtgggaggagcttataggaattaaaatcgtttctttcccccactgctcccgcgcacaacctatcctcccattcctcgtctctgtctttgctccactcgaccccacgccgccgccgccgccgccgcctccctgcgcaagctcccgccgctgcttcgcgcaagcccagcctctgccccacgcaagccctgccggtgtcgtggaagccgccgctgctcgtgtaagccaccgcgagtcgtgcggcagccatggcaggcaatgaggaagacacagtggatttcttctcccagtcgtacacacatcacctggcggccgccatcgacgccttcaagtatggcttctcgcaggggtcgtcaggccaagctggatctggcgccggtttccatttttgggggaggggatctgggggcctggatctgtactctcagaccgacgccttccccgagttcgcctcctactagcagatctttcaatcggctggccatgggttacctccgattcacctggcagcagatccaccgtcgccccgtcgcgctctccttgcccgggggtgagacgcgatagaagtacttatgttcatatttcgggaacttgtgatttgtatttctgttttctccacctgttcatgcgtgactgacctggtagagtgatgatccaaacctgttttgcgatgaggacagcagtgatgttctgcaacttgttttgcaacctgatagaatgatgctttgtaaagaagaaggcggcagccatgggcaggagatggtcttgcggtggcatagttttagaggtaacatagtctttgtatagtgtatttaatgacctttagtcacttttagtccttacatccaaacagatatagactaaagtttttagttctaggactaattttagtctagggattaaaagatccaaacaccctcaaaatacatggctcattctaattgcatttcaggattcacttttccctaggtaagatatgtaggctggtaaaataactcataatccagatttattatagtaggatcgatgtgtctcatccaatcaaattttcttatattttaggacgaatgcatatatatggtgatggagagtgggttaagtagatgtttgcgacacttcacgctttagggccccatatatcatgtcccaccatatttcactttcttttttaagtaaccaatcctctagacacggattagtcttaaccacactgcatagagaagccactacatctattttaaaatgcagctatttttatcaaatgaagttctatttcttcacatatcattccttacaaccaatcacaaccattctccatttatttttttcacatacttttccttttcaaccaatcacaattattttctaataagttttatttacttttattaatacccataccaacctagaaattatttatattttagaacagggatagtagtcatgggcacatctggcccttttctttcccgtgagtagataaaagaggcgcagtgccagtataactttgacattaggtaaggcatatgtgctacgacgagcagtgatgttcaagaagcacctagcatcttttgtctgcagctcgaacattgccaattacaagatcaattaatccaacaatgtatactaatgtcgtactccctctgtctcataatataaaacataatataaaagacacgatcaaactcgatacagatcaaaactattctttagcttatagtttctcatacactataaggtttatagcaataaaattatatatatgaaattaaattcaaatatcaatccaatgatattattttcatcaaataaaattcatattatatcaattgttggtcaaatattttaaaacttgaatttattagataggatggagggagtaagagtaagcgcatccgtaaatatgtgcacggagcaatgctactgctactactcctcatgcacccatgatgatccatgatcattaaagcattgacaagcgttgacaagaaaggaataaaggttaacttgccaatgcttgctgtcagctgccacatatattctcagagaggacatcataatctgcctatataataactactactccaaggagtaatacataggcgcagatccacgtatcaattaattccaaagtatgcggatcacttgaagagagctgacacttcaaggtgaattacgcaggtatgcctccatcgagttccatggatacttccacttccacgagctctcccaattttaatttcatatatatatatatatatatatatatatatatatagtagtattatttaacacacacttgtgtgtacatcttgcacatgtgtgcaccctgccatcccctctaccttaacccacgctcaaagtgacgtaattagtgatgaatactaaacttcactagatttctactccctccactcataaatataagcacccttatcgccttttagcaaagattaaagtggaaggaaagccaaacaatttaggttttattttgcaacaatgtcgatcattaaatgcggtcctagtaagaagaataatataaggaaggggtcgatgcaaagtatgaacagtaaaaatgtgccatgaagttttatatttatgccatgaatttcacatacttgtctttactagatacctctcaaacctttttacacgcggatcgtcttttagtctgtttgtaaaaaaaagcaagatgtaaaaaaaaattcattttggagtagcgtggacaaattctagtaggaatgcctatacttgttgatggggagcatattgtagcagcgaccagaatattttattgatattttacataataatattttagaatactacctctgtcctaaaatataggaagttttaagcttaaacgtgggtattaagaaagtatatggaattaaatgtcaggagtttgcgattggttgagaatataatgtagatagagaagttgttataatttggagcaaattttgaatgttagaagttatattttgaaatagagggagtaatttgtatttcaaatctttaaaaaagattttcaatacagaagtacatgatgatggctccttaaaaaaaagttctacttgtttcacatagagatatttcggacgtgtcgtgggttttattctatatcactgtgtaacccatgaataaccaacatacatgttcattggtgatttttggaagattgcgtgtcaacactaaataaaacattcaataagtgcagcaaagtaataggctaataattatttgatgttgaactaacttataggtgtagaattatggattttggtatatacttaatagttacgaattacagtaacttatgttattgattgtttgtggttttacactagctagtaattgtgatgttctatacctatgaatagatgtattacatgatgttgttgaaaaacccataggtatcagtaaatgcgtaaaaagaaaacccacctgtacccaatggataaccggtattcaacgagtgtaggcatgcatggttaaaattttaggcatggatgtgctataggtgttttgagtctcagattgggtatgctctcactccacccgaacttaatctgaccctatatattgctagttccaatatatagtaatttctaaaaaagcatcatttttcaagtatttcttggaatgaaatcttctactatattttcataattaatcttctccagcattagcctcaatatctaccgcatcatcaccatgaccatcatcaacactagcatctggtttgatattggttgctgcttctagtctatctcttctaacgcttttcagcaataggatcatacttcttatttctagcaggcatgatatatataataagaattgaggaaataagcatcttcctgttttataaataaaagaaaaataatttaatttgaatcaaacattcacattacttttgattcaatcgaccattcaagttatggcaatcgtaatttgattcaaattatgaatttacgatctactcacagtctcagctctcaacttacagtcaaacgagtcgagccgtcgaggaggcaggcgctcgacctagcttggcggtcgctgctcgccggccggttgggcggtcggggtcagggcgcgcgtcgtcattgactgcgtctcatcatcatctagtcgaacggaaagtcgagacacaaactgcagctagacggtttgatgaatgtgttgtaaccccttcagcgattttacatattttaattttaaaagtcaaactttgtaacatattttaatcaaaagttagtcaaatcccaaaaaaattatcgtatccacattataccaagggattcatcgtatatatttattgtgcgatactagaacaactaatattatactccctccgtccctaaatatttgatgccgttgacttttttaaatatgtttgaccgttcgtcttattaaaaaaaatttaagtaattattaattcatttcctatcctttgattcattgttaaatatatttttatatatactatatagtgttacatatttcacaaaagtttttaacgatcaaacatatttaaaaaaagtcaatggcgtcaaatatttagggacggagggagtatattttatagaaatcaatgtcaaattaagttttaattctgaagacctttgaaatcaaaatacactctatagaatcaaaagatggtcctattaataaaatagtaatatgtcatgaacgtatactttaatgtgcatacgatagaaaagtttgatacgccatgctagaggaattgtcccattttctcaaactatttagcttgagcacttaaaccatttaactattaatgggctcatgttatccccaaattactgaaaaggccaacttatagaagcatattttaagttgaatttgtgtacaactatagtgacaattaacatcctgtgtacaaaatggttttttaaaaaagattgcagtttgcacacatttttaaatcttgatttttaaactagaacctatgcaaatagtgattaaaaactccaaaaataagttgagatttaagatatgatactataatattgcaatttatgctacttgtaatgttgatcttagaatataacttgtatagagagaaagaaaaaagatatttttttagggaataaagtgagcaatttattattgtattattgagagagggctaaaatatggcacacaattttcactttgagggtgaaattactacattaattaatcgggaaaaaaagagagtaaaatacatggatgccatgttgatcatttgggtccatattacagtaattcatattagtacatattgtagcgttgcaacaacagcataagagatacaactgtgcagaagtgtataagaaagacataaaagttgttgaacagctacaaccctagcttgaaaactattacctaaatctatgcatgtatgctggaaacgagctagttttattaattctggagagtaaactgatccggaaatatacgtacattatggggtcatgtacaggtctaagggagtgaagtggatttttttcctaatctgaatcattgctaggagaggtttttaatttgaacaaagtacatagacatgaattaagatttaattgacatgcgtgatttataggtgtatataccatcatatttacacgcttagctaggtaacatgtttagctagctcaaacacattcatatatggtgcactaattgaaattaaacctggttaatttacagattcaagtatacagagtgttttggaggcatggaacaagttgatactaagaccattgtgcaacagttcaaagattgggaaatccagatattggtgctcctgagcttttgccttgcaattgctcctcttcttttttggtggccttcgccgccgtaccagccgagtgtggcttagagttttcctatggttgacttacctgtcagcggatttcatagctgtatatgcactaggctacctctcacggcatctacccaccactacaaatgaccatatatgctaccaaacatgccttggaaaaaccttgttgccaagccaaagccatcatgatttcacactcttgtgggcaccattctttctcgtacacctaggtgggcaagacactgtgactgcatttgccattgaggataatgagttgtggtcaaggcacttgctaaatatgatagttcaggtatgcttagttgtgtatgtgatgtggtattccatggcacataacctacctgttgtcccggctgcatttttatctgtcgctggggtcatcaagtatggggagaggatatgggcgctcaagtgtggtagccaggaaagtctcaagagttctattagtagctcttatgtcgcagctttgaagaaattagcacatgacgaagaagacggaattcaggtaaccaaaccggcatcgactgtgcagcgtgctcttaagtgcatgccaggtcttcgggaggtattttctagaaggtaaccatctggaaacttttctttcaaaaagtctctcgatgcacaattaactttcaagacggcagaaatggagcttagcatgatgtatgatgagctctacacgaaagccaaagtgattcaaacagggaagggcaccatccttcgttgtgtctccctcacctccacagtggtggcttttgttctcttcatcctgatgagtggcagcaagcaaaggtattacaactcaattggagttgatgttgcaataacctatatgttatttgtaggagctttttgcttggaggcttgcgccatcatcattgccatggtttcaccgagagcgtgggcatccatggaagctcgaggtggaggatgcaacagcagtttgctcacccgagcaacctgtaggtcatcatgttcatctatgttgccgagtatccatccagagaaaaggctatggtggtcaaactcattagggcagtataactttatgagctcccgcctggctgatggcaagtcgaggataaccgaggagatgatggccattgttggagctaaggaggtgtggagtaactttcggcacactaggcatggtccagtcaccgatgaaatgaaggagcttatccaccaagaaattgataataacaagtagaagaaacctctaaacttgtctcctcaattgttttttgcgcaagctgcttcctcctttgaggaaaccttgttcatgatgcacctctacactgacatgtacttgtacaaggtaagcatataattagatacaattaggagcagcgggagggatgatgatattcaagagaaagaggtacattccctgatgcatacatgcgaggtgatatctgactacatgttcttcctgctggtcacgcagcctgccatgctgcctgttcaacgcaatgtgtatgatttgttagcattggttttgaacgatgccggctatgcacgtacctccagcaaggagcagtttcttgagacagtggctagcggtgagtactcgtgggaccaaccattcatggacttcagggcagcacctcctgatgacatgttgcagcagggttggaagggtttgcatgcagcgctgcaagtaatgttgcagatctgggtgcggctgctgatctacgcggcgggcaagtcccagcacgcacggcggctgagcatgggaggggagctgctcaccttcgtttggctcctcatggcgcatcgggagcttggagacatctataatatccagttccagcttgtggaaaaagagaaagacgggtcagtccgtactggtcctaattcaacaataaccaccgacatatatactcttttccgtttaggtcatccgatcgacatgatcaaatagtactggtggccggtgatcgatggtctctttggactctgattatcttaagccatcaagggcatgtatgcccgcaccatctcgatcgtttccttcatgtggatcataatataatcgatcaccctcggttattttttttctttcttttctttttggttgtgtgctatctgctattatctaataatgtcatttgtattagttgctggttaattttgctgtaattaaatatattgtttttaattattcaatatgcatgtaacggactatatatgtatgtataattaatccatgcacatatttttgtaagctatatatacatttgtaagatttgcttctatactcctcgaaaaaataaatgcacggatgtactagacatgatccacggcgtatattggggtggcccaatatactcaacggcgtattactatttcaaaggggtaattttatcttaggaaggagttagtccatactccgctctgtcccaaattatttttatctttaaaattcaaattttgtcctaaaatagttgtcacaataaactactacttgtcccggtccatcaatcacttctaattcaaatttctcttttctctgcccctaaccaccctcttatatccaaccatataatatttaatagagggtacaatagtttttttctcaaatcttaacctatgctaaattatctagaacgacaactaatatgggatggaggaaatatctatctattttctctcaccgcactagctaatctctcgacaagagtaccgtctcttaatcgcgtcacctgcctccctttcttgctctggaaatacgttcctcccggctggcaaccatgcatcaagaggagcaattaatcaccttagtttcactaattaattagcctccagcgagttgtttgcctttgccatgggcgagtcagatatgatcgcagtcgaagcccagaaggccagaacgaagtggccgaaagcccgaaatccgtccggtttattagcctcatcaccgatttcagctgcaagcaacataacatatatacatatatacatgacccttcccccacccccaccatgactaggacacgtggcgtgcgtagagcggacggcgcgccttttcctttttttttcttttctgtttcttttcataatttatttcttgtttttttttttagtttttttaatacgtatatatacaaactttgtacatgtgtatatatttttttatacattataactgtatacatataaaaaaattatatatatatatatgtatgtttgtttatatacatacgtataaactttgaaactcttattctaatgtcctagtaaagttgttggatatacaaagcttcgcattgggacacaaaaatcatagatggagccaaaactgagagaaacgaataacaatatatatgacaagatacggagattaattagaacattttccttagctgcatcaaagtatttgcagagtacaaccatgtcactcttctctaattccacgaactaaatcctggacaaaagagaaaaaaaataattctgaaaccttgattttcttcctaaagcatgtctcacattttaccttctcctttggtctatatgtacccatcatgtatctatccaaatcgaatttcacatcaactttgtcttgatcagtagtgcttcatcccgctgacgccatgtaagagttcccttgaggccttgaccttgtcacaacgactgtattctacaatatgtttacaaattttgtgttggatttcacgatttagatgaaatttttttacggtttgaatgtaaagaaaatatgccttttttaatggtaaactctattttttagcccttatatgttatttttaatacattttccaccctaacctacaaaaattagtagttttttagacaacacagcgcacccaccaccccccaccccccgcgtgcgcaaaaaaaaaaacacccacccacccaaaaaaagagacaaaaacctttaaaccgaataaataacaccctattgtaataaaggtttaatttagatttttattatgcatagtttgttatttattgggtccacaaccataaaactaatataatcaaaaccatcatgaaatttggtttagggaattatttatccagttttaaaagttgagggtgcaaaacaaaaggcactgatattataatgtagggtgaaaaatgaaatcgggcaaagtgtagggagactttacaagtcataaattactcatagcaaatctgttggatttttctacggtctgaacacccatgtcatcaaattggttgccccaaatttgtcacttgatccaatgcatggctgaaaaattcacaggtgcctccgcacacgccatggcccagcaaggcagacgatgtgaatcacatcatcctcccaaaagcttcacagcctattcttggccagttgcttcgccctcaaccgaaacaaagaaaaaaaaagggagaaagaagagggaaaaagaaaaaggaaaaaaagggaagaaggcacgcacagggaagcaatagcaacgaattcaaccaaccaaccaaccaacccttctgctgcttcaatcgatcggcaacaaatctttctgggtggtctggtgctcaactcccccatcgccattttatgcccgaacctgtttctccagccaatttgatgaggattaatttccaaacgggctccgatcgatctccatgattaaccatccggcgtggtgatgagccgccgccgccgcatcgtcgtcgtctcccgatgcatcgccaggacgtgaggacgaaggaggccgaggaggagaggatggaggagaacaatctcctgcattttctagatagcccaaacgcgcattacagaaggtgccgcattttatcagtatatctgtcgggtttccttgcgaatttctctccgttttttgttcatgcaagattcagtaagaactttttttttctctcttcctctttttttttttataaaggaaatgtgaagaatacgtatccgcgcatgatgatgaagcccattgcgatgcatcaggtttttccccttgctccttcctttcctcttcacgttcatcgtggttaaactcattggggatctttgaaacgaatagattatagatctacgaaaagcttcacatgtatactgaatatcgcacaatgtcgaattttgttggaggagatttccatgatttttaactcttgttattaacattgtgcgaaactagctcaaacgggttaaatggctctcaaattggcattgcatggatggttcttccttggagctgcaatggctcacatttgcatggttaccaaatgccaagtgccaatccaccgaaaaatggggcttgcagagcccaaattgtgatctgcaaattcaattccccatgccatcttattctttatttgtgttcatgaccatcgtttctccaagaaatttgtctaatggtgttcaatgtcgatcatcgttgaaaattaggcggatctatatatgagcataatcttctgtgtttgtttgtctttaatgattcgcgtgtttccgacaatagctgcaacctgcatacaataacatgcaactcttaacagatgtagatctggccaatgcaagggaaagattggagcatctgttgaaacaacctgccaacaagttctgtgcagactgtggtacccctgatccaaaatgggcgtaagtatcagccgtttcccagacatacaacattatccctatatttttgtttttttttataaaattaatgctccttttgttatcctaatagctgatgtggttcttgcagggccttgccttttggtgcgttgatttgcataaagtgctctggaactcatagaagtcttggagtacacatatcaaaggtgcacacgattgactctttgtagttcactttgttctcccatctgctcatctcaaatttggtttcaactcgacttattctgattcaatggttgagatgttctaagagaccaaaggttgtcacgatatgaatctatttgtctctacagtaccaataaatttacactgcaggcaaacatttcgttactcaaaagcatggacatatatgatctagtttgtaaggcataagcatatggtaactgcaaactaatagacctcatactgaagtaataattattcaacaattcactgttcaattgagcacaggtaatttccgtgaatctagacgaatggacagatgaagaggtcaattgtttagctggttcaggtggaaatgctacggtgaacacaagatatgaggcctttttgccagagaactttaaaaagcccagacatgattgcacaacagaggagcgttgcaatttcattaggtataaattacgagtaagctagtatttttgtcgttactacttctgtagattctgctacggaaagtaggattctgatcgttactccttctgtaaattctgtttgacaaaactatgctttctctccatctacgtatatgcaggaaaaagtacgagtttcaacagtttgtgactgatccacagttttcatgccctttacgattgaataccaaacacgcaccagacaagaatcagcagcagcaaaactgcagtgcgcgacatggttttggccatgcttttaggaatagctggaagagaaaggacacagataacaaaggactaaagaaaatggtggggaaaacttacatattctacgtattttaagcgggtattgcactctatgaactgtttttactgcaacatggtctaattttttttttcagacggatgtgggtatggtggaatttgttggattaattaaggttgatattagacggggcacaaatcttgctgttcgtgatgtgatgtcaagtgatccatatgttatgcttaacctaggacaccaagtaagctcatcttgttaacagatgccagttatctctgaaaaaatatgcaatatatatttttcttactgccaaataacatttttcagaccatgaaaacgaaggtgataaagaacaccctgaatcctgtatggaatgaaagactaatgctatcgatccctcacccggtgccgcctcttaaattggtacatgctctttagtcataacaaatcatctaattttaatttttgccttgcccatcaatggagagtattgatcagtatctctatccagtgttgtagaatagctatgttgtgcaactttgtgtggcaagcaaattcttgatctttagtattcaagagttcaagactctaggttgcttttgaagtatagaaatttgctggctaaattcaatctgatttattgagttacctacttatggatataatgatctgaactcattttgcgtcaaaaaaaaatgatctgaacttacgagagcagagtgccttatttccccttaagaacagcaaagagagagtagcaaaagccaaattcaagcttgtgcttacatatatatagcctatgacaaaccgcatttttgtttggttggttctgaagtgagaattcttcgatcagatccaaacacatttgttacagataggatggaaacatggattacccactgatattcaaatttatgtacaaaaaagaaatgttctacaaactcacacattgcatctctatctgctcttctacctcctaatttaacagcaagtgttcgacaaggacacgttcagctccgacgaccggatgggcgatgtggaggtggacatccagccgctgatcgccgcggcgcgagaacacgagagctcggccgccatcgccggctcggtggaggtcacgaagctgctggcgagcgacgacggcacgctggccagggacagcgtcatctccgtcgtcgacggcaaggtgaagcaggacatcgcgctgaggctccagaacgtggagcacggggagctggagatcgagctcgagtgcgtgccgctcagccagtagtatagctatagctgctgtacacattttattgctactatagctggccgggatgaaaaatgctcgatctgcattcgctgtgggttgtgtgatcatatgcatggagcttaatttgcttctgtgttttactccatgcctgtatactttgtcaagttgtgtcatgttgagggcttaatgttcatgtcatcgtgtattaattagatatggtttgtataggtaggaaattaagggggaaatggatcgtctaaaacaactctaattttaggcttcaatgttggttttggctgattctttgttatccttatactattactgctagtgtgtgtagctaattttggtagttctcaagcatttccagggtgttaaggggtaaactgccagacatacagtgttcacaaactattactccctccgtttcacaatgtaagtcattctagcatttctcacattcatattaatgttaatgaatctagacatatatatccaactagattcattaacatccatatgaatatgggtaatgctagaatgacttacattgtgaaacggaggaagtaccttataagactaccacgcaagaaaaaagttcaatagaaatttagtgaggctagagaattactcctagcctatgcctctttaagcatgtgaaaagggaggacttgggggtgtgtgatgtgagtgttgtgtgtttcttgcttgtaataaaaaaaatcaaaaggataaaaactggcattcaattgagaaaaagaaattgaaggaataatcaaatttgtaaacagatgaaaatcaaatggaacagacatctactccccaaatcaaaaaggtaattaagtaagccaagaagcaaagcatcagaatgaccaaattaactaggaataagtctactttgactctcttaactagtgaccgaatctgattcctattcttgaacagcaataccagatatcttgaccctcaactattaaaactagtccaaattaactccctcagcagttttggagggtggtttcactgacgtggtgcatccgtgacggtgttgacttagtctatgtctcacgtggtgtttacgtggtattagaactaaaaaatatatatggaacccatttgacatccacacaaaaaaatattgtggggcccacatgtaatcttctctctcctttccttcttcatcctccctttctctcccttctctctctttctctttctccccccttccacttccccttcggtcgtctgtagggggcgagagctggagcgacagcaacaatgggcaggcgaggtcctgggtggcggcgggcgctcgagggccaaagcggtagtgggcccttgagggccggagcagcagcgacagtcggaaggacgggagctggagcaacagcggcgggcgggcggacggctaggattgccgaagcaccgccgcctcctcctttgcctgcatcgtgccagcaccacccctaatccggtaccaccaccaagctccatccgccgcaagctagcttcttgccacccacctcgccgtctgaggccgtcactgggggaggagaagggagaggggagaggcgacaccgcctagcttgtgggtgcactggcgtggggcagagagagggaggagggagagagaggatgacatgtgggctctatgttagggtcccatatatatgtttttaattctaatcctacataagcgccatgtcaacgccatgtgggatgaggaccaggtcaacactgccacgtagacaccacgttaacgaaatcgtcctccaaaaccaccgagtgagtcaaattgtagtggttttaatagttaggggtcaagataaccggtactgcggttcaaggatacgaattagatttggccactagtgaaaaagtgagttaaagtgaagttattccgattaactatcactcgcaagcaaagtgccatccatcgagaatcgatgcggcccaagcaaacgcatcctcgggccatcacacgtttaggcttcatttcaaggaggaagcaattgcacgcatgcgggaggggggggtataagttcactttaggtctctcaatttgtcatcgagtccgaaattcgtccctggagcgcaaacctgttacaacgcatcccccaacttataaaaccattacaaacgaggtccttcacctactcgcgcggttggcctccgccatgcactacacaaccatccatcgtcgtgggggtcgtctccgcagccgtgcggaccaacgccaacaactgctcccgtgacaagggctcggggggctttggcgatgtcccccttatcgtgccgaagctccgaggagggcatctcctggtggtggttggtggtggtggcagtggcggtagcctccgacgcgttgaccgaagatcgagcgagcggcgcgaaggggaaatggatggagcgaaaaggagcggcggtgggcgaagcagaggggcggcggcgggcgagctcctcgctctctccacctcctactcctccctcttctgtctatccttctctctccccctacactgcaagaagaagagcggagcagcggcgggcttccgttgccttcctcggcaaaccccaactctgtcggcgacgccgaggtggccgaccactgcagcgccatcgtcatgacggccacggtctccccgtctcgctgaggttgctacctaccgccgacctcgctcgccttctctgccgttctcctcgacgcctagccgccctccatcgcccgcccttccagtccgtgcaaatccaggctggcgccctctctgctgccgtccctcttctcgctgcagcccccctgctccaccaacgtcggccacacacctcgcaaagctcaaagaggaccatgccgcacacctcttcgtccataccagggatgcacttgaggccaaggcggcggagacggttcagcgtgttgctgagtgaggatgaggaagaagaaagagaggagagagaggggatcaaagtttttatttcgtacgtgcaactgatatgtgtgtcccattgttttttttttaatttttggggatcgcattgccacgtcaatgccatgtgggacgtagacctagtcaaaggagccacgtaggcgccacgtcagctaaaaccaggcataatactgccgagggacctcgtttgcacggttttgtaagttgggggacaaatttcggactcggcgacacataagggatctaaagtgaacttattcaattgcggagcgtacattcttgggccaaatcattttgctggcttctttttgaaccgatccgataacaaggtattactgacctgtttcagcccaactactatgggccgcacgatcctgtttccggcctaaacataaccgtcatgacccaattacggccacgaagggcagcatgcaggggacgtgcggtccgtggaattttttttatttatacattttttattaaaatatttacaaaaataattttttgttttgaaaatttacaaatctaatctcctgcggccctcccaaaggacggcaagggacctaaatgtaaaatttttatttgtgttcaaaccctttccaccggttttaattgcttaaaaactaataatgcttattcgatacttcaaataattttaaatggaaaagtaataaactacaaagttatagatctcatcaagatctataatttttatataaagtttatctctatccaatgtcgtttgaaatgtagatctgagattttttaaaatgtgttttatattttgtaacgaatatttggatatctaaaacatcttaaatgaaaaagttgttaactacaaagttgtagatctccttgagctctacaattttgatataaagttttatttcatctaactttatataatataattttaaattataaaagcatagagctaacaagttgtgctggaaaatttgcatttaggtcccttgccgccctctggaagggcgatttttaaaaaatcgtcctcccaaagagcggcaggtgattagatttgtaaattttcaaaacaaaaaattatttttgtaaatattttaataaaaaaatgtataaataaaataaattctccatgcgtagcgggctggtttgcaaaaccgccggtaaccgcttaccgaggaatatggttaaaggaaaatttttgataaatttaaataaatttaaaaaataatttaaaattttgataaattttacatggtttcgtacggtttgccacggttaccgcagcaaccgtgcttaccgcctaggcgcggtaaccctggttccggcgatttgggaaacccttcgtggcatgggcttttgtttgcgtgattttacagcacattcccacattctaaactactattatttatctttcattaattccaaatatcaattgtcccctagttctccggttaccacaaccccacggtttggccgttatcgtgaggtatactgttgatttaaaatttgagaaggttatcgcacatgataaccgcgataaccatgtggttttgtaaacctacaattaaatccaaaagtaaaattttaacttaaagtgacttgaacaaatcttaaacatccatttttagatgttacccttcatctacttttgatagtcatatttcatcttgacacacagatcaaggataagtaattctacttatcatctatttaaacatgctattagtcatcgctcataaacaagcgatccattaatatttacatttcttgatgcctatgcaaccaatcttgcgtggaagaatggagagtcacgcattaaattcgagaaagtcattaagatgataggttattggattggaatatgcctatcaagaataaatttttcagatttaaaaatataactatcaaaagtagatgaagggatagtgcagtggtaacggggtgtgtagtttcaattctaagatcatgtgctcaatccctactataagcttacaattttttattaaaaaaattggagagacgactctaaatacaacatgttaatagagtagtctgagagtcgtaattctacggtagattgggcagattaatttacatgaacaacacaatacagttgtacaaacaacatttatcacaaggattgatacatgagtacatgaacagtggggtactattaatcagcagggattgccagccggaacacacaatagtgtaatgcgcacacaagcaaattcaccttagctagctaagccggacaagcgtcgccaccattgagctccacgtcatcgctctccggcgtggtcgccgtcggcgtgcgccggtagagcgccgtcatgaacggcgtcgcgagcaccgtcgtcgttagcgccatgatcacgaagatggcaaacgtcgtgtcgtccagcacctgcacacacatatatacacgcgtacatacgtatatttgtacgtatcgaagtacatggacacatgtgagacgtatacgtgtataaagaagacataccttcctctccttgccgatgttgagcacgatgagctcgacgagccccttggcgctcatggccacgccgagggcggcggcctcgcgcctgggcatgccggtgccggcggccaccgcgaacgtcccggcgaacttcccgccgatggccacggccacgacgagcgcgaccatgccccacgcggccgcgccacggacgttgtcgatgtccgtgtgcaggccgctcgtggcgaagtagagcggcagcatcagcccggacaccagcggtgccaccttctcgcccgcgcgctccgcgaggccgccctcccgcggcatggccagcccgaacacgaacgcgccgaacaccgggtgcacgccgatggcgtcggtggcggcgccggcgaggagcacgcacgccacggcgccggtgcacgccaggtcgcccgcgcggtcggggccaaggcggcgcgccaggcgcgccatgagcgggcggagcgcgccgagcatgaacgccacgaaggcggcacccgacgcgaggatgtacaccggcgcgagagggggccccttcggctcgccgcctccgccgccggagacggcgagcgcgagggcgaggaggacccaagcgaagacgtcgtttacggcggcggccgccatggcggtgtcgccgaagggcacgccgaggaggctgagctccttgaggatgcaggcgagcacggggagcgcggtcaccgagagcgcggcgccgacgaacacgcagagcgggaggaaggacgcgcggcgcggcgccgggacggcgacgtcgaggagcggcacgaggcccgcggcggcgaggaacgggggcgcgatgcccgccgcggcgatggccacgctgcgcggcccgacgcggcgcacggagcggaagtcgagctcgaggccgaccaggaagaggaagagcagcaggccgaggccggagacggtgtccagcgcggcggcgctccacgccgggaagagggtgcggcggaaggggccccaccggccgagagccgacggccccagcaagatgccaccctggcgagcatgcatatatgtataagtaaacaatcagatcatgtactcccttcataccattctgtgtccaactttgatcgtcggtcttttaaaaatatcttatttaaaaaaaactatggttattatttttgttgttattagatgataaaacatgaaaaatactttatgcgtgacttatatttttaattattttttaaaaaattaaataagatgaacgattaaatttggtcatggaaactcatgccctgtgtttaaaatggagtggagagagtactgatcataagtatactagaacactttatatataggttatttgttatgaggcatgcatgattcaggaaaacaagagcaaatgcataaagcatggattatctatttatcttggacatgccgtacgaatgaatgttcattgttacagtatgtcattagttttctggaaattaatgtgttctagatagctaaacaggcatatttccctccggttttgcttaaaaatatgtagccacagtttttcttagtttaggttatttttaaaaaaatgtgattgctacctcttttttaatatttaagtatgtttttacctctcccatctcccttttcatatagataattaaattttttattataattttctgatatatggtaggaaaaattatacagtaagtattaaaatttataatatagctatcaacatttgcatgataattgaagtgcaaatatatgtaatttatcgtgtaacaaatgtgactgtttctaataaaaaaatatgatgtcataaatatagctacatcggtcatctccctttccatgtaggagagttaagtgttttgaccactgaacagatacacatgcgatatatactactctctccgtccccaaaaaatttaacgggaaggatgcgacatcacctaagacaacgaatccggataacctcatgttcagatttattgttttaggtgatgtcacattttcacttatgctggtttttttttggacagatggagtacctcctaaaattttctaggtaaaataagtactcgtactaaatacagctatgcgggacttagtttgtgaatattcatgtcaattctagggcttgatcattagaaaatatgaattgtcgatcagttatgccaactacatgatttgaatctgtggtaaatctaaaactcaaattctggtgggaataactgaactgttgaagttttgtcctcgtggcttatgcataaccccaatcaaaaagtggacttaactttttttgctgtgtacaagtacaccatccaacacgtcaacatctggctgaatatatagtcaattatattcaatgacaattgggagtactttcatgatctcaacaatgttgtgcctcttctagaaaatgcggctgcctagctatatactctagtttggtagtcccttgtgttgtgtgtacattaggagaatcctagattctcgggagatatatagagaacacgttcaagagaaataatgccaaacatgtgacgcgcattattaaagaattatagggccacttttgttttttttatttatgcgagacaaatctagctaagcatgtatgcactgacttaattagtcactactacttggggctgtttggatggaatgtaagttcccggtggagggactaaaattttttttgagggattaaaatttttgtaagagaaatcaaaattagtccctcccatctaaacatggccttcatatcgatatcgctcatgttggtagagaaaatgacctcattatatatgtagcaaaagttttcgtcctttcgctaacatatatgcatttcttaatccggtctccttatgatctcctaattattttttaagagatacatattgtcatagaaatgtgaacgtagcggttagcaaattgtcatagaaatgtgaagaatgatatatattaatctatcatatcattttttttagaaaaaaagttatatttatttggatgacatataagagacgaatggacatgtctcaatggaaaaaaaatatttttcccagaaatatgaggagtagaatactcctcatatttttataggtaagcacatgcatcagtttaattccaaatataagcacaccaaacccatatttcaatctgtaggcaagatgctcaaggtaggcgttgttccatcgaatataatatccaacaaaataataggccgttgaatttagttttgtaataatgtttgacatatttattaagtataatttgaatatagcatgatgctaatatacctaaacaattgctactagtttacaattaagtgagtttacatcaccgggtttaaatgatctatttattttgttaggtattagatatatcgagggattgacgtggtccagtacacgtacatgtttaggaatggaattacgaatatgatgtgctcatatacgtaatcaaagggttggatgcgttgcgactaaaacaaaatcgggaatactccatccaggagtatatatatttcagtacgtaccaggatctcggcgaccaccctaggctggcgcaggggcttaagcgcgagcgcgaggccctgcgtgatcaccaggatgacggccacctgcagcgccagcagcggcagcgcgaagtccagcgggttctccccctgccacatcccgtccgacgccatcttcacggtgaccgccgccgccgccatgctagctctacctatagctcgtacacttgatgagggcgtgcgtgctggcttgaggttgagggcgtacgctgtggtttgatacaaacgtaacgctgctgtactgcgaatttataggcgaggagaaatggatgcggtgatatgatatgatgcgacctggccggctagctatagctcgtgcaccggatgagccatcgatgagtataacgttagtggttgctactagtagctcgatcgatcgatcggtgcgtttctccatcattgtgggagggggctttgctagatttggacggacatgtgggtgttgttgggatcgatcgatcgaactctcgtatagtattgcgctgcctaccgcccctgtactacgtgtggctagagattaatccaattaatgggatgcacagcacggttaaagtcaacgaatgatcgagtgatcggacacatgtgtgaatatattggaaaggaataacaagtagccctgcatgcatgcatgtggcttcgatctcaccacagcccctagtaaatatcattacgatcgatcgtggtcataactgtataagagaaatgggccgggatttgttaagaaatagtaaatcaatgttgcttccttaatttgttctaaaatacaagcatttttatgtgttcctcaaaatgtatcgatcgatggacgacgatcgcctgcacggagatcagactccagttagcctctccttccttgagatcgtggcaccttccttagctgcctgaccaaactatggcgactcgggcatggtgtctcaaacgatggtgggggtgtatagcggctcatggtgtcgtggcggcgaggagctggtggcccggctgattcggagctcaagcatatatggaggcttgctagctgctgaatgtttgtgttgttttttaatttttgatttggcaggtaagtccgtgttcatcgctgtttgtgttcgtcttgttcatgttgtattgatgttttgtgatgagtttctagttcttatatgtgatgaggttatcttgtgttagagacttcgactcttcaagcaaagttgagtgtagatcattttattgatgcttgcattgcctcggttaattggatctgaatttctttcttttttttcagaaaaatgcatcgacatctgtaacggctcaagacaagcagccgttacagatgaaactcgtctataacagggcctccaaccgttacagatgattggtcacatctgtgactaattctttgtaacgactgaccaagcttacatgcagatggcaatcttgagtcgttacggatagacaaatctatactattttaaatgattaatgtctgcatacgatttgaataaatctttaaaattctgggcattaattctgtattagaataaattagtgatccaataaatttacaatattatgatagtatttttcaagaaattgtgtgcacaaaactgattatatatattgtgcagaaaatcaggataacttcagctattatatatgctgttgttcatgcagttttcaacatatgaacaaagtcagaaattagaatgccgcagaatccctgcacccccactaacccaggcagggttagtgagtgtccagtggccaccttagtaatgtatctatcaaaagctagctagcaagatcaccaaagcattgcatcacgcatgcaactatctcagaagcgtatatgtatgtactccgggcctcaaactttccagaaccctaatcctgatacgatctcgagtccatggctgatacacaagtcaatcacaagacgttactccctccgttttaaattacaagatgttttgatttttgtcaaagttaaactaatttaagtttgaccatgtttataaaaaaatagtaatatttttgatcgaaaataaatttattcaaaaaatatatttaattattaatttaataaaactaatattaatgtaaatattcctatatttatctataaacttagttaaacttaaagcttaaagcagtttgactttgaccaaagtcaaaatatcttgtaacctgaaatagagggagtaattattaataaccccctctcaaattgtatgtgtgcgtgcatgcatcaatcaaatccccttttcggccgtcggttaatcactatgccgaaaaaaggcatggcagcagagcactgaatttatcgtgccgtcgacaggagcaattgtgagagaaagatgatgcactggttggagcttcttgattggcccagccaccgtagtgcgcttagcctatatctctccctgatcacacaattagggttttagggtttagtttaattaatcagtgagtggttggccggagctctgattaaaattatttatcgcaagaatctgcatgcatcaaggtaataataaacagagaaaagatgaagaaagtttgtgctcctgatgctggggtttgatgttgggagtggcctctagtggtctgatatgtcattgcttgattggcgttagttcgccacatcagtccgacctgtcaatgaaccaatggagatcagcaagcaagtgtcagagacacagaatgccaattactacctccatattttaatgtatgacgccgttgactttttatctaacatttggccattcgtcttattcaaaaaatttatgtaattatcatttattttattatgacttgattcgtcatcaaatgttctttaagtatgacataaatattttcatatttgcacaaaaattttgaataaaacgaatggtcaaacgttggtcgaaaagtcaacggcgtcatacattaaaatacggagggagtaacatcatgtctctttaaactagaactactagctattaagaagcgtgattaagctgaacagagagtgaaagcgggacatatcgatcaatcgaaactactgatgatcaaataagaaagaagacaattatatcaaattttgatcttacacagttaattacacaccgttatcaaaattattacacacagttacgttacacagtgatgttgtgagagggctttggtggtctgacctgtcattgcttgattggctggttgcatcgtgttcggccaccacatcaacccgacttatcaacgaaccactggtcgaggtcagcaaatttgtgccagcagtgccagagatagaatagtagtttcgttctttcccttgaagaattatacttatctcttttttaattgacgacgcgttaaccatttattttagtaaagaaaatgcaattatcatttgcttggttatgacttggtttatcatttatgatattttaaacctgacttatatttctatatttgcacaaaattttatctctactacttaaaaataagagatgcttctatcgtccgtaaaaaaaaaccaggcgagcgagaaaaaaaccgggcgaaaaaaataatccgattcttccctgaaaaagaagggcgaataaaaaaccggtgaaaaaaccagacgagtgagaaaaaaaccgtaacggttcgataaaaaaaagggacgaaaaaaaaatccgattccgtgccaaaaaagggcaaaaaaaaatctccatgaaaaagaagggcgaaaaaaaaatccgattccatgcaaagaaaaaaaaggccaaaaaaaatctctacttctctatctctacttaatgtttccttcgtcaaaacaaaaaaatagcgaaaaaaataaaaaaaagtctgattccctcttagaaacaaaaaaaaaagttcgactatagatctgattcccccggaaaataaaaggcgccactccttccgagataatagccaccactcctctcggtttcaaatatatactgtgatatctctcacatcttggtgaaacaaaataatgtgccagattgaagatctgtttacaaaaacggaacctactggtcgagagcattccatttttatagtattttaatttttaggtttgtacttttgcatttgagtccctgtaatttttatatttacatttgagtccctataatcttacaataaggtacttgaggtcgtttttgttaaaataataataaaagagagagaaaaaaccgaaaggtgcataaaaataaaaacaacaacaacaaaagttctgtttctcctaagtcatgtattggaaaaaagcaaaaaaaagaacattcaaagaaaaaacaagcaaaaaacacgcgagaaaataattgtaaaagaaggcaaaaaacacacgagaaaagaaaagcaaaaaaagggagaaaaatatggttttcgttgtaaataaaaaagcaaaaaaaatgctaaaaaaacttttagaaagaaatgcgccatttctgaatggtttgagaaaatcgtgcaagaaaaaaagaccgtttataaaaaaaaacaagccgctcattaaaatacaaacattgtcattgacatgattattcatgaaaaacgtttattatcattagaattttttcacccgttgcaacgcacaggcatttttgctagttaagaaaagatataaccaaaaatcaaattgtgtcatctttttttttaaaaaaaaaggatggagtacaagctagtaggaaatgctctgattaagctgaacagagtgtgagatatgtcgataccgaaactactgatcaaacaaaacaaaagagtttgctccgttcggtagtggaagaaagaaagaaagtaagtttgtttcgttttccgcgggtacgtttcccgaactattaaatggtgtgtgttttgtaaaaaaaaattccgcgggtacgtttcccgaactattaaatggtgtgtgttttgtaaaaaaaaaactataggaaagttgctttaaaaaatcatatgaatccatttttaaaatttacaatagttaatactaaattaatcatacactaatgacctacctcatttgacgtatcttctcaatcttccaatcttctcttctcgcaaacagagctgccctggtgagtagtatttccctggcctgcagccatccggagcagcaagtagcagtgtttggttgcttccctgaagaaggttgtccatgctcaggcatggttgccggagtcacgccaccaaaaatgaacgcctgatccaggcgtgggcgtgtgcctgatcatcccccattgattcttaacggatgtgactactactacacttgtaaacatctcactcaaacaagcatgtttttttttatggccgtgtttagtttcccccctatttccaactttccatcacatcatatcacatcaaaaaaacttttatacacatataaatttttagttttttttccaaactcccaactttattcaaactttcaacttttttttaggactaaacacaacctatgttcaatatattcagccaggctcatgtcttcaaccaaacaacagaacatcatatatgcctgctaggcatgattcaacacgagcttttctaccacagtacaggcatagatttttctcaggcaagtcatccagatcaccaaccaaacatgcccttgctaattgtgagtgcgagcgttgcagacttgcagttcgatatatttatttatgtttcaatttgggacgtttcctgtatataggactgtaaacagtttttttttttcttttgcaatattgcatcgatttgcaccatgactaaaaaagaagtttgaacatttttttttttggcggggggtgggggggtgggtgtaatgtaaacttttgaaaagtcggcaaatataccagaacgcacaaaacttacaaaaatagagttggtataaaagcgtaggcaattaagattattatgaaatgcatgacttacaaaattccgactgaagttgttcactgtaaaatttgtgatacagaaaaaatgacggaagcatgtttgtgatcattacaaattcattttattcgcgaacgcgtaaaagaattgcattagtatattactctctccgtcccaaaatataaggagttttggttggatgtggcacatcctatctgtctgtttagattcacaaacagacataatactatgatatgtttcatacaaccaaaactcttatatattttaggacggatagagtagaagaaatagagtttttgttacacaacgcaatggactagattggtcgttgccagtgataggacactgctattgtgtggtttagttgtggaacactgcccaaactcactttgggggaaaacactccataaacatggtaatttgccaatggacaccgtgccgattaaaataatgatttccggttgaggaggagagatatcgcgtgaaatgtcaaaaatgcccttgggcccacatgtcagctctctatctctcttcctatctttcttttctttctctcttctcctggtcgcggcttgttcggtgacagcggcgacgcacagagcgcgcgcggcctactcggcaccggacctcctcctccacacctgatggcgtactttgccaccgccgtcgccggagttctcgacgacgctgacgttcttcctcttcctcgtcagcctcgagctcgacccggccttactctgctgcaccgccctcgcagtcgccgccgccggaatcttgctcccaacgtcgcatcccagatgccaagaatcgggcgccgacgccgttccgcctctgcaccgccccgcaccacgtcgcgcgttgccgccctttgccgttacaccacccccacggtaaaaccctcgtgccccgagcctcacctagtgacctagaagccggcggccccctcgatttggggcgggcgccgccgtagccatgccggcccggtcgcccttatgccaccaatgagcttcctgtgggcaaacgtagtcccaatgcaacataggttatattatcgtgaaattgacatccctatgaaacctagatcgtgtagaagtagccggttgtgcccaaatttatcgacattgcgccgccgccgtgcttgtgtgctcggtgccgccgcttgccgtcgcgtcgtgcgccgggtggccgctgcgcctcgtcgtcgttggcggtgggtcctcggcggtgagccatcgcttccccgtcagcgcgccatgccgtcctggcttgggctgtcgcgctgaccatgcattgcgctgttactcacccgcgacgagaggaggaagaagggagaaacaaaagaaagagaggaagagagatggagagctgacatgtgggcccaagggcatttttgacatatcacgtgatttctctctcctcctcaaccggaaattattattttaatcggcgcggtgtctattaacaattatcatgtttatagagtgttttctactaaaagtgagtttggacagtgtcccacgactaaaaccacataatagcagtgtcttgtagcaaaatttgtctagaaaaaggatttcgaataaaaaaaagataaaactaagaactaaaagttgtttctcttaagaaaatgatttcgaataaaataaaggttaaaactaagaactaaaagttgtttctcctatctagcaggaggggtggtggcagaggagcctcctaatgttccaataggtccccaaatgatacggcacgagcgagataatttggttgatgaaagagcccaagcgcagattagagcttgaaagtcgaaaaaactcatcatacctatacagatctgaagtagtagcccacatcgttttttttttccctgggacttttccatttgacttgaattattgatggtcgtcattgctatgcaaattttctctagtaattcatactttattttgtatcatcgttgaatacaagagcacgtgtagcctcaaatagtcacaagatgtcttcatcgaagaaaattgatggttccggttaaatgaatgcaacaaaacagtaggagtattcttgttggcaaattgcacggaatttggatggaattataaaaagcattaattcctcccgtatgaattcgccaatctgaatttccgggaaaattgagaaaccatggagaccgcgcatctagcctacgtgctcctcttcctcgtcaccgccgtcctcctcttccatctccggcgaggcggccggtcagctccggcgaagctcacgacggcgcaccgcccgcacccgaaccccgtcctgggcaacaccgtcgagttcatccgcaaccggcgccgcttcttcgactggtacaccgacctgctgcgcgcgtcgccgtcgggcgccatcgaggcgtggggcccgttcggcgccggccacgcggtgaccacggcgtgcccggccgccgtcgaacacctcctgcgcggcaacttcggcaactatgtcaggggggcgagcttccgcgccgcgatgtccgagctcatcggcgacggcctcttcgccgccgacgggcgcctctggagcgtccagaggaaagtggcgtcctacgccttctcctcccgcgcgctccgccgcttctccgacgacgtcctcgccgtgcacctccgcggagggctcctcccgttcctggacgccgccgcggcgtccggggaggccgtcgacctgcaggacgcgctccgccggttcgccttcgacagcatctgccacgtcgcgttcggcgtcgagagctcgacgctgctcgagacggcgagggaggactccggccgccacgaggccctcttcgcggcgttcgacgccgccgtcgagatctccttccggagggcgctggcgccgttcaccctcgtgcggaagctcacgggcctcgtcaacgtcggcagctcgcgccggctccgcgaagccatcggtgtcatcgacgactacgccatgtccgtcgtcgaatccaaggaggcggcgtgtcgcgatcgcgatagcgaggacgtggacccggacctgctgtcgcggttcatggcggccatggacgaggaggacggcggcgagctgggcgccatgttccccacgccggaggggaagcgccggctcctgcgcgacgtggtcgtgagcttcgtgctggccggcaaggacacgacgtcgtccgccctgacgtggctcttctggctcctcgccgcgaacccgcggtgcgagaggcgcgtccgcgacgaggtgtcgcggtcgcccgacggcgacggcggcggcgacgcgaaggggatgcacacgcactacctccacgctgcgatcacggaggcgatgcggctgtacccgccggtgccgttcaacgggagggtggcggtcggcgacgacgtgctcccgggcggcgcggcggtgcgcgccgggtggttcgccaactactccgcgtacgcgatggggcggatggagaggctgtggggcgagggctgcctcgagttctcgccggagcgatggctccgcgacggcggcgagttcgtggccgtggacgcggcgcggtacccggtgttccacgccgggccgagggcgtgcctcgggaaggagatggcgtacgtgcagatgaagacggtggcggcagccgtgctgcggaggttcagcgtcgaggtggcggcgccggctccggccatggaatcgccgccggcgtacgagatgacggcgacgatgaagatgaagggcgggctgtgggtgcggctaaggaagcgggaatagtcagtgtgagtgatttgatgccacttgttgttcttgtttgactaagtgaactcttgcatcaggtgttgacgggaaaccgttttaaacactcgttggacattcacccgtttcttacatgtcatctaaataattatggaaaatttttaaaaaaattgacatgataggttaatatgtaatatattacttcacaaatatacaagttcaaattcgtcttctatgaattgtaacaaaaataacaattttgactgtgaatatacgtatactaattagagtttaatttcttatttttgttacaacttgtagaagtcgaatttgaacttccatgtttgtgaagtgatatattacatattaacctatcttgtcaatttttttgaatttttttcataattatttaggtggcatgcaagaaacgggttgacgttcacccgagatattagaatccatcctaggtgttgaccacaattgccgtaggcccgttggagtagcacgccaagagagtggctataaaagtcaatattttctgtggaatttggggatctggttgacgatgatatgtagaaagatatcaatattgaacgtgctatttatttgtagaaaaaaaacatactggatgttatctttacctttatttattataaaaatttaaggtgtttttgcatttgaatttcatacgtcacatcaatcctagcgctcgatttttttgttgtccgtagtcacgtggcacgttttactggctgcccgcatccgattgcaattccctctttccacgccgcgcaccgcgtccaggccgtgcgccagccctggcgcatgcatgcatatgccctcccagatcacgtgaaacaaaactgtttctgatttctccattcacacacaactttaatttttatagcacctacctcattcttatgttcctatacaatttcaatttttaaggcacgtaccctaaacaccagaaaaaaattgaataagataaaaatctttatctttacctttatccatatatatatctatactatagccatctctactacttaaaaaattgaaaacgtttctgtcatccgtaataacgaaaaaaggacgaaaaaaacatgaaaacaaaaaaaaggaaagtcaaattcaatttataaaaaaacgtaaagaaggggaaaaaaaagaagtccgattcatcggcttggtccgttgccgcatcacacgcatcccctctccaaatcccaaaccatcaccatccaacccaaaaacaaaatcccaatccaaataggaatcatcacaaaatcatccaaaatagatcacaggacaggagataatcaaatcggatcacaaataaatcacacaggagaggaaagggcaagcgagaggccgtcgctgctcctcgccgcctcgttgccgggatccaccaacctgccactgcgccgggaatacgttgcgccgccaacccgcagccgcgcagccacgccgtcgttgcgccgagaagtcgctgacccatcgctgcgctgggcagatgttgagagggagagagaggagccagatcccaagccgctgcgccaccaacccgccggatatggcgacgagcgggacagcggcgacaccccgacgaggaggaaaggggccaccgcccaccggtggggaagggacagcgccggtagggggagagggatggggagctgcgatgctggtggggagaggggagagggaacagtgtcgccggtgagaataaaaggcagtggtgctgccatgggagaggaagtggcgccgccgtggggagagggaagggaactagggttagggatttcgggtacgatccgagccgtccatcaaaatgaacggttcagatcgatcccgacttgggccggcgacattcccaggccgccctgtggctgggccacctcatgggccgcaagttcgtgggccaggcaaaaattattttatttctctgtattttaagtattttctatttttaggaataatattagtaccattttaattgtttaaaattgctaaaaaatcatgaaatttcttttctttcttttttctagaactttgtttctttaggaatatattttcttaaagggctcatatcataaaaaataaaccctaatcagccaatatttttatatttttgtataattatagtttacctgttgcaacgtacgggtatttttctagtaatataaaaaataaaagaaaaataccggggtagatttcaagtgacggatctcttcaaatctaagtcacgagccagtgggagactaggagagacaagaagagaggagaaaaggagggaagtgtaagatatatcgactggggatatccgtaaaccgaatgataagggtattgtggtacgtttgtacggggatcaacacgattcaacatcaagcaaacaaggagacaaggataatactggttcaggtccatcgtaaggtaatagctctaatctaaggccttgtttagatccgaaaaatttttggccaaaaatgccacattaaatgtttggacacacatgcatggggcattaaatgtggaaaataaaaccaattgcacagtttgcatgtaaattgcgatatgaatcttttgagcctaattacgccatgatttgacaatgtgatgctacagtaaacatttgctaatgacagattagttaggcttattcaattcgtctcgtagtttacatgcgcaatctgtaatttgttttgttgttagtctacgtttaatacatcaaatgtgcgtccgcatacttcaaaaactttacacccaatgaactaaacacaccctaatttatataagactgatatagaaaaccatagagtacaatagagaacaactagaagagggtgatgggcaggattggcagagagaacaggggcgataggggtgtcagagggatgcaagtgggtcgatttgcgaacccacttatttggcctataagtaggtttgcggatcgatccacttacatccctagttgtctcagcgatgtgaaccacatgaaaagggggaaatagacatggcggaggctttctggtgctagtgagagaaaagtgagaccaggggcagcggtggtgctggtgaggatgtgagagtgaggagtggcgagaggatagaggggttttagcaagcaaggataggaggtgacggtgtggggatatggaatgttgcagtggtgagttgttcgatctagtttatacatcttggagtcacgggagagggagaagataaggtttcctctgatgcgtgaatctcaatgcaatttgagtcatctaaaagtgatagagatttgtaggtatttttcatattactaaaacgcgatgccgcgccacccccaccccctcccccctcctcccggcggagggggtcgcgcggtgagcgcatgcgtaggggtggggcctttatttttgtggttttccattcggttttttcctttccggtttttttctttttggttttttagcatatacatatacgtatacaaaatttgtatacgtgtatacaaactttgtatacgagtatgcaaactttatatacgtcgtacataaagttggtatacttgtatacgaatatatgtgatgtttttttttggttttttgattttttaatatgtacgtatacaaagtttgtacacgttgtatataaagtttgtatacatcatatataaagtttatacacgtcgtatatacaaagtttgtacacatcgtatacaaagtttgtatgtgtgtatttttttatacatcaaaaaaatatacatataaaaatatatatatttatagtagtaatactagtagtagtatagcagtagtagtaatattaatagtagtagtgtagtaatactagtagactagaactgtagtactagtcggcggtcgggcgtctgaggggccgcgcgactagtcgtgcattagcccccccccccctcccccccccccgcctcgttagttgcaatatgtaattaaactctcccttctaatatattgataatatattgatgtgtaattattttgtgcgctaaactgccaatcaactcaccagcgggcagtgctgcacttcggcccgatttggagttagcttacgggttacggcccactcgagggaagtacaaggcctctaagcggcccagccgttcggccacccgccttcccctccagcctaacgcgcgggagacagcgagcgttgaaggcaaccgcagtacggtcccgtccagtgtgccccaacgcgtggccgtgctgggtcggatcatcatgatcacgtggtcatggtgtgtgtgttggatttagatcaggtgtcgttatagctgttactaaaacttaagaattacatgcaatttgattcgtccatttcgcaacactacaataaccgtataaacaatagccgtataaacagtactctactctaaagtgcttttgctaccgtataatgaacagtgcgactcactagtctggaccgttccatctgtatctgtgaatgagaaccggtgctgcctaaattgcagtgacaaaagtgactacacctgatccagattcgtgtgtagtggtgcgtgtctgtatggtttggtcccatatgttgcaatccacctatcagagcaacagcgtggtcaaggaccatgacaccatgtaccgatcaatagatcaccatctccaaaatcaaattcggtagccacaccatttagatcgccaaatctaaggacgaaacggtcgaaaaaaccttgtaccatttccatttttatattttttttcttgaaaacgaaatcggaacgataaaaccgaaaacgataacaatatcggtatattagaaacgggatcatcggaacggaatatatcgatattggttggaagtcaaaaattcatgtcggaattagcggagtgtggcatagcacacatttaactatgcacaaagatgacttttaagtttattcttgcatcatcacactccacataataccattatataataataagtttgacatataatat

SEQ ID NO: 68309 - DNA, 18511 bp, Oryza sativa
aatgaaatcgatcctcttttttttttcaagaaaaattaaatcgaccttattccataccaacagctctgctgcgaaatgctaagtttacaagtctcgatccacgcatgcaacaaaaacacaacaacaacaacagcagcagcaacaacgtacacgatggcgacgcactgacaaggcgaggcgacagatcggaggagcaatggctgatcggccgggtcacttgccgccggcgacgagcgagaggagcgcgtctctgtagtagccgtgcgccttcccggcgacggcgtcctccagcctcccgccgaactgctcgtggtaggccgcgcggatggcgtccatgtccacgtccgcccgcgtcaccgccacccgcgtcagcgcctccttcgcgtggtggtcggcgccgtcgctcaccgccgccgccaccacctcgctgaagtacctcgccggcgtcgccaggcacagcgccgcctccctcagtgtctcctcgtgcccaagatcctaacaaaaaatccaataagatcgatagatcgatcgattagttcgtcgtggtttgattgattggttacctcttcgatgtggcggccatggatttccttgtagtgcttgaaggtctcgacgaggtgcggcttgctccgggtggtgaggatcctgacgacgtcgtcgttctccaccagcttcgccgccgcgtggccggcgctcttcaccgcggcgacgagcgccttcgcctccgcgcgcgccgtctcctcgctcaccctcgggccctcgtaccggtacgcgctcaccagcccgaccagcagctgcatccacgcgcgacacgggacacagagaaagatcaacgggagaggtcgacgcgacgacgacgacgtgcactcaaggtgtttgttgaattgcttacgccgcagtagggcttgtccctggcgcggtaggcgacgtcctcctcgagggagtggtggaacagcgcctggtacgccttgcgagcgccgaggagctcctccgccgtccgggtgcaagcgatctccacgacgatggccgccgggtgcgcctggtggagcacgtggtgcgccagccgcggtcgcgctcccaaaggtgcatcgcccacatcaccatcaggttctgaacagtgaacaaacacaaccacaataacccaatcagctccatctccattgacaagcttcgtcaagaattcaagattcaaagagaagagctaaatcgcttgccttgaaccgcgagaactcggcggcgaggtggagcatgtactcctcctcgcacttctcgatgacgccgccatgatccttgaagaagccattgaagctcttcctgaacccggacagcttctccggctgcctgcgccacttggccagcgccgacaccatcgccggctcgtccacgccgaggccaccgagcccttcattgatcaatcgatcgatccacaaaatccataagcatttgcaagacaaaacaatatgaaacagcagcataaatgcacacacgaatgtgtccaagaattgaatggttgtaagtttactaacctgagaaggccctggtcagatgctggatttcatcagccatggccgattggatgatctctgaatgcaagcaacaaagatgggaagagaagatgagtagtgagtgaggattggctactggcttagctgattgctgtgagctgtaagcttgctctctccttcctgtggatgatcgatctttataccaaagaagtttgtgtctgggaagccaattatgggcaatggtggtatttcaataaccaggaaatgttcatcagtagtctacacatgtgcagacatgtacgtatggatcaatctaatttagttccctgttgaaatggaaaggaggataaaagaaaataaacgagttgccagcacatgatgctgagttagccccgggggttggggtggggtgtgttcaattgaagtgattggttgattggtgaattggagtcgtggaacacggggtaatctgagaattaagattatgtctgcaataatttgaataggggcaggtctgatggcctccttacctggatgcagtcccatcatgctgaattcctagagagaagatgagaaaacttgttgcatatacacctgcattttcaggtctggactgtaaggtagttgtgatggacatgattcaatcagagatagtaaaatgtttgctgttctttcttgaattttgttatctgtcaggcaaaatcatagtaaacctactctcagcactgcaattcttattcaagggaaaatataatgcaattgaataactgtagggcagcatgcaatgaagtgttataccgaaattgaattatctaacatttgcagcaatgtgagtactaactatttttttataatggaaatcattcagcttctgtgtactaattgctaattagtagcaagatccacaagacacgctgtcatccttatcaacggcatcagaattgcccatacctttgatcaaatcatggttggtttatgtcccattcgattgtttttcgatagtctttgctcaatttaagtttgtcaatgtcttgcaattgctacgatgacagagggactgttttctgaaaaataagctgacagcaggaagcgcaacttctacttgaagtgtttattgtaaggtcaataaccagctaccagacatccactacatcaatacattgtagcttgatgtatttggcttgttggtataaaataaatagtagtttcataattgggtccaatatattgccattgtcaattggggagaggcacagaagaaaaaagaatccaacgggtattttgggactttttgacataattttcttttaacataatattttggaactttcagagatgatcagttttagttaagcaatggtgtcttggcatgagtaacatgctcactggaacgtatatatacttgacaaaaatctgtattctctaagacagaacgcataagtggccatatcaccatcgtctttaagaaacatgtgaaacaagaaggttcctagatttaccacaatgttctggcaagaaatggataagaacatgctggcaattttgaaacatgaaaatcatgatgtgccagggatataaatatcctatcatttgaaacctactggggcaattgtcaccttcaaaaatgtggaccaagctaattaattgtcctttgatgttgggtcaccctctgcaatcatgcagggaaggatgaaaaattggcacatggtaggaaaaagacaagctgattactgagaactgcacaagcggatcacctttaatattgcagttgaaatctgatcgagttgttggcatttggcaacttggcatgtttgcaccagaaaaaaagggcatctgccacatagaaatcccatgagtttcacatatgaactgcagtatttggccgttcatcttttcttaaatgttttgttatgcgttggcaaccaaattatattcgattcagtataaaacctttaatcagatcagcgtgatccgcaaggagacttgtttttttagtttcctgagcatgaagtctactatcagctccaacattgccaactgtacctttcacactttatttttgcacagttgtatgaaagtaatgggagaaaagacattcttttaataaaataaatatttcacaatgtttcagttccaattggaaggaattttaaaaggtaagaaaaaatgataaaatcagctctgtgcgtttcacatgcatggaaagctaaaaaaaaagagagaaatacagaaacgtggttttaaacgagtcaggccctttgaattttaatcttagagaccataatgcttcttcttttgtatgatgggcttaacatgtgcaaattcttatatgttgtggatacaacgtaagtttcctgagtactgcccccctctacttttggatagtataatcgatatgcaaaagataaccttaagagctaagcattgaatcatatttgaaaagcattgaattatggataataatatatttcaaaaaattagaaataatacatgtttggtcccttgtgatcactaaataacaatttcagttagctatgtccataatatgagcaaacaaatcaattcacttgtacatgtaagagtttaataaagaaaatataaatcaatccaatgacagcgcctgaagtcaagtgaaaaagggtttggttcctaaaccaggttggaaggtcgacccccaccctggcgcgttgttttcaaattatttcttttccatatttttttcaacaaagttttgcaactaaaatggttggtttacaacgtgtcgcggatgatataaaaattatatattgcaactaagtggttagccatatatatttttttctatgaagttatgcaactatgtgattcgactacaatgtgtcagttatagataattatttctttttcatattttgcaactaagtggttggtctacaatgtatgcagatgatatgaacaagttgatgatgaatcctcctcctaattaagtaaaccacgtgaatatataaaaaggtaacaaatgcatattggttactacttactagtagttttttaaaactaaaccggcaggagaactgccaattatatttcattaaataggagtaaaaactcagatgggctacagaaaaagaaaaaacaacctctcggcgagtagagactcgccaagcctttccaccgtggccagtacaaccacacagcacacggagctccacatcactctagccaaactatcaacgaaatgatggcggaatccaacgatgaacatcgatgtcgagatgctgaagaggcggcacacagcgttgacatcacaaggcacgtgtcatcgttgccgagctagccgcccagcgacccagtagctccgactccatggcaatcatggcatcattgtaggcatcgccaaaccgagcaaagcaacaccaagctcatactttggacatcagccaagcccctgaagcgccaaagcctgtactagcaacacccacatccctagagagaaactgcaaatgttatcgttgccaagcttcgtcgcaccccaacgacgtagcagctccgactccacccgacagagacaaacgaagaagctggatgctaccaatacaagaaaggaaccaagaaggagaaggcctcgccaagcacctaggcatctagcgcatcgagctgacacaggagtccagcagcggcaaatggtgcatgggtaaggttctccaagatgatgcccccaaggaggatacaacgtgaaacgccgccatcgcccgtccggaaaccggatcacagtttttacctggagactggtagcggtggagaaaacgctataacgacgcctccaagaagggaatgacgccaaaggcgccaccgtcgtcgtgccagccaaaggctaagcaaggctttcgccaacgatttcgtccagcgccacctacccacacaacaaccgttgctgaaccaccacatcatctcatcagccaccagttagcccagttcaccaccccacggctcaggtaggctcacggcctgctcccgcacatcgccatggcaccgtcgtcctctgcacaaaccgccacgtcccctctcccgaagctccccacggccaggacaggatctagccataggaggggaggagctccacgaggtgggttttttaagccgcccgggaagaagagacgtcgccgccgccaactgcttccccgtgcacataggccagagaagcagcagttgatgcatgtccgtgagccgctgccgcctcctccgcgcggccctcgcgccgcggccgccgcctccgccgccgacctgcgcgtccagcccagatctagccaagggagggccggatccgaactcgacggctccggatctggccgtcctcgccaagctgcgcctctcgtgctccggtctcatcggcgccccaaccgcttgactaggagtgaggggaaagggagagacccgccgccgccgtctttgcagccgcccggctttgccggcggctgctcaggcggtggcgaggtgggggagaggagggagagggagggggtgacgatggggtttcgccgcccgcgtcacccctgaggcggagcgaccgggcgtcgagccgagttatatattacagtttaggaacaaaagccttcaaagatatgtttaggaagcacttaacacaataattatttgcatttttagaagagacatgacaataaaaccaaactgaccaaggaaccaaccgggcaaccattacacaaaaacaaaaaaatgtcccagcttgtctgagctgtccatgattgcaaacggtattcaatcaatcactatcacttacatacacaatcaaacacttcaccaagatcataaaaatgagtaaggaaaaaaaacatcatggaaaaataccatgaaatacaaatggaaaaaatagggtagagcccagagcattggatgtgcagattaaagctatactactagcattcaagtttttttcaactctgctgcgtaggaggcgtgtgtgtgccatgtgttgctggtgctgctgcctggactgcatccataacatacctccactcaatctcctcttcctccatttctccccccattctctctcctcctcagctgcttctgcaggtggaggagaagcagcagcagcagcagctgttgctcccatggcttccatctctgtcccaaacccagctccttcccctacagaggatgcagagagcataagaaaggcagtgcaaggtacaaatggactcttcaatctctttgtacatcatgaacatttaggatttgaatttgtttcacaatgtaaacttaaagagcactgaattctgaacactgttctttgccaaaccctgttgcttttcatgtcattgttattgttttcatctgaagtgtttgcgagtaattagttgctactactccagttcatgtggaagagacgagaaattttgtttgttcaagttggtcatggattagctaaacatgttctacatagctctgaaagactgaaacaactgatgatttcgaaatcaaatatttgaattttcttttcttttttttggttgaactgaatcaaaggatggggaacggacgagaatgcgctgatcgagatcctcggccaccggacggcggcgcagcgggcggagatcgccgtcgcctacgagggcctctacgacgagaccctcctcgacaggctccactccgagctctccggcgacttccgtgtaattagccctcaccctggcgacctcgccggcgggcggcggcgccattgatggactcgagttcttgattgatctccctctctctctctcttgccgtgcagagcgcgttgatgctgtggacgatggacccggcggcgcgggacgccaagctggccaacgaggccctgaagaagaagaagaagggcgagctccgccacatctgggtgctcgtcgaggtcgcctgcgcgtcgtcgccggaccacctcgtcgccgtcaggaaggcctaccgcgccgcctacgcctcgtcgctggaggaggacgtggcgtcgtgctcgctgttcggggacccgctcaggcggttcctggtgcgcctcgtgagctcctaccggtacggcggcggtggcgtcgacggcgagctggcgatcgccgaggcggcggagctgcacgacgcggtggtgggcagggggcaggcgctgcacggcgacgacgtcgtccgcatcgtcggcacgaggagcaaggcgcagctcgcggtgacgctggagcggtacaggcaggagcacggcaagggcatcgacgaggtcctcgacggccgccgcggcgaccagctcgcggcggtgctcaaggccgcgctctggtgcctcacctcgccggagaagcatttcgctgaggtaaattaaaatcgaacgtcctcgataacttaaaaacttgcttcttcataaccatcttaaaaaatactttctagcaaatccgtttttccaattggcactgaacgtttaataatttatcactgaattcacatatcatgagaacagactataagtgataaatattaatcatattttaaaagtgacaaattgttaaatgtcccgtaattcaaaacgcgccttaatactacagaacatattggagcaaagtttagccgagtttagttccaaactttttcttcaaactttcaacttttccgtcacatcaaaacttttctacacacacaaattttcaacttttctgtcacatcgttacaatttcaatcaaacttctaattttagcgtaaactaaaaacaccctttgactcaattgtcttttcgcgtcttctttaggcgaacattggagtaaagtttcactcaatattttttttttctcgtcttcttcttcaggtgatccggacatcgattctagggcttggcaccgacgaggagatgctgacgagagggatcgtgtcgcgggcggaggtggacatggagaaggtgaaggaggagtacaaggtcaggtacaacaccacggtcaccgccgacgtccgcggcgacacgtcggggtactacatgaacacgcttctcaccctcgtcggccctgagaagtagccatgtagcagcttggacattttattgcttgctcatttgatttgaacaaaatacaccgtgtgatgttgcagttattagtaaaatgcgagtaggatcgatgttgttttcgttgggtggattaataatggagcatgttttatcgcaccgtggtgtatccaacacttgttttcagacgatactatcgatgtttgatcagaatcaagccagaggtgcttgaaactagtgacaataaaaccaaagaaaaggaaaggtacatgttgcatccggagtaccatggtcatcaatttgttttatgcacattactgtggcgattctcgactggaataccacgaattgaaaaaagaacaaacaagccaaacatctacttggttactacatcagcaagcagatatcatctcacttcttccttgcagcaatagctgcaatcccaccaaccagaagtccaacagcagttgtggcgatgcctattccgatcagaccatctgcagataacgcatgcagatgtttagacagaattatcataaaataagttgttgtcccagtgaaaatgaggaaaaataaataaatgttcgatttgtgagacaatccatcacgtagctcaatacaaaaccaataatataggatataactggaacaaatttctcaatgtctcacctttggcaattttatcttctatagccttcctgagagacaaagcctgcctccaatcaggttgaatctgcaaggaaagtaagttatatagattaattcaggagataccaagccacaaaccaaaacatgttgaagcacaaggaaagcaagttacatataaaactcacgtttcagttggtatacagaacaagcacaatggttttacaaggatgctcacatgaaaatgttcttgcctactaagattaaaactttcaatcccatttgcattgtgaacataggtcaggcaagaaaacaatacaagcactaggaagaccaagtaaacattcccatgactacataatcatcaaaccaagcaaactcaagaaaacaatgctgagcaaatcaccacgatctgtcaacatatagcaaagcacagcacagcaagaaaaccaaaatcccgaaaaacatcttcagcggagttatgaagttgcaattatgataaagatgagcaatagcatattggagacaagcaattttataatttcagtttcagccaatgcccctaaatctctcaaaagatgcaaagaatagtaaattctgaaaggggctcgatgcattagcagctaaggcatccccaccaagcatgagctgaaaagcaatgagcttaaactcattaaccttgcttagctggaattgggttacaagtaaaagggtgaaattaacacatcatatcggagagcttattgatttgcataacagcattaaaactttgtgtcgactagtctggtgaggcaaatattttaaataacaatccagatcaacgaagataatttccgatgcctactcaattggaaaaaccagaaaccatacatagtgtagccaacatgtgtcaactttggctgtgaaaattcagtgaaaaaggatgacaagcttaaagtcaacctgacttccattgcatcatatggcacaaaaacagcactattacgctagcaatcgaacagacttgcacaaacaatttcaaagtttgttttgcagtcacctaagaccgaataattcaatgcaacactctatcctgttttgatagcacaaaaactaaatgacatgaaagttgcttccaggaaaaaaacaacaacattaaggaatatgaattataccaatgaatctacaagctaaaaatttgcacacatacctccaaacaacggtccacaagctgccgacttcttgggtagtcaccatttctgtagtgtccaaccgccagcagatatagcttctccctagtctgcagtgggctgttggattgacctaatgatgctgtgaaaacaaaacgaaattgatcaaaacagattaggctgcaaaaattatgtttagattatcgaaaacaaaacaagatatgagaccttcaagcatgcctattccacgatttacatcctcctggttcttggaatgcacgagggcccaagacagcctcataatgctatcactcttctgctcttcatttgcagcctcagctacctccctttcacagccctaataaagcatacaaccatagaaactctgagcgcgaacgtgtaagcctaaacattatttggaatgtatctagtaacaaacagggtaatgatttttttgtaaagtgagactgatatgtgcattttcttagccaatagttgcagtgatgattgaatcagagatagttccagtgttactcttcagattgtgaaccgctaaaaaggaatcaaaatcacacagctcaataaagagaagccgccttgactcatccgcgttgcaacaaacaatcacgcgagctaatcacgggcagccgacggcagcaccaccatgatggaacaaacaagccactgtaaatgggggcaggctgccatgccgcctaaactaagcatgaaaaccactccacactcgaccattcgctccccagtacaaccctccaatcctcggagttgctaatcctcaagcaccgcgcgggatctcccgctagaactaaaacctccccccattgaataaattaaattagaaattagagtactagaaaaaagctccccacagcaggggattcgaataggagcggagagaatggattctcacggcgatgatgtcgcgggtgcaccaggggatggtgtcgccgccggagaagaagctccccaccgactcgacgagcttcccgatcttggcctccatcggggagggggggtgggcaggggatcgggccgatctggaggaggagggagaggagagcaagcacggcggcggtggcggagggcgaggcgacggggccagcagcggcggatgcgaatccggtgggtgggaatggatttgggtgcaagtcttgagtcgcgtcgcgtgggttttgtattgtttgttcgattcgctgctgctgcttcttcttcttcggcgctaagaaagaaggggaggagaacttccggcgacttctgagttctgacttctcgccgtcgcacgtgggtcccgcgtttaagccactgtttaattcaacatagtcatattataatctgaattattagaactaagttgaaacaaatagatagtttattatgatggattattacaatctataagctatattactataatctggtaatccattaccactataaaggtgttttttaaatattatgggtgtagctatatttatagcgccatatttttcatcaaaaaatagtcggcatgtatttacattgtaagtccttaaattacatatgtaattttagtgtatttacaatgtaagtctcaaaattacatatgtaagtactaaaattacatatgtaaattcgaaaattacataccaattacatatgtaagtgtgtgtaaatgaggtgtaactactgtgtaagtggctgaaaaaaaatcgactgtaacatatggcgccatatttctagcaactccgaatattattgggtggctaacatttagtaacaaacaactaataattcagagtaacaaagaactatcagcttattttatatcagtttattataatataacttatagtagcctggcacagtaatcttaagttgaaacaaacatggtctaagttgattttaatttttcttaggaaaataagtgtactttactttttagcattagcttttaagatttatgtaggaattttataggattcaaatcctctcaagaattttaatttttcgtacgcggccatatgattcaaatgattgtagttttctaaatcctatgaaattcctatagaataacttagggcttattcggttcattagatttccaaattaaaagaataaaaaagtagggctgattcggtttgtaggattttcaaaacgtaggaatagtatagtaatgcatgtgcaaacctaaggattgaaaaacataggaaattttcctatggttgtgtagcaaacaatccaaaggattgaaaacattgggttggagtggattgttttttttcctttgttttcccttaaaaaagtagagggataggaatttttcatttggtgcattcctttgaaacgaatgacagtatagtacccattccaaaggacgaataagccctaaaaagattgggatgtcacatgcacttcatttcttagggatttttcgaagatgtctcacttcatgctaagaatcctatggaataaacttgcaagagcacaatccttaggaatttggtagtccattcctatgaaacgaatgatgcatataggaaaaaaaatcctaaggttttaattcctacaataatcctatgaaattcctctaaactgaatgagccctcattgaaggtagattttgaagaaaacttagcaagagcttcaacatcttggaaaatttcctctgattctatctctcctattcgattcctatatttttcctgcggtccaatcaaacggcaattcttatgctttttctatgttttgcattcctctattttaaacttgtattcctgtaaaaatcatgtgttttttatattcctctgttcttccaatcctacaattcaaatgggcccgaagttgttgagaatacacgtatatataagttttatcataaattatgttatatcactaataagtgttatgatgtataattaggtagaaaacagagtggtagtatttgttactccttctgtttcaaattgcggacattttgtgttttgaatagagacgttttaggttttgaatacattcgtgtatgaattaatgtattttctttatatatgaatctaaatttatatggatgttagtgaatctagataggccaaaacttagagcaagtttaatagtatagccaactgttggctccaaatcatctatagctaatctaatagcctattcatacaatagttaactataaaaatatactacaccattaataccttggtcccacctcttatgcacacataatgtcttggaatccgtgttgcagtcggctacaaatctatagtccactttcttctctcttctcttttcttctcgatatgtgattatagctggtttataacttgctattgaacctcttgtagtgtggaacagtgagagtatagataggagtatctctagttaagacatgcaacactatcgattggcgaaagttgattacatgttgcatagcttattagcgaaaaaaataatttatagataaaactcttatacatgttcttagcgacaaaaactattgataaaaatgaagcaagtcaactctaaaattaagttttaaattttagcaagggctgatatgttgtaggccatacggtacgactgatacctgaatctctcgtgtgatttaccatcatcaccatttggattttctgaaaccactcacctgagaagttttagggttattaaagaagtttccacgcgttcagtacttgttctttctttcgagaatgctccagtagaactgatactaagtcaaggtgattgactatgcatatgactgtaagttggagcaccctttgcacagacaatttcgcttgcagatcacatctaaactagttgtagtatttttcctttaaataagagttacaggcacctgctaatttttgtacagctgtttacaaattacaaatgcaaacacaacagctatgacgcccatggaaataatagccctggttgttgaggagttgggggttcaaaacctattcacttcaaaaacacccaccgcttttcaatgtgtagttcaaaggaaatactcaacattaacagatttactcagtgaaatggatggtgaacagaagggatatggcagaactcaaaatcttgatctcaggcactgaacatctatacgaagaaatcttcgccttcataaacacagcgaagattctgtggctttgccgacgaggagaagaaagattgatctagggagcagactgcccatggacgaactgactgatcgtgatgccttgccagcccaccccccggggttatggtatcatgttggtttcgacgtgcagacaacagctgtgaattacacagaaacttaagatctgacctcataccttccggcttgagtctgggctcgaaaacctttgtaaggagcattgggagtgtttttgacttccagcttatcaatttgaagcccagatagtgcaacccccataatcttgaatttcacctcaaacgttgggaatgtatgcaaatgagtaagcccttcttcaaggcgtaaattcccagagagagacggggctttgtcttttggaatctgccctattgtccaaaagcaggtctgcataaagaaagaaacatgtattatgcaagcaatatatgtagagcataaaaaacctatgtgtggtgatacaaagtatagtataaataactgacatttgccaaaaaagaaaaagcattcaagccccaatcttgcgtttactgagaacgcagatcctagctacatgcatgactactgatagaataggaggcatgaatcaaagttacagtactgatggggaaagaaggtattgacctggtcagcaagaatatcaactgtgccatagtttgcagtcaaatcagcagaagcaataagtgggggcaatcgaaactgcactgttatagaatcaatagttttcccaggatcatttttaatccccaccatcacattgacacggcaattccccgaatctgatgttaactgaggtttcacataaattggtgtggtcttcaatttcttaactctggtcattcatgattaaataatgagtaaaaataaaacagacaagccaaacatagccaacagagagagaaacagaaggaaaaataagagagcaaatatttatgcacctgtaactcatgagctcgaactgcccgtcagggggaacaaacgaaaggatctgattggactcccaaggtctgaatcggacacaagggtgaaacctcacatcgttgataattgtaggattagagaatgacaaggtcagttctggtacacctggaaggctagaatttacttgaattttaccatatgcttcacatttcactagagctccttctctgtaaataaaatttactgggatgtcagacatcaaaaacattctttcactatggtgcatgtcctaaggtaacaagatcagatggtgtcatgtgcgcacatgacagatggttggatctctccagaaacgagctacattgtgtttattcacagacatggtttcgttgggatccttactgctatgacaattaatgggcatgaactagatcacagtagtgaaaagtttgaatatgctatatagatttcagtaatagcttcctgcagatattaatagatgaaaaaactgttcaggcatgaatctagggtctaaaactcaaatttacagatttagtgaaatatatttggaatatcgaaaaggccaaggtgaaagtacctgtttacacatgcatctagttcttcaactatgttaacatagacttcattacttgcatccttgacaacagttgttctccatggtacaaaagaagcagctgcatctggaagtttgttaccaagattagaactcttaccagtcacaacattcaacattttgctgacaatatttggtggggcaatcatctctttcaagatgtttggctcagtagtgagtggaaaaccgttgtccatcatctcatctaaaatctgcactcatacaagtattatattttagagaatacacaaacatgaatattataaaatttgcctatcatggtcttcacaagcaactaaatatgctgatatttagactgcagcatgcagtctagatcgatgtttcacatatcaatagaatgaaaacaacaaagtgtcttgatcaatccacgtacattacagtagaaattattgctaacaagtatagataagtacttgtaaagttcgtcgcactggcagttgaagtatcaattagataagttgtaatacagagcaagtatttctttttatctgtgttgcaaacaataatatcattgttatggaacaagtgggatggcatagtagctgaataatatattttgtctaaccttaatttgatatgtaaatttactataacaattatacttttttatttacatagcaacataaaaaaaacacagcgcagcacaaacaccacaaactgagactaagaatgatatcctagttttgaacttgtaccatggtacacaactgtgtccaaaatctgtatatagagagatttaaaacctgtctgacatagtttgacaagaaatcttccagcaataaagtaaagtggcactgtaatatcatccaaatatttgcactagttttcaaatttcagaagactagaacaaggtgaaaataatataataggcaaccagctgcaaagttattatgtgatgtcacatagaagagcatatgaaaatagacctgatacacaagtacgaagttgtctttgattatgtcttcatttaaatctccaagatagtcagttaggacatcagcaacccgtgagagaaactggaagtcgcaaatcatattcacagagccataaaaaagagcaaaagtcaaaacctgtagtcagccatggttcttggcatttcatcataaattactttagcaaattactgcaatgtgcatgtttcatggtagattggtaggacaattatgatagtgacaacaattttgtagttagttgcctgtttttactgataatgcttctaaagttccaaagttgttgaacacatcatttcataccttcaagaagctttcaagcatgacaacaaactttgataatatgcaaaacatgattccaaagaaaaattctgaaaattacatgttttacgcataccagaatggagaacattgttcaagctgacatccaaatgcaaagcatatttgataatatataattatatagattccaggatcttaatagatattatcaaagttctagaaataccgattctaggcaaaacccaccagtatgactagtattgatttcacaattattcttgctgaaagtgtgagtagtatcaaagcattcactatgctcagcaacaaataacaagtgatctctgcaactctaccctagttcaaactagctatcttcagcaactgaattatgctgtactgctgattttactaccatcacagagctcccaagcaagtaaaaaggagaagctaagaggataaaactcatacctcgatagccaacaacgggggcatctccacttgggtgcatgccaagaatgtcaccccatttcgataaacttgaaacaagtaatgcgtcggtgagaccaccacctgcaagaccttccaaaaaatcaaagcaacataatcagcagagctcccccatcaaaatctaacagctaaagcagcactgcatcacaacaaatcaaagctcgaaaatccgaaagcaacagccctgaggaagagccgaacatcaaccttggaagcgtcgccggcggcgtgggcgagcacgtagtcccagaaccagccgcagatgccgcggtccacgcggtgcgccgtcatctgcttctccaccatcacctccctgccatgccgaaaaaattgtgttcagtcacaaaatcaggtcaggacagatccggcgacagaggggaggaatcgatgcgaggaggaatacggggatggcggggaggggaattacccggaatcagagaggaggaagacgcactgcaacattctgctcccctctctcgcggcggcggcggcggcggtaccgaaacggaggcgggggatcgccggcggtgaggatctgcgacctcgctacgagcaagagagagcagctctcgcgctggaggagagttgagaacaaagagagcaattagtaggcctagcccatgggctaaggcagaagcccaataggaagttaggaacccagaccacgtgacccacatggtttgaagtggtgccaatgggccggcccatggtaccatgggggacc

SEQ ID NO: 68310 - DNA, 3718 bp, Oryza sativa
gctcctcctcccgctcctgcccccgatcccctcaaccacggcgccgttgccccagcaggccaccgccgcgggcagcctctcccggatcgccctcgcgaccgccttcctccgcgtcccctgtttccttccgccgccgccgcccccttgctcctcctcctccaccctcctgccggatgaagacgacccggccgagccggaggtggacgggtaggaggacgacgcggccgagccggaggtgggcggctgcctccgccggcgaagcgcccctcttccttcccctcccgctcccgctccctcaccatccaatcccccattggttctcttctcccctcccgcatacatgcaaccgccacgggaatcccccgctcccgcacggcagcggcggcggccaccgccgacgcggaggcggttggtgaatcgccgatcggtttccgatcagcgacgacgtggtggcgtggggggattgaaggggagaggcgaggggagcgatgcgatgcggctaatccgaaaaattctaattcgattccaaattgcgaattggagtggtattattgggggggcaccagctcgaatacgttgtcgccttgggccttcctccctctccctctcgctttcgttacaagtggaagcctcgtttaatttacagcgacagagagagaaactgcctcgtcaaaaataaatgagtatgaaatataagtacaactttatcactttgtcatgcactaatggagggaatttgtatacgtaaaaaggggtagatttgattgattgcttaatgttgagtgatgatctagagtttacgcaatagtgtcgccatcggtggttccgtgacacgttcttagatttgatcgaagtaaacctgtaaccagcgtagttcacagctgtgaacattttgtcattgtacttgtagtactatatgacaatttcagactagcggatggtcaatattatttatctcatgatgttgatacggctataaagtaccacctctttcatctacaaataagtaatttagaacatcattaaagataatttattttctgtagaaaatgttgcatactataaataacaagaggtgtgacttttttttttttgaactttcctttgtttctctctgggcattatcaaaggaggactcctgttctctttactgtattttttttattcttataggatttgataagtatactattttaatttctatatttttttctattagtttttcctatcgcaattgaagtaagatactagtactccctccgtttcagatcaaagtcagactgctttaaatttaactaagtttttagaaaaaaaatagtaatatttttgacccaatataaatttattagaaaaatatatttaattattaatttaatacaactaatttggtaatgcaaatattactatatttgtctttaaatctattatatactaaaagtccattatacttcccataaacgctcccaaactgcaaagtggcaccctataaacactcccaaatcgccaatctatctatctatctatctatctatctattatatactaaaagtccattaaacttcctataaacgctcccaaaccgccaagtggcaccctctaaacactctcaaatcgccaagtggcaccataataataagaaaaatctgaccatctatttttacttatattagtgcacccattattttttggatggttggatttacttagatctattttataaagaaaaaagaacatccggaaccatcatatacggaaccaacgtacgtaatgtcgaacgtacgtgcgtatgtactgtacgtacttccctcttgtctttccatattttcattcatgtgttattttctatttaatgagaaaataaaaaaaatacttttacaggtaaaaaaacacaaatagaccaactactaggtttagaagctctccctatttctaaatcgctacgtgtactattaaattagagaaagtattagaaaatcttaaataatacaaagcaacgtaccatcgatttctacttaaactgatgtatttaagttgttagattttttaataaaaaaatcccaaacctctctccctccctccccaccccttgcagtgttaaaatccattaaacattttgtaaacatctctaagctactatgtcacatacttaaattaaataaaatcttacaaatttcaaaaaaagacaattatataataaaagttcattaaacatcttacaaatacttctaattcgccaagtggtaccttacaaatgctcctaggtcatcaagtgcactctaatccaaccatcgatttttatttaaatcggtgatctattatttttatattagaaggttagattttttttttaaaaaagcacacattccgaacctcccgtcacgtacgtaccaacgagctatgttcatgagaaatcataatcaaaattatttttacattaaaaaaatcacaaagagacctccacctattaggtctagcaactcttactctgtgactctaaatattctacaaatacctctaaactactacgtggtgctattaaattaaataaaatgctagaaaatcttaaaaaagaacaaaacatttggctatcgatttgttagttttttaataaaaaaaaccaaacctctctccctccctccccacccctgtgtggtgttaaaatccattaaacattttataaacacctctaagctactatatcacatacttaaattaaagaaaatcttagaaatttttaaaaaaagacaattatatataaaatttcattaaatatcttacaaatacttttaattcgccaagtggtacattacaaacgctcctaggtcgccaagtggcactctaatccaaccattgatttttatttaaatcagtgatctattatttttatactagaaggttagatttttttttaaaaaagcacacattccgaacctcccatcacatacataccaacaagctatgttcttgagaaattataatcaaaattatttttacattaaaaaatcacaaagagacctccacctattaggtctagcagctctcgctctgtgactctaaatattactatatttgtctttaaatctattatatactaaaagtccattaaacttcccataaacgctcccaaaccgcaaagtggcaccctataaacactcccaaatcgccaatctatctatctatctattatatactaaaagtccattaaacttcctataaacgcttccaaaccgccaagtggcaccctctaaacactctcaaatcgccaagtggcaccataataataagaaaaatctgaccatctatttttacttatattagtgcacccattattttggatggttggatttacttagatctattttataaagaaaaaagaacatccggaaccatcatatacggaaccactctcaaatcgccaagtggcaccataataataagaaaaatctgaccatctatttttacttatattagtgcacccattattttggatggttggatttacttagatctattttataaagaaaaaagaacatccggaaccatcatatacggaaccaacgtacgtaatgtcgaacgtacgtgcgtatgtactgtacgtacttccctcttgtctttccatattttcattcatgtgttattttctatttaatgagaaaataaaaaaaatacttttacaggtaaaaaaacacaaatagaccaactactaggtttagaagct

SEQ ID NO: 68311 - DNA, 9693 bp, Oryza sativa
agacctccacctattaggtctagcagctctcgctctgtgactctaaatatcctacaaatgactctaaactgctacgtggtgctattaaattaaataaaatactaaaaatcttaaaaaaagaacaaaacatttggctatcgatttgttagttttttaataagaaaaaaacccaaatctctctccctcgctccctccccatccccgtgtggtgttaaaatccattaaatatattataaatgcctctaagctgctatatgacattcttgaattagagaaaaatcttagaaattttggaaaaaaaaaacccaaccattagatatgacataaatcgatggacacattttttcaatggattaattgacacattatattaggtcattaaatctatatttttttttaaaaaaagaacaccctaaaccttcttccctccctcctttgcggcatacagtgttaaaagtcgattacacatcttataaatgctcttaagatattatgttgttctcttaaatcaaagaaaatcctaataaaattctgacaagaaaataaaacatctgaccatcggtttcaatataaacatctgacacattattttagtctgttagattaatcatttagaaaaacatcccaaacctccctccctccctacccatgtacagtgtgcgccattcttttctctctgtttttttatctccttgacaattaaaattaaaattatctataagggaaaaaacacaaatggacctccatctattacttatatcatgttaggcatctaaagactttctgccaacttaattaatttctcttgacatgcttatacaaattgaccttgatactttcaaaataatgtttttaggacatagataaatatttttaagaaagatgatcatagtgtccgaattacacatatgatctatgaagtcactaatcatagcaggtattcatgtagcaatatagacaatagggtgaaaatgaaggtgtggttggttgaacatcatattgataagcatgtgggttgtacctaaggattttaaccgtggaacaaccttgcagtggctttagcaataaatcaagtcagttccatttaggaattaatgaccatgtcctttatttatttatttttattaaacttgctacagtacattgtaaagtcttgacgtagaacaatctaaaacatgtatttgttataagacaatacactttagtgatgattcgctaaatacattatgaccattacttcaaaatttcaggagagaaaatttagaacgtatacctttaccccatactaggttatgttttcttatattttcgtcccaaattgcaaagatcaaatcatttcaaggatgattaatagaatgaaactatccaaaagaaaaaaaataaaaatgggcataaaataaattgaaaattgaaaaaatattgctggattttaaatcaatacttgattgaaaaattcaaacattttacaaggatggttagaatgaaaaaatatatctataattttaaaatacaatcaaacaaaaaaaataatattattgaatttgttttgaggttgtaagatatccttttggcgagttaaaataccctaaattttatcataggaaccacctccattgtttcgacacaatagtttctcatcaattaaaaaccacatgatctcaagtaattttattttagaatttatatgttgcacgggtaattataaaaatataacaagctttcaaatcacacaaaataagtttaattttagtttagaacataatatatgatattttaataaaaagccacccgcatataaatattcataataaaatttcactcacattatacgagaaggtgcacgcgcatgtgcgcgggctaactttctagtttaattaaacttgaaacaatttaactttgacatattataacctgaaacggagggagtagtatataaaaaagaagtatcaccgttttttttcttagggtattagctgtagttgggatccacacccaacgttctgtaatcggattattctactcccgtaattgggccagctcagtcctaacatgaaatggacggtgagagcaaatttaagtagcttaataaggtgtaacagcacacccttataaaaacataatgattccaaacgtaagaatgcatagtaggaagcagttctctctgtaaagcgcaggtgtgtcgacgtttgatgtcgcggttctggtatttgcatggtatggggatcgtcggtgctagggtatacgcgagactaaggtaaaagagatgaagacatggatttttatacaggttcgggcccctgaattgtcaggtaataaccctacatcctgttggccaaagccggtattgctcttattcatgataatcacaccagtacaatatttggggtagcctatctaactgttgtcgacatggcggtctgacgatttgactcgtagtcgacaacagggtagccttcctccttgaatccgtgtccggcgagatcagagatagcgctttcatctctcctaacagtatccggagacaccgtaggggactagccgtgcttatctctgaagtcgatatccggcggcatgtcttggcgtatgtaggcttctatgttgattgtgttgggtgttgatcctctgtgtatgttgattctcccgttgggcgctgatcccgttgggtgttgattgtcccccctctcctcctaggggggtttgtatttatacccatagttgtctccttgagtagtccttgtcgtttccatgtagaactctggttgtctttccttatccggaactccctcgaggtcagtttccgtataagacatggtatgtggtggatcctgccgagatttagtcaactactattaggtatgtggtatccataaccctgacagtagcccctgacttcgatgcaaatgaacgagttcatattctcaaccgcagactttggaggaactgttatcgagctcacgtgaccgttctcggtgagtttagagataacgttagacttcctttatcagcctcgtgcgggcaccgaatgagtttgcctaagtcaatctctgatgtcgaccgagaaagtacagagcgtacgactaagtctcccgctttgctgtaatcaagaatttggattgaagtcaagaaattttatctcggtgggtacaccatctcttcattctgtattccttgtcgagatccatgaaccgttctcgagtaatcgagcaggcgtagagtctgcgacggagccttgtcgacatttgtcgtacttgccttagtcaatcttggtgtagaaccatagagacatggagtcttcgataatgtcgaatagaattttcctgaaatcaatactcagaaaagaatattagatagaaatagcctccgagcgaatgctcaaagggtgacatgttataatatgacagactagtgaattgaatgtacagaccagtgttttgtatatgagcatcttctctcttaccgactccgatcagtcagtttgtagagtcatacactctccctagcccccagccttgtcgtcggagaatcgttctcggatgacaaggctcttggacctttgacctgcctcggttgaacaagcactgatcctagcccccaaccatgaagttggaaaactcaatttccgattacacggcttggttaatacgcacggcgagaactcttacacgaccagatcttacatggtctttcgtctctgaaggatccgacaaggccttatcggctctgggcgtccccagccgaagttccctcaggttcctcggaggccttgtcaagacggcgtaaagggacagtacgataggtttcaatgctaggtgtcttttgtggtaagggatctctgggtaaaacacttggcgatcttgtgcacctaatatcaactttgttgaagcagggtaatgggagaatcgctacacccctggtcgaggaccgggtagtagccgtaacccgaccacttgaagtggaaatagtgggagaaacgctacatcgctggtcgaggaccaggcagtagtcgtaactcgaccacttgaagtggaaatagtgggagaaacgctacatcgttggtcgaggaccaggcagtagtcgtagctcgaccacttaaagtggaagtagtgggagaaacactatatcgttggtcgaggaccaggcagtagtcgtagctcgaccacttaaagtggaagtagtgggagaaacgctacatcgctggtcgaggaccaggcagtaatcgtaactcgaccacttaaagtgaggcgagagagatcactacgttttactggttcgagaaccaggagtaggagtctcttaatcacctataggggcgctaaagttggtttattacatgtgcatatcatgtggccagcatgactcacacacccaacttatagcatatccggatgtccgttcgcaatcatgtcgggtgatcaagccgacgacgttcgcgaggaattatccgttaacatccttttctcgagtagtccagcgatggccggcgctatgagataggtcgtcggtcttctttgataggttgggcgcgacgactctgcatttgtcgagatcgttctcgataatgcggtgtactcgaccacgacctactcgagtgctcaattgttcctgaaaaatattttctagaaggcaagatatatagcagataatgtcgagtatgtactcaaaaaaaactgcatggatcttctagtattatcaggatataacgagcagatgtaaatatcaggcattatgtaaaccgtaaacaagcatgatttatacggaagaaaacagagcgagcccccagcgttagatcgtagtcgatttaacatcggggacactcgcgctacagatattattgtataaagaacatgctctgggtaaacataataaatcatggatctgataatgatgtatgatatgaataggtacgataaattgcatatgaaatattgcgtacctttgtagatacatgccggatgtatctacgaaattagtagatcaatttgaaaaaccaatctaccaattaccttattgcgtactcgttggacatcatatgatctgacatcttttggtacgccgcgtatcttgaggcttggatgatctcgatagaccaagttgtcgatgacgatgatggttctgatctggttaggttggatctccccacagccgaagtcgccgagtagcttgttgtcggagagtccatctcttaaacccatctcgtcgaaatcctgaagcaccaaaatccccctacctggcgcgccactgtcgacgtttgatgtcgcagttctggtatttgcatggtatggggatcgtcggtgctagggtatacgcgagactgaggtaaaagagatggagacagggatttttatacaggttcgggcccctgaattgtcaggtaataaccctacatcctgttggccgaagccggtattgctcttattcatgatattcacaccagtacaatatttggggtagcctatctaactgttgtcgacatggcggtctgacgatctgactcgtagtcgacaacagggtagccttcctccttgaatccgtgcccggcgagatcagagatagcgctttcatatctcctaacagtatccggagacaccgtaggggactagccgtgcttatctctgaagtcgatatccggcggcgtgtcttggcgtatgtaggcttctatgttgattgtgttgggtgttgatcctctgtgtatgttgattctcccgttgggcgctgatcccgttgggtgttgattgtcccccctcctcctatggggcttgtatttatacccatagttgtctccttgtccaagtagaactagggaaaccaatatggatacaatccgagtagtccttgtcattttcatgtagaactctggttgtctttccttatccggaactcccttgaggtcagtttccgtataagacatggtatgtggtggatcctgtcaagatttagtcaactactattaggtatgtggtatccataaccctgacaaggtggtagttggatgtccatcgagggacaaaaaaatccacggtcaaatttattatttttgtttcgaattgtataagtcgaattttaacttatatgtgtgtgaaaagatacatcatatattgatctatcttgataaatttttaaaatttttaataactttttgaacgtcatgcacaaaacgaggggatgtcgagggaaaaaatccatttccaaggttatatatacactctgaggagatattgccaaatcgatcggtaaaactttggtcgctggctcgctgcctgccagagaattccttgtagacttgccagccgtcatggactcatggtcctctgatcgatcatctcgtttgtcgatcgcctccttgccgtttttctcgtcgcttatcccttcttttccagcgcgccctctctgtctgcagttagcttcgacttcgaactagtggtacatgtacctggccccttagggcttagggtgaaattgatagtacgtttgaaactgtacgaggtgcaccaggagcgtgaaagttgtgttggactgtagggtggtgcatgcaccaggtggcaaagagtaatgacatggattctcaatgtctacatgaaggtaaaccacataaatactttaaatttaaatggtgtttgattacaacacgagaaaaaagtatgaaaacatgagctaccatcttttggttattttctctgaaattgccataggattgttcaccataagaatttcaaaggaaatgataggattcaattaatcctttatttcaaataatttcatagaaaatttttctatatattaattataaccttctaaatttctatgtcaatcctccaattaaaaggggcctcattttggaggataagaacataaggcttgttttctttttttctaaaattttgacaactttaatagtatcgatgccgctacgtttagatataccttttgggttgactttaaaaagagttgagtgtccggggacatgctaagagcatctctaacagcctcttcaaattggactctccaaacacccatatggccaactctccatttgatttggctagttaactagatggtcactctaacaaagcgcctcatcggatggccaaatgctttggctgatcagccaaagctgcctccaattcggctaaacttcaatgcatattggttagcttattttgcttaaatggcttatcagcgaaagcatttggccaatgttcgctaattaatactgcgtcttccaaattgtaaccttcccatggcatataagctactaatacgttttttcctaaagcaagttccccaccaaccgtagcagccctctgatgaggcccagactctctattaatcctcttcaaaataacaatggacccacatatctctttccttttttcccccaaaacatccttcctatcgtcgaacaccacgcatcgcaccaccaacgacgacgatagaggggcggcgccggtggaggggcagcgcgaaggggcggcacggaggggcagcaccgacggaggggcgatgttagcgggagcggcgcgagcagcggggggatagaggcagcgccggcagaagcggtgcaaggatgtaggcggcgccggcgggaggatggcgcgcgcgccaatctggagacgccaccactggttcgctgtccctcccctccctccttttcctcttcttcagcacggccatcgcggtggacatctcgcaggcggcggcggcctcggggtgcctgctgctacgccgcccggcagcgccagggctcgtcaacattgccgtggcaagggaggaggaggagcggaaaggcgccgtgcccgtcgtgctcggcggagatcgtcctcgtccacggcatctctgcttcgggagaggggcaaaaggtgtggggcctaccattggagaggccattttggatggccaaagttggccagcaggagggggagtttagccagccggatggcttggccatctagttggcaagtttgttagagtgtgtttttcgttcaaaattgctaaattttaacttggagagagagatagagatgcggttggagatgctaggtcatactcttcagcctaattgcctcccaaacaaccagggcaggctatgctagcagccaccctacggcccccgcttactaggcctcgatgtgatcgcacaacctatgagattggcccaatccgaaatacacaccgtaatgcaaatgaataagtcgacttatactccctcaaatatagttttaatctgattcgtatggatccctcaaccataatattaaatatcttgaccatctaactattaaaaataatgcaatttgactcccttaacagtttcaagagcgttttttactgacttagcttgttgactagtctaagtggttgagtcaattttatgcgggacccacatgttagtctccgttcctcttcctcctctctttttctatctgcggtggcaacatggagaggccgatgggaggaaggatgaatagggaattggtaccatatcttcggaaacgatgctcgatcgatcggtaattgatcatatttatcatttaaattaatcagtgtcgacattactactatgtagaaagaaattaaaaaataaaatttatgtataacaaaaaacggctttgctaaaattatgtcgacatatttctgggctaaatacagtcagtttgtcgatctgccatctaatcttctcactattcgtgcaagtacatctgataagctaatcgaacaacttgctcctaagttggcgactcctttttgctttgcatgacacgtgttggtcatcaacgaatgtaattactctatttacacagtaattacacatgtgtaatttagggacttacacatataattttagtatttacattgtaaatattctaaaattacatatgtaatttagatacttacatatgtaatttcgagacttacatcgtaaatatactaaaattacatatgtaatttaggaaattacaatgtaaatacatactgactattttttggtgaaaaatatggcgccataaatatagctactccaaaaaaaaataatggtcggaaacggtaccccttatacgaaaacgatgctcgctcgatttgaaatttccgtgacccattttcactcctaccggtgagctcttggatgaccaccacactccctccaccaacgagtcgataacgagttcgctgttaccaccgccctacaagagcatgatttttcctgtctcgttgccgccaccaccggcatgctcatcgtgcgtccccgagtcccaccgcctgcgccaactcgatgtcctccgcggcggcggcgtcgttgcacccgtcatcatcgtcatgcccggcgactcggccagacacgaggggcgccagtgcgccgcccgtcgcagccatagaattcgaagaagcagtctgaaaaccggcgtggagagatcattagttcagcatcgtggaatgctagaattcagttttgcagtgcagtaagaatgcaaatgtgctagtactactagagttttccacagggagggaggcattactgtgcaagcatatatatatatatatatatatatatatatatatatatatatatgtatgtatgtatatatatatgtatgtgtgctcccacatccacaaacaaaaagttcaggattcagatccaatagcactagcaaatcctagtgacgaacgattcgtgctgcggtttgggggggggggggg

SEQ ID NO: 68312 - DNA, 7203 bp, Oryza sativa
ccacctaacctggtcctcgtggtagccacgtggggcccgtggggaggggtcgggacagcccgtttccatcgggcttagaggaggtggccaccacctattcacgggcccgacccccttggagggagcgccacgtggatactagggacaatctcttccctctaagcttggtatcactgggcccatatcaccaacataatcataaaaaaaaattcaaataagatggacaataaaaattggatacggaaactcatggctgcacttattttggaacggagggagtacaatactacaatagcatgaggacttgtcgagcaggccatggtggtcttagagcaagtttaatagtatagccaactatcaactccaaatcatctatagtcaatctaatagccaattcatatgatagttaactacaaatatatactacatcattaataattagtcccacctgtcatatacacacattgtcttggagtctgtattgcagctggctacaaatctgtagcccgcttctcttctctctcctctcttatctcctccacgtgtgcttatagctgacttatagtctactattgtacctgcttttagaggatggccctagcaggtggggacatcgagatggatagtttcctcgctgtcgtcatcgaggttccgcatatgcgcttcgtcgtcatcggcaggaagtgagctgcccaagccatcactcaccactcctcttcatcgcaggctgccccttgtcatcgctcaacccgtgcgcctccgcctcgtcgtcgttcaacttggggttgttgccagggttttgaaatttcggttcgaaattttcgaaatttcagtaatttcgccccccaccggtatgctcaaatatcgcccgaaatttttgggttttttttgcaattttttgtgaatttgtcaaattttattcaaattcattcaaattttcaactaatttcggccagaaatttctgaaatttcggtcaccgccagcataaagtccaatttcaaaattaaaaaccctggttgttgcggagacagccttcgtcgctaaggaagatgcaagggataaaagtaggggtgggcgttcggtctacccgaaaatttcggtctcggtcttcggtttttcagtcaattcggtttttaaaaagtcaggaccgaatttcatcccaaaaaaatcaagaccggtctcagttttttcggtctcggtctcggtcagatcgaatttagaggagccgagccggagggcggagacgacgctggcgatgtcgaggcggagggcggaggtggcggcgcggtgtgatggatccggcggccggcggcctgcgcgaccggcgaggcggcatggaggcggagggcggagacgacaccggcgatgtggaggcggagggtggaggtggcggtgcagcccgatggatctggcagccggcggcccacgcgaccggcgaggcggcgtggaggcagagggcggaggtggcggcgcggcgcggcgcgatagatctagcggccggcggcccgcgcgaccggcaaggcagcgtgaaggcggacacggcgccggcgatgtggagggcggagggcggaggtggtggcgcggcgtgatgaatccggtggcccgccgcgaccggcgaggcggcgtggaggcggagggcggagacggcgccgacgatgtggaggcggcggcgtggcgcggcgcgatggaggcggcaacggcagcgcggcacgatggaggcagaggaggcgtgctcacgcgggatggaagggagggcggtgcgatagggatggggatggaagggagggcgacgcgatggctggatggatagggatgcagcctgcgggttgtctctagggtttagtggtgtattgggcctattgggcctcctggacctattgggccacaattcggttttctcggttaattcggttaactgagcccaagaaccgaattacctgaacaaatttcggtctttgacatgctgagaccgaattactacccgaatttctcggtctcggtcttttcggtttcggtctcggtcttttcggttcggttcttcggttcggtcttattttgcccacccctagataaaagagagggagagaaggggacgctgacatgtaaaccccatctgctgagtgagctgatagaactaggtcaataagctacgttattactccgattcaaataaagtactacttcctccgtcccagaatatagcaacctaagatcgaatgggacgtatccccctatctagattcgtagtactaggatatgtccaatccggtcctaggttgctatattctgggacggagggagtagcctactaggcataccatgataactgaacaacaccctcaaaccgattttacataatatcataataaaccacgtttgttgagaagaaatggaattgaactactataatgcatcctaacagcaaggaaaaaaattaaaggtaattaaaagcataataatagtagtagtagttgtttcaggagaccacgttcaggcgttcagcaccacaaggcaccacacgaaacatgccatcgtcaccaccgcgaccgcgaccccccgtggctttggctgcgcggtagccgatgacgtcggattggacggcagatcggatgactgggacggcggcggatcggacgtctggaacccgagcctcgacttgtggaggtcgtagatcatgtacgtgcccgtctggatcatgctgccgatgagcgacaacccatcgctgtcgtccggcgacggcggtatcgtcaggcactccagcccggtatcctcgtcctggtagaggtagttccactgctgcagcttcatcaccgcgtttcccccgaagacgaacgctatgtcggggatcttcgccctgtccatgtgctggcttctgtagcacaggtcaagcccaagcgcggagccatcctccgtgttgttggaacccagcgcgctcaccagctccttcttcaggaggccgtaggcgttcttctcgaggtaagtcactggcacggaggtgctcaggaccgcctccagggatccccccgccgagccgccgccgccgcccccgagctgcaggtccttgccgccaacgcgtatgccggtgagctcgacgaagtacaggtcgaggttcgcgctacggactgcgccggtggtgaagaacggcgtgtagcggggacgactgccgccgctgttccctggcacggtgatgccgtcgtcgtcgccgaagacgatgaagtcgtctgctgcgttgttgtccgtggtgttcacctcgggtgcgaagtagtaggagaaccgcccgaggttgagctgcgagacgagggagagattccccttgttgaggccgagcacgccggacgcgccgaagtccccctccgttgaggagctgcacccgaaggtgacgacgccctttacggcggtgtcttcgctgtcgtcgccgaacgtgaagttttggacggcgaggttgccggtcgtctcccttccgtcgtcacccccgtacccgtacgtgtaggtgtactcgcacagatcgcccgtcgtgttgcaggtcggcttgatgatacgctggcaggtatcactctcgcatttgtacagctcctcgggccgcgcgtcgtagaccgtcacgccgggcatgttgttgttcgtgccgcaggaggagttgccggtggcgcagcacggcacccacacgaactcactggtgacgtcgagcgcgccggagaagtcctgctgcgagccgacggcgaaggcgacgctgtaggtcacggcggtggtggccggggcgtggcgggcacgcctcggcgtcggcgggctcggggcattgctgctgccgtgatctgcgccgtcgcgccctggctgctgctggggctgccggtggggaggaggccgaccacgtctttcgcgtggttcttgaagaagtcccgcaacgcttttcctgtctttgggcttaccaagaaccgtgggatctttccggcggaggccattcccggcatgacgacgaggacgaggaaggcgatggcgacggcgggggctcggccggccattgaaggcaacccgatcgacctcttgtggcaaatcgaagagagagctacaatgttctctgatagattacttatggtaaacaagagtaattattctgtgtggaatgtgcgtgattacaacactggacgtactgctatttatagcctttaaatggatcggagctggctggcaaatttgatcgaccgagtcaaaacattacttggagttggttcatatatactaaaacaatcacattttccactcgttttcaagtccaatgcacactctcccgtgctttctctactctctctttcacataacacttcccctaaaatttctgtgtttcaaaagacatcacttctattgttagggagcgttggttctggtgagttagggtgagaaaacacatcgtagtccgtgcgcacgcttcccaaactactaaacggtgcgtttttgaaatttactttaaaaaatcatattaatctatttttgaaatttaaaatagtttatgctcaattaatcatgcgctaatgactcatctcattttgtgtatcttcccaatcttctcaatctcctatccctcaaactcacccttactctgcttgaaattttgtagcattgtatagcatatgactaagcctgctaatggactggattggaatgggttaaatggattggttttgtatttgggtttgctttggttggattgaaatgggcacacgctataaatgggttggatcgatttggatccaccggaaaagaggattggggcggtttggtgatggttatgattttttgagtataatgtggattcagtccatggattgaacccatggattgtgaatggtttccactaagaaggctagatcaggtctcagtcgtggacaacacactccagcggtcgatgagacgatgcatgttccctggtcgattaacaagctgcatcacggccgcctcctcctccgctcgcgctggctccggcaccgattccgctgccggcggcctcttcacatccgcggaggacggcaacggcgacaccacggctttgactgaacaaccgcgtccacctgcctctctacctccttctgcctcgccgcctccgccggaaagggaggcggcggcggcgatggcagcggcttctgcctcgccgccctgggcgccgtcgccggcgagggggaggacgaaggcggccgttgcccctgcagcagctgctgctgttgtagcagcagcatctgctggcggcggacgtgagatgggctgtagagccggtcgctcaacatgtagcctccacgggacgacgacgacgacgccaaggtggcgccagacgggtggaccatggcggcggcgccagaacaagctgcatcgcggccaccgcgtgctcggcttgacagacggcgaggtcgacacaaacatgtcgtcgacgctatgaacgccggcttgctgctgccgttcaggctgtgcgtgacgaaatgcatgttctggttgatggtgaatcaaatgggtttgtggtcgggggtggattctaaatggtctgaaatggtttgacagggtggactgaatccataggaagggaatgggttagtgcggtgtggactgaggtgagaaatggattggattggtttggattctgaaaggagatttgcgggttgggttggtttgaactatttgagctaactgctgtggtgtggattgggaatggggcgggtcttaggccattagcaggcttacatatgacaatcaactcctacgtttcttctatttctctatgtttttaaaatcctgcattccaaggatatctttctcatcctattcctattgcatagcatgtggagttttgtttgttatttttattacaatctgtacaagttaaattttaacctgcatgtttatagagtgatatattatatattgatctatctttttaattttttttcataactatatagataacatacaacaaataggtggacgtccacccgagtgatcaaaacggtttccccatagcatgggagatggattctaatcactcgggttaacgtccacccgtttattgtatgtcaactatatggttataaaaaaattaaaaaaattaataagatagatcaatatataatacatcactccgcaaacatacatgacaatcttttctattacaacacttatgttacctgtttgtcgtcttaggctctttgtagcttgctgtcgggaaaaagaaagatgaacatgtagaccgtgaagcttcagttatgattgttttttttttccattacacaaagaaggcacatacatgcatctcctaaaactgtaaccctatactaactaaaaacccgtcatcgtcagactatatgcctaaactaaacgtgttgaacattatgcatttaactcttttctaattaattggcacgtacgcagttatactacgcaacactaccaaactacttttggttgttaacaacacgaaatctataaataaattttactactatatacatatagatatgggttttgcttatcaacggaaagaaatgtttccttatctatatagtacattaatttactcagtatacacacacacacaaagatttacttatgaccaatatttcttagtaataaaatgtactaagaatagcgcattggtcatataaaatattccctccatcctaaaatatttgacaccgatgactttttaaaaaatattttaccgttcgtcttatttaaaaaatttaagtaattattaattctttttttatcatttgatttatcgttaaatatacttttatgtatacatatagttttatacatttcacaaaagtttttgaataagacgaatggttaaacatcttttaaaaagttaacggcgtcaaacgtttagggaagtagggagtaattagaatgggtgatgcttcgaacccagatcgtttagcccaccgctaccttgtgaagctagtcgtaagatccctgagcgtttctatcagcacagcacattgaccatatagcttaatttggtctacgttaatagggaagacttaagtcgttgaccacacagcttcgggcaaggtgcatggtaaaatatggtatcatgacaactctcctcgatctggtgttttaaataacagtgaagattcctaccagatggagttctcttttcgctcgatcgatacatattgatctcgagttgcttctgacttccagtgatccagattagttgg

SEQ ID NO: 68313 - DNA, 12905 bp, Oryza sativa
ttccctacttaatactccctccgtttcaaaatatttgacaccgttgattttttagtacgtgtttgaccattcatcttattaaaaattttaagaacttatttattcttttcatatcatttgattcattgttaaatatattttcatgtacacatatagttttacatatttcataatttttttaataagacgaacagtcaaacatttgctaaaaagtcaacggtgtcaaacattttgaaacggagggagtactaaactgtgtgcccatcactcttcgaccggctccagtaaatcccaagacgaacacttgcaattagaagagtgatgaagtagagaggggatacttgatcaagtagctacagctagtcagctagtggtaagtaaggcactaaggctgaaacattcaaatcaaaggaaatgcttaatttatatgaaacttgtctttctcgtttaacctcagatcaactcagtagaagatagtatattgttctcggtaagtcggcaattgcaagtgttcgtcttgggattgtatctttcgtttatgcatgcataaaagaagaagagcattggttaattaggttcatgcatcgtgtctgaaaactaattggtgaggatgcacgcgttcaaaagatgatcaaattgttctcggcaacataaactgtaattcgattgctcgctgaccatgtcgatcgtagctttgacaatccaagttaatagctagggaagaattaattaacggatttgctgaaaaagtgtcgccacattacgtggctgagtacagtcggattttaacggctgggatgcgctgcgctggacatcgtgtgcacgatgcacatccgttcctccacctgtttatccctttgcattttttttattttatttgttgatccggaattgctatgggtttgtagtagtcaactttcttgttgtaattatatatttatacaaatttacatactagttacaccccacttacacattacttacatatgtaattaatatgtaattttaggatttacatatatgtcgactggggatacccgtagaccggatatagagggtattggggtacactggtacgaggatctacgtaatatgacatcaagcaaatagaaaacatgaattatactggttcaggccccttggtaggtaatagccctaatctagttgatatgggattatatgatggaaatcagagattataaagggaacagtggaactcgatgataccgacgagaccgtagtcgagtcgactagatcacccggcgacttggctcctgtaggctccggcttcgtaggctatggtggttgtctcggatgtgagattcgatgccttaggtcctcccggggggggtcccttttataccgcaggtcaggtggtttccaagtaggactcggagacatcggaccctacatgatacagttacgacccagtcctatccgggtaggaatcttttcatctatggactccgtgatgaatttccttagcgcatacaaagaacgtccgtatacgcgcagatataccacaccgatgtatagcatatatccaagggtagagggtataccttatccgtaaccctgacagtagcccccgacttctacttaaatgaactcatgtaaccgatcgcgacttctgatgttgggtttgttgtcgttctcgtctagtcgatctcggcgtaaggaccgtagagacaaagagtaatcgacaacgctatgaaaagttcaacggtcgtgagtgaatttaaattgaagtccaaaaactgccgcgcgtaacggacccagaaattttcggcgggcatctctcctctttccttggaaatcgcaccgccggtagtgcgcctttaaaagagttttggggatccattttgaagtccgcctgttgcgaaagaacttttcagtctctaagcgctcctcatcttctccgctcccgcaaaaccctagcttgttcatctccgtccctcctccgacgatctccgacggcaatggatctcgacaaatccacttccaccggcgcgtcgctgaagaagttacaggaggacggcgctctccccggttgcggggccatggagagagaaccaggaggtactgaccctgagccagtcctgggccgcatggttgcagttgaggactacattctctgtggttttcttcctcctccttccgaatttctgcttttggtcttgaatttctacggtctttctttgctccatttgaaccccaattccatcgccttccttagtatcttttcgcatctttgtgaggcctatattggagtagagccatttctcgacctctttcgtttctactacgagttgcgttggatgaaatccaacagggtatctggatgcgttggtttccgactttgggatggcctgaagtcgcgctacatccccttctagtgcccctcttctcgtagtaaatggcgggcgaggtggttctatcttcagatagaaaattcggatccagtcttcgttgtccctgaggagcaaccagacaagatttcttcttgcaccgccaaacccgccttaaccccttcccttcagtccttcatcgatatcatcgatgacctccgagtacaaggattgtcggggtatgaagtcgctgccgacttcattcgtaggcagatccagctgttctaggcttgagcccacccaccctttcactattctgggccggaggacgtgacccaggtttctcctcagggtatttttcttgtattttggactccattccttaagtgtgtattcctcctgacttatcatttctggttttcgatctacaattgaacagcgaaaccgtggagcaccgtgtcggtcaagtgatgatcagcggtcctacaacggcgagcaacgtccccgtccctctttgcgagaaggagccagctgaacgcgaagccgcgatcaatgtgagtgtactcgacggccctgttgtctttttcctccgggatcgcattgtgactttatgtagtgcaggctctccctcttactgatatcatcggaccgctcgtggaccaccaggcggcggcttcgctgaaggtggacgtcgccaaggaggcgtccgatgttgctgccgctgctgccacgatgagtggcggcaatgttccgaaaagggggaggaagttctcctccgtgctcggaaatcgtcggaagacgcccaccccatcggtaagctctcccgacccttcatcactgaagatcttgacctcacatcatgctcgtttttactctaggcctccgacgcgtctcccccgcctccgcgccggcataggcttgtaacgcttagcgagaagtaagaggatgaatttgaggttttgttaattcgtcgaactcttgtagcctgtcttgagagcaatctttcacagggtggcgcgggcgaaggcagcgcaagacgggtctggagggaactccagtgtgtctcctgctgcggcctcgacagatgtcgtggtcgtgcctcggagccgtgaggcaacgcccagcggccctgccggcggtcttgtgcctgcttgaggccctcccgctgacgtcctcacttgggaggagctccaaatcgagataaggcgcatcctccaagccagcgctcgcggcataggccgcgagattgcggaggcgagggcggcagcggcggcgtcagcgaacgaacgcgtcgacaagctagcgcgttacctggcggaggttcgcgaggacctccagaagatgagggagctggtggccggcaacgagcggcaacagcaggggctcgagcaccgcatgtcggagctcgagaacaacctgtcagagttccgtggcttgctgcggcttacctacactggcctgcaccagttcgccggggagtgtggtgtcacgaccacgatcccggcgaatcccgatgagttctcgctgacgacttcgattacagaactgcgacggcaatggaggcgatcccctccaagcatgcggcaaggatcagagaggatatgtccaacgggatctacatcggggcgtgccacgtcctcgcgtgcgtaaggttggcgcaccctgaactcgacctccaggggatcctggatcagggggcggctaacgacgcgcgtaagggtgtgatggaagaagtcggtgatttgggggagtctgttctccccctttttgaagagtaggacttcagtttccctgtactccttaatcagttatgcttcgtaaaacttttgttggctccaactgcctttgtgtgtgcagtcatcaccttagttttctttagcattttgatcctgagtactttgttgttgtttgtagagatatcgatgtcgaggatgtccagcagtgcgggcagcctgagttgccagtgatcgttccggcacttgccttcgagtcgtatgtgttgcaggacgacgtagatcagaacttgtccgtggaaacgggtgtggcgacgacttccttaggttggtttttttttgttttcatcttctttgctctttcagctggattgacttgatttgctgcgttctcgagagaggagggcagcttgacttagtcgcttccatactgagcagacttcgagagtgtgcttgccgaccgagatcatcgcatccaatactagaggacgaagtttgaggtggcagaacttgagaggactatgttggaagtgaaaaaggaccaggccgtggaagcactccgaggtcgtgaggtgtggttcaactcgtacctcaggagttgttgcacagccatggccggagtctgccgggaactccaagtatctcgcggggatcccgaggagtcggtggccgggtatatctcgtggctgaatggggcctgtgcccaacttgaaggcatcggcaagcgtatcgacgaggccttgaagcaggagtgccgtcgatcgagccgatatgccggagggcacgtgttggcctgtatacgagataatcgtccgcagctgcacctcgagttcctccacgaagggtttgcacgttctcgttggactcccgcagagatagaccacctggcgaagtcaatggcaccgcttgcggagaaaatctttcagtcgatggattggcgttggacttgctggtagtttctgtatcctgtgacaaacatctcagggtagattgtaatatattttcaatttttgcgagctgtaaaaaatacttgtgaaatagaaaagagatctatctaactgagctttcttactctgtatgcggtgtgtgcgagtgtcttctcacttagcgacttcgatcagtcacttgagtcatacactctccctaacccccagccttgtcatcggagaattcttctcggaagataaggctcttggacctttgacctgccttggttgaacaaacactaatcctagcccctagccgtgaggttggaaaatccaatttccgattacacggcttggttaatacgcacgacgagaactcttacacgaccagatcttacatggtctttcgtctctacaggatccgacaaggccttatcggctctgggtgtccccagccgaagttcccttaggttcctcggaggccttgtcaagacggcgtaaaggacatgaggataggtttcaacgctaggtgtcatcggggtaatggatcatcgggaaggaacactttagttgtaatcttttcctgaaagaagactttattgaagaggtaatatgtcttacaagtatggatgctattgatttatacataaaatttacgtggttgatcaatgttccaagaatttgccaactcgcgaccatcgccgtctgaaatcttgaatgcgcctggtcgcaggacttgcgtgatcgtgtacggtccttcccatttgggtgagagcttgttttgcgctgcttggctttgaacccgtcggaggacgtagttgccgatcgaaagcgtgcgtgctcggatgcgcttctcatggtatcggcgaagggcctgttggtagctagctgctctgacggcaactcgttctcgatgttcttcgagaaggttcacatcgtcgtttctcggcttttgcatcgtcctcgggtagctcgtcgctacttatgaatttaattagtgggatccgccagtcatctgaggtctcgatgtcagcaacgacgcattctgcctctgtagcccccgagcagatgtcgggtgtgactgtgctattttcgtcatttgtttctttcaccgatggttttgtcaggacgtccaggaaggtgccgggttcgagtggctcctgtgtagatgcacgccgtgccagatcgtctggttcgatgttgtccttgcggtatacgtgtcggacctcgattccatcaaatcttttttccagcttcctgacttccgcgaggtacttggataactctgggctagagcacttgtagtctttgtgcacctggtttgcgactagttcggaatcccctttcacgattaattgcttgactccaagtgcggttgcagctcttatcccagcgagtagtccttcatactccgctgtgttattggttgctctgaagttgaggtgaattgcatgcttgaactgctctcccgaaggtgatgtcaagatgaaccctgcccctgctccttggctgttgagtgcgccgtcgaacgccattatccatgtttcattgtcggtttgactgtctaacctattttcaggcatagtccaattggctacgcagtcggcgagaacctgggacttgatggctgttcgtggcacaaagtagacatcaaactggcttagctcgactacccatttcgcaatgcggccgacaacgtctttgtttctcacgacttcaccaagagggaaggaggagacaactgtgaccccatgggcttggaagtagtggcgtagctttcttgacgtcatgattactgcatagagcagtttttgggtctgtggatatcttgtcttcacgtcatggagagcttcgctgacgtagtagactggtctttgcaccttctctctctcgacaacgatgacagtacgcacggaatatggcgtggcggcaatatagaggaataattcttcattaggttggagagcaacaagtacagggggatttgacaggtagcacttgagtgcgatgaacgcctcttcgacttcctgtgtccatacaaatttgtcttgttttttcagcagaacgaagaagggttgtcctcgttctcccatcctagcgacgaacctgcttagtgccgccatgcatccagttagcttctgtacttccttgagtcttgtgggcgacttcatgttttcgattgccttgatattctcgggatttgcttctattcctctgcccgagacgaggaacccgagcagcttgcccaatggtactccgaacgtgcacttctcaggattgagcatgaggcgatatcgtcggaggttgtcgaaggtttcccgtagatcgtcaatcaatgagtcgcttgtcttggtcttgacaacaatgtcatcgacgtaggcctcgacgttgttcccaagctaatcgttaagtgccccttggaccgtgcattggaaagtgtttcctgcggttatcagtccaaacggcatcttaaacgtagcagaatacagcgaacggcgtgatgaatgatgtcttctcctcgatctcttttgccatgctgatttggtggtagccggaataaacatctacgaagcttaacaactcgcaagcagctgttgagtccaccagttggtctatttgaggaagagggaagtgatccttggggcacgccttgttgaggtcagtgaagtcgacgcacatcctccacttcccgttggccttccgcaccatgactgggttggctagccactctggatggagtacctctctgatgaaaccagctttgagaagtttatcgagctcttcttctcgtatggcctgttttcgatctggtgcaaatctccgcagtttttgttttattggctcggcatcgggtcgcaccatgagtttgtgctcaatcacctccctggggacccccgacatgtcggacggctgccaagcgaacacgtcaacattgtcgcggaggaaggtgatgagcgcgagttcctatttctcgtccagtgatgccccgatcttgactgtcttgtcggggttggcgctggagagtggaacgattttgattacgccttctggtttcggcgtcttggttgttttgctcactttcttgggtggctcggttgcggtgggtgggctgggcgtgtgctcgaccatgtcgaggcttcgcttgtcgtattggacggccagctttgcgttcccttgaatagtgattgttctcttcggcccgggcatcttgagtacttgatatgcgtagtgagatgcggccatgaacttcgcgagtgcagttctcccgatgatggcattgtatgctgtgtcaaactcagcaacatcaaacgtaatctgctctgttcggaagttgctcgcttggctgaaagtcataggaagcgtgatcttgcctaatggcttggacgatgactaaggagtgattccgtggaagggttgatcggtgggtgtcaactcacttcgtggaatccccattgcatccaaggtgctggcaaagagaaggttgatggagctgccgccatcgatgagaactcgcgctaccttgatattccgaatagtgggttcgaccacgatcggatatcgtcctaggataacagcagccttggggtggtcctcatctgagaactcaatcttctgttcggaccactttatcttgggtgcagccccctgccatgtcgaacaaacttcacgctccactttcttgtattctcgctttgaggagtatgccatggaacctccgaagatgtgcgagacatggagaccggaatctggatatgccgaatccgagtcctgagtggttgcctcggcagctttctcgactacccgtactcgcttgcttttctccaatgccagttgcttttccagcgactttttgaagacgaggcaatcctctagagaatgtctgtccgacttgtgtatggggtaccatattctcttcgtgtcgctgccggtttgggtgtttaggagggcactcatattccgacgcgaggacttccacttgagctttccttttcccactcttgttacttttcttcttgcttgattcaggtgcgtctttggctggtttcttctcccctcccgtctttggcttgtcgttcttacgtctcagtgcgtcgtccatgtgagcgcatcgatcgacgatctcgaacaatcttcgagtagttgtgattcgccttgtcgccaactcctgggtagtatagtgatctctgacaccggttttgaaagcgcgaatcacagaggcgtcagtgatttcggggattgtatttctgcactcattaaagcgccgaaatagtccctcagagattcgcccggattctgtgtcaacgcatgtaggtcgtcttcgatcgcgtgacgcttgtatgttccttggaagttagcgacgaattgctgccacagatctgcccatgaagaaatcgagtggggcgggaggtgcatcagccacgaacgcgcggaacctttcaacgccgtaggcagataatttgccaatgcgttgtcatctgctccggcagcgtagagtaccgtggagtagacctgaaggaattcttctgggtcggtactcccgtcgtacttctctattgctcccggtcagaatctctcaggccatcggacatcacgtagcgaacggttgaaagctctacacccgacgctgggggcagtgggttgtcggcgatcatatgtccttcgtggatgtctatctgacgatgaggatgaagtggatgatgacgatgacgacgggtcacttggctctagtgtgcgattccgaggatgacgtccgagttctcgggaatcctgtcatcgtccaccattgtcgttcctgcgccgatctctgtcatcgtcaccattatggtggcgtcctcgaccaacatcgcccgacatccgctgttcgcgatcatcgcgctcttggcggttgtggcggtcatcacggtctcggttctcgcccgagcgtcctcctcgctcttcgttctcgcgacgtcgcgaagagacgcgatgtcgggaacgattctcgttgtctcgcgcgcctcgcgcttctcggcggtcgttcagatggtcgtggagattgccggtgctgtgaggcggaggggtggctcattgaggcgatgtccgttactccggtggctcgccgtcggcgccgccagctgtcggttgttctgtctgtgctctggtagtggcctcctcgaacgcgttactgagattggctactgattcccgtagtcgttctgtccaccgtgcgagatcatcgttgagtacgggatcattggtggtttctctcagtattgcgttgatggtcccaaggtgttgggccggcgtggccgcttgattctccacttctgcattagcgtgcgcagacgtgctggtcccaccgatagcaaatacgtcatgtggtgtactcgctaacaatgagccatagtcttcgagcaagtgtaggactgatggctcgtggggatcgatgtcgatcaccccaacgaatcgactgggatgaccgtcgctcctcgttccttgttcacatctctaggaggaatttgtgactactggaccttaggaggcgacgtcttcatggctttgagaagaatcttgcagtttgagaagtcgtgattctttgtcttgtggataggacaatagatatcacgagttggagaagtacgctgaattccatgctctttgcaggcacggatctcagcttgtgcgttgagaaaaacccagcaagcttgcagggtgtatttcctagttttgtgaataggacaccaggaccttgtcgcctcaaaagttgtccttgtcggctcgtgattcttgtcggaaggacaagatttggccgcactaagatcttcctcaggcttggatgtcgtcgacattccttctccgcttcggcgggaggatcgttcgacagggggtcgtccggggttacggccacggcattctcacttctggtcattgatggaccagtcgagaccggcaccatggtgtaaatcgggaagacgatttcaccgacttgagtacacaccagcattgttgaagtcggaactccttggttgacgatggggtcgacgctattgttgacgagatttgacgacatagtagtagaatcttgagcaccaagtccccctacttggcgcgccattgtcgacgggggatacccgtagactggatatagagggtattggggtacgctagtatgaggatctacgtaatatgacattaagcaaatagaaaacaggaattatactggttctgaccccttggtaggtaatagccctaatccagttgatatgggattatatgatggaaatcacatattacaaagggaacagtggaactcgatgataccgacgagaccgtagtcgagtcgactagatcacccggcgacttggctcctgtaggctccggcttcgtaggctatggtggttgtctcggatgtgagattcgatgccttaggtcctcccggggggtcccttttatatcgcaggtcaggtagtttccaagtaggactcggagacatcggattctacatgatacagtgacgacccagtcctatccggttaggaatcttttcatctgtggactccgtgatgaatttccttagcgcatacaaaaaacatccgtatacgcacacatataccacaccgatgtatagcgtatatctaagggtagagggtataccttatccgtaaccctgacaatatataattttaagacttacatatgtaattttagaacttacattgtaaatatactaaaattacatatgtaatttagagacttacaatttaaatacataccaactatttttttaaaaaaaatatgacgccataaatatagctagtcctattaattaatgttgaccgtgatatacaggtccattgtattagctatattgtcaactgagagtctgcgaggacgccgataacaggcggccggtggccacaacacctaaaactgagaccatatccacgtacggtgtcacatacagctgtagtctagcgtacgaggatatataccacggttggcagaatggcagttggcacgtgcaactacgtacgtgtacggcgtaatatcgtcggcatcgatccaagggccgacgatggggtacgtaagtacgttcgagtcgttggctgcgcgcgctgccaaggcgtgtgcgtatttcttgtgagagctggatttaccgtcccggtcgcgatcgaattacctccggccatgcaaaccggataaatagagagcaactagacgaaggtgtaccacgggcggacgggccccctctcctcctccttctcctctgaaacggcgagagcagtggtggtcgtcggatccgcgtccgtcgcgtcggcttccgccaccagcttgggcagaatgaggaagcggctccgtaccacatgtccttcaccgcaacatcgccggagttggacggccccaacgtaaggtagctggtgacgcgctcgccgtcggtccctgcgactcggtcacgaacatcgcccggacgggaaggggaggaggatgccgtccgccatcctgcatccgttctttttttttttctcgttactgctgcagatgaaaatgacaccaaatgatctgttcatttttttcgctaaacttttgttgcttggctgcagttacataattctgggagcacacctgtagatatagcagtagcactgctcttcacatgggcagtaattgcaaaccaacacctagttcttcagaaaaagacagcattttcctgtaaaaatctcacctttggctctgttcgtcatgcagatttcagttggagggaaatcagaattgactgggaatcacatgaactccagaatgacgtaattaatgatcttggcattacgtttcttgccaattttatcatcagttaatcaatggactcgttgcttcttacaactgtaagcaactgtgccgttctttcttgcgcagagctcgcg

SEQ ID NO: 68314 - DNA, 16918 bp, Oryza sativa
  unsure (1)..(16918): unsure at all n locations
gtgaacttattcccacgccaagaacacaccacacgaaacatgcaaataagatccatggcatggcagcacggcaggtcggcagcccacgactcgatcgaatcccatcctcgggccttggatgtcgtcttgtggccgccgctttatatcggctcgcagttgacaacctattacagtggacctatatccgaaacaattttgttatatatttatcgataaattcttttaaaaatttaatagatataattacagtataatcgtataatcgtagtgttattacactgttaacttgcatgtaactataatataatttgcatataactttcacataattttgaaccgttagatttcttcaagatttgtatgagtggagaaagaaaaaagtcactgcgcgtacatatgtgggaggattcgttcccaaaacctccggtttttatcgaaatagcatgttactgtcgacgggtgatacccgtagaccggatatagagggtattggggtatgttggtacaaggatctacgtagtatgacatcgagcaaacaaaagacaagaattatactggttcaggccccttgataggtaatagccctaatctagttgatgtgggattatatggtggaaaacacaggttacaaagagaacgatggaacttgtcggatccagcgagatcttagtcgagtaggttcgactggatctcaatggctttgctccttgtaggctccggcttcgtagactgtgtgggttgtgttggtttcgagattcgatgtcttaagccctccccggggggtcctttttatatcgcagatctggtggtctccaagtagaacttggaggtatcagaccctatacaatacgtcaacgacccagttctgtccgggtaggattcttccctactgtaaattacgcgaaaggtttccttagaatatacaggaaatatccgcatgcgcgtgggtatgccatatcgatatgcaacgtatatcgaagggtaaagggtatgccgaacccgtaaccctgacagttacaaagagatttttgaaagttccatacaaattacatgtaagttagagtgtaatttcacaacgattatgttatagttacatttgtcaattttttagagaaaatttgtcgacaaatgtaggtaaatcttccctattaacttggatcaaattaagctacgatcaacgtggtcaacgagttacagtttatgttgccgagaacaattgagcaattgatcattttttgaacgcgtcctcacctattaattttcatccccaatcgacacgatgcatgaacctaaccttggctcttcttgcatgcaatggccagcacgtccatcttcctattgttgccgacttgcggagaatataccgaagaattctgaggtaaaacgaaagacaagtggcatataaaattaagcatttcttttgctttgaatgtttcagccttacttatcactagctgtagctactcaagtatcccctccttagcttcactcttcggaagtgtttgtcttgggattgtatcttaggttctactactaggtaagttcatcgccctggaggcctggacccggtcgtccttctatgagccagtgatgaactggatcaccggaaggcggaagcaactcgagctaggtcaacgcatcagcctttcatcttccctcgatgtgtatgagcatctttacttaatttccagtttaaggtaaaaggctatactgcgtgttttactaactgtaattagctcatgaccgaggctataaatagccgtgcagtctcgatcagtcgtcaattctacacagagaatctgtaatagggcttgtttagattgacgtcatttcaaaccataccattttttagcaaagttgctaaatatatacatctatttagtttcttactaaactctaggaaataaataagaaatcataccaaaacttagcaatattagctagcctcatgttcgatcaatttccaacacaccttccgtacacacaacctgttgaatgatctggcgatgcatgtttcaccgtctgccatcaaagacctggctaaagtctgtaacctcgacgaggctgccaccaaagagctggaactggtgctcacggaaggcatatgaatcagtcaatcacacaatcttttgttcaagggaggctgctctgttgctgtcttgggtcttcgctctggtgctggtgctgtgccctgcagttcttccctgttgagatgcgtcccccccccccccccccttcctttgcttttggtgtctttcctatcatatgtcaagtaacgttagaactctatctattatgtcctggaatgttcgcgggcttggagacttaactaagcgccccattatctttaattcagttagctccgctgctttctccgttgtcttatttcaataaactaagctatactctattcaccacccgattacctcttctttcctgccgtccttcctcagtgcttttgattttacccctgcaatgtccacgagcggtggtctccttacggtttggaatccaacaccctaaccaaatccttcctcatctcccgcaaacataccctaacaatcggcttcacccacaatatctcaaacatttcgtttgccattaccaatgtgtatgcctcaacagacccacaaacaaaagccatctttgtagaagacctctccgagctctccaccaatatctctggcccgtggttactttttggtgatttcaatcttactcgctacccctatgataaaaacaactcaaacttcgacctccacttagcaaacctcttcaacgaaaaaaatgacgatcttgcgctcttagaaatcccgctcttcgattggctctttacttggtccagtaaaagagaaatccccaccctttctagaatcgatcgtgccttcataaaccaagcttggaacctatctcacccaaacacctccctctcctccctacctcgcactacctctgaccacgtccccctaaaaatatccatttccacttcaatacccaaaactcaagttttccgtttcgacaatcaccttctctgctccccaaatttcctccccactatcctttgggcctgggtgggccaactacccactcaccaccccacagacgcggctggcaaccttgttgctaacctgaagaaatcacgtttcgccaccaagaattggatcaaagctcacaagttgaccaacgacaacatttctgactgttctttgctcatcgacttcctggactctattgaagaagctaggcccctctcgactgcggaattcaccctacgggacctcgttcaagacaagttagctgatctccatcgatgcaaagcaatctactggaagcaacgcagcaagatcaagagaatcaaagcctctgacgagaacaccaaatttttccatgcacacgcgtcacacaggttcagaaacaatggcatccactccctcctgctacaaggttcgcaggttttcgaccacgacaccaaggcagatgcgctttacgagttcttctacgaaactctgggcggctcagcaaacaccacctgggattttcatctccaagatctctaccctgagaatacagtccacaatgcgagctagcagcagatctcggaacctttcactcttcaagaagcaaagtctgcattggactgcatggataattacaatgccccaggtccagatggttttggtccaagcttctataaggcagcatggcagcaaatcaagccctacatacagaacttgttgactgaatttcacaaccactctgcccagcttgaaagacttaacagagcatacatagtcctcattcacaaacccggtaaactaaactccccatattgttatagacccatctcactgcaaaactgccatctcaaactactgtcgaaagtccttgctaactgcctacaatccgttcttggcagtctcatagactgggagcaaacaggctttatgaaaaggagaagcatctcagaaacttttctatatgcaacagaaattctccagtgttgtcacaaatgtaagctgcctacggctgtcttgaaattggattttgcaaaagcttttgactcagtgcaatggtcaagcctccaagctattctgagagctagaaatttccctaattgatggcagaagtggatccaagctctgctaatttcaagcaagtcagctgtcttgctaaatggcatccctggaagatggataaactgcactcaaggtctccgtcaaggcgacccactctcaccctacctgttcattctggttgctgatatcttgcagtagatgatcaagaattgcagtgctatcaagcacccaataattcacaacctgctaggagccaccctacaatatgcagatgatacacttattatctgcccagcagaagcctcccagctaagtgctctaaaaacaattctcaactcctttgcacaggccacgggtctctgaataaacttcagcaaaagtaccctagtcacccttcacactccaccagaagccagcaaagaattagcagacatcctccagtgcaagctagaatcttttcctcaaacttatctggggttgccactatcagctactaagctacccctcactgcctttcaaccactcatagcaaaagttaacaaatacctagcggggtggcaggcctctctcttaaactatgcaggcagggcggtcttggtgaactcagtgctagactttctaccgacctatgcaatggccgtcgggctttcctatggactggggaggaatcatgtcacggctcgaaatgcttcattgcatgggacttaatctgcatagacaaaaagcaaggtggccttggaatcaaacgccttcacacacaaaacatctgccttctcatcaagatgctttacagactgtacacctagaattcaccctggacaaattggatatggagggagcatgctgattcagccctgggcccccactggcgatccttgattgccctgtttccacttctcagatctcaaactaatttggttgtccgagatggcaggcgcaacaatttctggcacgacatttggctggatgatcagcctcttgcctcaagattccaagctctctacacacactctactaagtcaaactgcacagtgcaagccattatccaaaatggcctggctgccacccttgtcccacgtctttcaatggaagcgcataatcagctcaataccctcaggttttattgtagcaatcccccctctcggctacccaggatgagctaatatgtaaaaccaaatgcaaaaatggtgtcatctcatcttcagctctctaccagctacaaatggcaaagtttcaggaatggcctcaatgggcttacatctggaaaagcaaagccccccccccccaggatcaaattctttgcctggcttctagctttcaaccatcttccgaccagagtaaatctacacaaaaagaagattctcccatccccaacatgtgagctctaccagagctctcctgaagatacggatcactttttcctcgattgccctttttcatcagctttctggaatttgatcaagctcactccgtcagtgacaaccctcttcatgctgcacaccaacaaccttgctggtgccccggtaccgttgaacaacacattgtttcttctctgctgctggtgcctctggaaccatagaaacgaagtcgtgttccaaaatgaactcccatccataagccgcctcctcagatgttgctgccaagatgccaagctctgggttcatcggttcaagcaatcgaatagagctatcctccctgtgtggctttcttttttctcttcccccttatctcctgtaattttggtttttcttgttttgcttttcccgcttttgttgtacagtgtttgttttggcctttaatttaattcccggcggcggtgacgatcgcctgtttcgtggggtgggttgtgcactcgtgctggtggtgaacatggtttcgtgaaagctactctctattttaccttccttcgctacttgaagttcattaatttttcgttcaaaaaaagttcattagttttttcataaaacattattctattacggaaatgctaatgggcgggtgatcgctcccctgtccgcccagcgatcacctgcctgccctctcccctatactactcgatacactcctccctcctccccttcttatcttcctactacagtacaccataaaatttttttaaaaaaaacaaaaagttagaaaaaattatggagtgaattacactttggactagttttaattacataagttgcatactggactaggaacgtacaaccattttcactttgaaccaggttttgttaccaaactatgcaatttggactagttgactcacatgttagcctcagccattcatcttcctcttttattagtccctatcctgatcgggcagagctcatctcttccccagtaatgcagcagtagcagcctagcaggctgcacgaacatcgagtggccgctggcatgtcctctgcagctctgccctgcatccctccctcttgaagatgaccgctcgtcggctccataggttgtgcccgtcgacgaccgctccaccggctgacgcaatgcgcgagatggaatgggctctgtcgttggcgctgccactgggagacgagtgcgggcgcccctcgagcttgacaggtgaaggcacgtacaacgtacagcctggcgctccatcgatctcggtccatccattggccaacctgcgttgctcaagatcggacttcaattggaaccccaagcaaatcacaccaacaaagctgcactcattctggactgctggtcactaaccacgggcccaagatgagattgatgcattcgtcggtgaagacgggagagatggaagaaaacactttctacatgatatgtgggccactagtccaagatgaaagttttggtaacttcatatgtattaaagtgaaaatatggggtagcatccagtccattgtgcaacacaggtaagaaaaccaggaccaatatacaatttactcaaatttatgtatggaaatacttatacataaaaaatttgaattcaaattcaaatttgaatcgggtaggtaaacttttgacttataaactttgagtctataagctttaggtgtataaactttatatatatagaaatactatatatagaaaatatttgaattcaaattcaaatttgaatcgggtatgtaaacttttgacttataaactttggatctataaactttaggtgtataaattttagatgtatataaatactatatataaaaaatatttgaattcaaattcaatttttaattagatataatttaaattcaaatttgaaacgggtatataaacttttgacttataaactttaggtctataaacttttgatatatagaaatactatatataaaaaaaatatttgaattcaaattcaaatttgaatcggatatataaacttttgacttataaacttttggtctctaaaccttaaatgtgtaaacttgaggtgtataaactttagtgtacaaatttactaaaataggaaagtaatgtggtacccaagaaaggaaaccagatggagggggaagaaaattctctgcggcgatgccgcatgacacttcatgtacaacaccgcgtagtctagcgacgcatgtctaagtttttactgtagcccgagttctttcgagccgagccgatgtccaatctctatagtcgactcaacgcccaggagctggttctcacctacgacctcatcgtggaggtcctgatatgcctcccgtccgtcactgatgtcggccgcgcatgcgcggtctgcgcctccttcctcggttccgctgcatcgtcaacgatcctgctttcctccgccgtgtgcgtgcgctccacccgccgacgctcctcggcttctacgactacgcctcacccgtcggggcgtcgggttccccctgccaaggagccccacccatccgccgccgccgccatctcccgtggcatgttctgtgccgccaacttcagcttctcattcgtgatatccttgacggtcgcttcctcctcggcatcatccaccgcattccccttctcaaacggcggagggcttgtgagcacactaattccaatcccaatgagcaccccattgtaaagagaagccaggatcaatattcaatatcgcttcaagaaacctgatatcttctcctcggttggagccttgaaggaagtgatattggtctctgcctctccggtgatgcgatgaattcgattttggggtagtccgccgcagagaattttcttccggtggagggagggagggagaggggatcgatcgctaacccacgatcgatcgcccattgggatcccccgttctattaggcctttacaatgcaacacggtgtcgttcggcttgaggcgtacacgtcgacaaatccggagaaatcggcgccacgttcgcaagtgaaaacgaagcaactcggtcttgggtgaaaacgaagctgcgcgcggctgggagaaagcgtggccggcgcgctgtggggcgagtggcttcgtgctcgtgcccaggcgcgcgccgcatcccggttttgccctcgccatcgccctctttcccgcgtccccctctttctcccgcgcacgggccgctttctttttcccctttccgcgtggtccatggttggaatcggaggaggatccagaggagtctgtgctctcggcacgacgccctccggcgacatgaccggcttcccctgccccagtggctcgccgtacagcagccatggcaatcacagccatggccggctctcctgtttttctaggattgggattatgttaagcacctaatcacccaccgcaatcacaagaaccaaaaaggaattggattagattaagcaccaaatcaggtagtgagatgcaggaagagaggtgaaacttgagcaagagatgaaaggtcacaagtctccatttatcaacaaataaaatgcaaaggattagcaaatggaagataacaagacagatgaagcagaccaagaactgaaagaggcaaaaaccaactttaccaaagaacccatgtgtagcagatgcaagaatctcacacggcgcagcaagagaccataccgaaaggatccaagacatgcacgggagtagcaaagaaagaaacaaagccccactcacatttcaggctttcagcagcagcagcagatagtttcagagaagcctgtgcatggctggaaccggagggagtggagactgtgccgcgtttggggatagccgctccggagccacgaagccactccggagcttcatcgtcggcgaggtcagactggcgtacggtggcgcgggaggaggagaggaaggagatgctgttaggaggaggcgatgagacatggttgtaccggcctcgtcaaagggcagtgtactagttgatttcgagggtacataggtaattttatgtgctgggacaaatcttggctccgtgggctaggccatgccacatgtgtgtcttcaaacataaatgactcggttttaggccacattgcattttgtagtggcttttgaagttctttagtctatttggcaccccaggctaaatatatatagtgacacattgctcttacccttaggatgttcaataacatcggtttgaatttgatgttgttatcggttcattcatgcgtatgtccactactttgttttggatggcaaaaatgtgagttattctgatcacaaaagaaagtcaaaaatctgatttgttctgatcacaaaggaaaattaaccagtcaataacacaatacgctccatatgtcactctctcttactattacttaaatcgatgagtatagattgcagcgtattggggttggatgcaactcgagacttggaatgttagatcgagacaaactcataagccacatcgctcgtagtagcgccgtcccaagagctgcacaacctgtgagacgtaccgcggctaccgccccgatctaaactcatacgagaacacaccaacattcgagaacccttatcggaattgctagattagggggaaaactttcaattttagaccattagatttgctttaagattcgtgctagcaaataggagaaaaaataaattagcaagtgtagctgctaaaatttgatctcacaccgttgagctcattgaggatctatgctaccaccgtgccatataattttttggatatttttattttagttacgtataaattatatacgagttacaatgtagttactttctagttatatataagttattataatatagttacactatacttacatttgaaagttttataaaaaaaaattgcgaagttttttttaagatagttctaataacacatatctcagtccatccgtagcacaacacaagcagttcacacgaacatgcacgccacgacagaccacacggaacaggcgatcgccgcagccgtcgagatgatccgcggcaacgcggcagccgaagccgaggacgcccggttggacgacttggacggctggtcgaacgactcgaaccacagcgacccgcggccctggatctggatgtcgtagtacatcatgtgcgtgcccgtctggatcaggctgccgaggagcgacagcccgccggccaccgccgtcggcagtatcgtcaggcactccagcccggtagccgtgtcctggtagaggtagttccgcggctgcagctccatgaccgcgccgtcccagaacacgagcgccatggcggggaacttggccttggccaggtactggctcgtgtagcacaggtcaaggccgagcgcagagccgtccacggtgtcggaccccaccgtgctgaccagctcccgccttagaaggtcgtaggcgttcttctcgagaaaggtgatgggcacggaggtgctgaggtacgcaacgagtgggtctcggccgcccgaccccgcacccaacatgttgaggttgttgctgccgactcgcataccggagagcccaacgaggtaaaggtagctgtaggcaccgttttcgtaggaccaaaactgagtgtaccggggattgctggtctgcgggacggcgtattcgccgaagaggatgaagcttgcgttgccggcggcggtgtcgtcgtattcaggggcgaagtagtaggagaaccgcccgagttgtagctgcgaaatgagggagagtctccccctgtttaagccgatcacgccgaagtttgtttcgggttcgaggccacacccgaaaatcatattgactggcatcgtgttgtcacctaacgtgaacggttggaggccgaggtgtccttccgtttccgttccgcccgcaccaccgtacctgcaggtgtatttgcatgggccattatacggtgcgccgcagtccggctgcccgacgattgtccggcagcgctgttctccgcatgagtaaagctcccggggcagcgtcttgtaaacgccggttttgtcgctggggcaggagtaggggctcacgcactcctcgcatggcacccacacgaactgactggagatgtcgaacgcgccgtagacatactgcggaggcgtgccgacaccgacggtgatgaggtaggttccgccggtggtggccggggcctgacttgggtcactgctgctgccttcgccctcgcccttgctggggatggcgtccgcggcgaggccggccaagtccgcggcatggtccttgaatatgtcccggatctgcttatttgcctttgggcttagcttgaaccgtggaatgaagccggaggagaccatttccggcgtaacgacgaggattagggaggcaatggcaatggcagcggcaacagcagggattcggtccgccattggaggcagcctggagtaccttttttttttgtgagaagttcaactaagctggaatgttctctacttctctgacagttgggaaaaccagagattctgtgtagaatgcgtgaccagagggcagagtctgttctcaatttatagcctgaacaaatgaaaacttatctactccacttcataataattaaatgctccgcagctttgctaaaatgcccccacgttaattggtaattgctataaacaagttgctgagtccttctctaagaagtctaacagacggcaacatgttcgacaaagaacaggtcaaccagtggcgcatcttgatatgagtggggccgaacttaagaggtacttacccattttatattataagttgtttgactttttctcagttaaaatttttttagtttgaccaagttcataaaatgtattgattattatatgcatacagcagtataggacttaaaaagtcgatctataatatggcctgtttggagaacgggaatggggtccccggttccctggaatagtcagggctccaaatgatgtgtatcacaacaagagatagacatataagatttacatatttaagagacgtacaaaatctatatcttcaagagacgtataagatctacattcagatcttaagaaaagtgtagaaacctacaagatctacgtatccaaggtaccgagaagagggtggagacctacaagaatatctccaaggtgtatggtgcttctttgacgaaggtaaccactttgaacccgttcattaacgacatcttcgagaagctcgtccaaagtaacaagaaacctgtaaagaagcaagaggaaatatccctggagacctgggaaactcagtgcgccaggcatggaaacaagccccatggagtggaggcaccctcaatgcgcaataccaatggacttggggccctaggcaggggcccgagcacacctcattgccccgggctcactatggggtttttttcacctcgcttggtgggccaacgggcttaactccaactcaatattattatttccgttgtaggagggagccgtttggagaacagctcatccacccacatcttagggacatgacgccgcatgtagcctcccgagaacccatgtctgccgaaggaataggtggggtggacatgcccctcccatatcactccagcatattcaatcttgccaccttgtaagagttgactggtgggcccaatggtgagaagatcaccttgcctctgcatcgtgtgtcaatcggagagcaaagatgtcacttcctgccatcttgctataggggacatcgacgaaacaagacacacccaactctttggaatagggcccgctcttagatgcaagttttagcactatgcacttcccttggcatataaaaggaggatctatcccaatgaatagaaggttgaatcttttagcaattagagctcacataagtcctatatctcatcgtaatacaagttcatcactgatagtctacatacacacaagagtaagatgttacgcatccgtatggctcaaacctgtatacttcatcacgtccatttgatcctgagggtgactcaggcttagactcgccccttgtccaaatcttcgaaagggggtcttgcttccccgatgtgggagttacatactgcgacatagcccatctcaatctcatcatccccaacatgataggaatcaaaagggacaattaaaccctagagtctgcatctgtctagacgcatgccgtatggctaggggtgacaatttccccgttagggtaggggacccgcccctacaggggcgggagagttctcacccgcgggtgagtggggacggggccccacaaaattctaggaacggggatggggatcggaattaacccgcaagtgacccggaggggtcccggatgtgagttacttctctaaaagtagcccattacaataatatagacccaacaatcccattcaaagttgacatataaaagctcaataccctagtcccctcaatcgtaatccctttccttccttcaatccacccacactgtcgagggttattgaaattttatcatactattatttagtgtattgcaatatttggatggagtattaactccatccagctgatgcggggacccggtcacccaccaggtcccctatgggggtagggacgggtgaagtttttcacccgacttcctttgcgaggccggggacggggatacctgcatgagggtggaggtgggggcattccaagccaacccggccccgccccgccccgttgccacccctacaggtcaccgacttgttactgaccttcctaaaaaaacttgtttagtgaccgatttactattctatcagaagaatgacttgttgatatttattcatctctagaataggagagagattgtgtaagacacctttatcgagagaccattatggtttttagacttctttctttttcatagagtttagtttgtgagattaatatagaggactgcctcggatgcactatggaaaacatttggtgtaaagtgttgcaatttcgctctctatcatattgttttagttttctggtttaatttatttaacatgttgaaaataatgctgtcttttcttttggcggtgaatatttattctataagatttgctgttttgcacccgctactgtttatccttttttaggcttggtttaccgtgtttcaatcctatggcttagtttttatttctataaaaaaggcactggcttggatctaattcaaaatggaattttgacaattatctgcaggcaaatgcaaaatttacccaaaacatagtaatatgtcttagaaaatgaatttttcttaacgtgtgtttagttcacgtcaaaattgaaagtttggttaaaattggaacgacgtgacggaaaagttgaaagtttatatgtgtaggaaaactttgatgtgatagaaaagttgaaagtttgaagaaataatttggaactaaacccagccgaactaaaagtagaggatgcattgacctccggtagttttcggtctgctccctttgttttatagaaaataaatctacagcccgttaagaaaaataatttatgaataaagctttttatacatgttcttagcgatctaaaagcaaaagcaaatgctgaaaaataaacttcgatgaaaaaactccaaaatcaactccaaatttaatttaaaaattcaaattttagatgataaagcataagcacaagtcaaaagatgatgccgctaatacagagatgtaacgtatcctaccacataaatctagaaaaagaatatatttagatttatagtattagaacgtatcatatatatctcgtgctaaattttttattgcccctgggaatttccatttcaattggggatgccgatagaggcgagactgaaatctgacataaatacagtcatggaaagacttgcaattggaagagtgaagtcaagagggtgtgtataattgagcaggccgacactgaaaataatgtcacttatgtctttcgtcctagtggtggttgggagatataggccatgtttacattccaatctttttcttcaaatttttaactttttcgtcacatcgaacttttctacacatataaacttttaactttttcatcgtattgttttaatttctttaaacttttaattttaacgtgtaactgaacacagccatattcgcggtaataataagaattaacgtgttgatcgagtaccgcttgcatggttagattcttgcatgccatcttgtcaactgtggatgccaattgattaagaggactggctcaaaaggtgatcgatcgttctcagctatagcagggtacacaaacctgcattgactacgtaattgacttggtccactatgcagattaatcgatctttttttatgaggccccttagattgtaggtggagtggtggaccataactactcttgtctataagaagatggttctatgaaaacggtttaagaaccataagcgaaaatcaattttttatacgagcctcttaaccgtagatgatatttggctataataaggtttttgaattattgacaatataaggaaatcaccttaatatttgatgtagaaaataagagagtaaatcataacgatgtaaatttaaattatgatagcgtaaatcaataaacgatgtactctcaacaacaggaatatgaaaaaaaaacatgatatcagtgtaaaccatgaaaataggcatatctaactcatttgcgcatatgaaaggaaccaacagagaagggaagaagagaacaatagcatacagtgatacaatagtggttgcaatggtagcagaaggagaaccgttgccgttcccaccgttgtcattgccattcttgccattgccattgctgttgcctttactgttcttgttctcgccaccagccatgattaaaaggaagtagtcgatgtagtcgcactcaagcacaagcgggcagtcgtgcaatgtgcttgcaaaaagcctgattcgcctcctctcggtgcaagatcaaggatgtgaggtttcggagccttgttctcctagtgcatatgcacacacactcgccaggatggaatcaccatagaagcaacagaagtggaagtggatggaaaatgtatgttctctctcatgcgtaggagatcaaatccattctcgttttataggagaaaagaaaaatgaagggtaagagactcatggaataggaagaaaaatagagtaactgattgtcatcaactagccatcaaccttcctccactgcactactatcaaccaactatcaattagatgtaatcaatgaatggattaattctcagaactcttcatctttaccattgataactcatgagagaatgaatacacataaatactagcatatgagccttggaatttatttgatatcattgatttaaatggatcaattgtccaagtaaatttaacaatctccaccaaatttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68315 - DNA, 1432 bp, Oryza sativa
attcctgcagccctacggttgactagtttgacttgtttactgataaaaacttttgaaattacgatgttttgatgaaagcaaatagtgtagttatatttgtcatgcaaagtacttgaacaataatatgatatcttcttaagcatttataaaccttttgaaagaaagatgaatatccaagtttatatatgaatagtatttggtgtcaaataaaaaggacaggagctatggagggagtaaaaaaattttagcctatgaaaatgtttttaacgtcggtgcatgagtgtgtcggtgttcatgggtccataaaaacaccgccggcaaagttagtgttattttcacatgcaggtatcctaagacaaccagtaaattaatttttacaagcgtgccttgactggaggagtcctatgcattctcacaaggatacattattttagtatgtttgttaaagtaaggatgatgtatctgtcaaaatggtattcttagtgaattagacatgttatactatcatgaccatatattgtatttagaataatcagtgttaaatcaaacatgttatatattgggaatacaatgaattcattttttagcatttctaaaatgtaataattataaattttagaattaataaataaatggagttgtacacatcttggacactcaatttaattctaaaactccaaattaataattaacaagttgttattgacatagaatcttccttttaatttaaaccatcacaaaggaatatatacttttgacatgttattagcattttcaatattaatttgtaatatcagtaacaatggcccgggcaacacatctagatgacgacttgcgaacatcaatgatgttaaggctctgtttgaggagaaggagatagaaaagattggaaagatacgcaaaacgaggtgagccattagcacataattaattgagtattaactattttaaactttaaaaatggattaatatgattttttaaagtaactttcctatagaaaatttttataaaaaacacaccgtttcgtaatttggaaatcatgcgcgcggaaaacgatgtccctttttcacccaatcccccagaaacgaacgcacctagaacaaacacataatactaagataacttcaggacatcaacaaaagatatagcttattagcttgtgcttggttaaggaatcagcaacaacctttttgttttcagaatagctaacaatagacttgtggaagattagtgtaactagatcagatatatgagtatatgatatctgaaaatcattgcattacgacatttccacgatacacaacagattaattgccgcacagccgacaataaccataccctttctgtttagtgaaagatcgatgacaaaagttgaaagttccgaacaagttaacgacacgtttgatatcaaaagcaaaagcaaaccattcg

SEQ ID NO: 68316 - DNA, 1640 bp, Oryza sativa
cataatgaaagaccaataataatccccgagaaagctactactaaatagtaccccaaatctccatcggtaaagtggatttacgcgtcagcatcttgcattgacgccccaataaagctctggggatcccctgagacgaacgttcgagagagggcatttagacctgcttatctttttgttaactttgtatcagtatcagccactccgtaccacggtaccaacggctaaaccatgtgccattagcagtaagatttatgtgtagaacaggtgaagttcgaattctctttaattaagtaaaattgtttactctttgtaggttgtcttaattttacgattactaccattatactcgatttgtaaacatagatatagttaaaagaacaataccagtaaaacttcagtatcagtagttattatcaatagttaagatgttactttttatctaataatactgttcattaaattgtagcttcaaataaatttgcttctagacttttgtcaaaccaccacgacaccgaacgtacgaagtagatgaatacgacacagcactaccgttcgtacaggaacaaaaccttcatccctgcgtattctttttagccaacatcaccatacccaaaagtcttaacgtcttaactgtgctcgatagtacttatcatatatattcccaagctgttaaattacaacaaactttaggaatgagtttatgaccaactaaccaaccaattgccctcttaaaatccattcaattaccagctcacaaaaggataccctccaaggttcatccacacgcacaaagttgcacacagagtttgaatccactgaagatccacagattcaaaacaaacttttgtgttttgtcagtgtccaagccttcccctcaaagatgccacctttgagccgcccacccactctccctccctccctccccttgctttccttgtcaattttgtactcccatctctctttgttattatcccctccactaatccatcaacaccttcttcttctttcttcttactccatctccatccaaacctctcttcttcttcttcttttgctttgcttttctcgccgccgccgtccaacccaagagagaagccaagagcgacaagcaaacctgcaagtctaacaagccaagaaatccgagagaaatcgatccaaggaggagggcggtgagccatggtgcggagcaaggaggtgcacaagaagcccaaggacccgctgatgacgccgccgccgtcgtcggccaagaagaggggtttccgggacgacggccgcggcggcggtggggggagcaggccgaggaaccgcgagggcgcggcgacgtcgctgacgccggcgtccgtgcctaactacatgagggggacgggcagctccgacgccaaggtcgggcgcggggcggcgtcgtcggcgtcgccgcggcggaggccggtgcgggtggtggcgagggggaaggtgctgttcccgaaggtgtcggccgccgccgccgccgccgccagcgccgggctgggcagggcgacgtgctcgtcgacgatgaaggaggccaagttccccgacgcgctcgacctcgcccccggcgccaccgacgccgagggccccgccgcgacgcgggtctgcccctacacctactgctccctcaacgg

SEQ ID NO: 68317 - DNA, 5243 bp, Oryza sativa
ctccggagcttcctcgcgtcgcgccgccggctcatcaagacgcagcagagcatgaagctcaggggcgtctccgccttccgcaagggcgccgcccaccagaggccggaggacaccaacggcgctggcggcggcgcgagggtggcgccgccgccgccgctcatcgacgaggaggcgctcggcgacttcttcgtggaggtgtacgccggcccgcgtgtgagcacggacatgagctgcagcgacatgtccctggacgagatggacgccacggtgaggaagatggagttcgtcgtcttcgaccggtgcggcgccgacgagtccgacgagaaggggaagaacgacctcgatgtctgcggcgacggcggcgacgatgacggcgaggcgaggccggaggagaggtttggtgccttcagagacagcacgtcggagtgcagcgacgcgtcgacctccggcgaattcgtcgaggagttgccgtggatcaggtaccaggggtatgaggatgatagcttggatggtgaattttcagacgaacacgggatcagagacgaggagatcactagagcagttgtttctgaatttcaagaagatcaagaagaagagggcacatcaggtagattgggagatgggtgcgaagatgaggctgctcaacaacaggaagaaaatgatgagcaaaacatctcagattttgcctgtgaatcggagatcgcgtcggagcatgaaggtgttgatttcagagttgaggcttgtgaggagcaggagagagtcagtgaagacaacatcctggatgcggcacatcaaaccgaggtttgtagagaacaagagatgcaagaagagaaaaactttgctgctgtctgcaaattggggattcctgagcaggaactagcagagacggcggataatatccctgatgagtgctgcaaagaggagacttcaatggagcaggacgaaggcggcgatgggaccaacatggagtctgaaagcatttcagaggttgccgagcatccgaatgtggaagatgaagagaacacgcaggatgatggtggatctgaaatggagatatctgaggagatcatctctggttttgggtgcgaagaggatttctccgaggaagtcacttcaaaatatgtctccgaaggtgaaatttctgactccggtgcgattgtttccctacatgttgaaatgcaaaaacaaccagtggagacccatgcctttgagcaagatgacagcagcactgcagacaatgcatttcatcaagatgacagcacagcagacagagcatttgatcaagatgacatccgtgcagatggctatgatgactctcagaaggaattggatattggaatgagagaattcagagttgcctccgaagaagttggtattcaagaagctaatagtgatgatcctgtggactgcacagaagatgctaacatggaactgggtgtattcttgtgcgacggcaagatgcttctgaaggttctggtatcgctcaagaaagcagccaagaaggtaactcggcatgctttaatgatggagctcaaatggtaccagatattaccacacaaacaacagaagatgcttctgaagaatctgataccgctcaagaaaccactcttgatgataactctacaccactcgctgctggtgcccaaatggaattggggattggcacaagtgagttgattgaaggctcttctgatgtcactgaacagtctggtattgctgaagaaacctgtcaagatgataatgctggatatttcagtgatgatgattctcaaaaggcaaccgtgataaccacatgccaattgcaagttgattatgaagaaaatgttattgctcaagaagctgatgataactctacaggtgtcagagatgatgctcaaaatgaacctgagcaaacatgtgaattggcaacatctgaagaatgtcattttacccaaaaaactattcaaaatcatggtgctctagaggaatccgtggttatcgcaagtgcatcagaagatgctcatgaagaatcagatcctactcaagatggtcatgaagaagactattctgtaggtatcaattctggtgctcagaaggaaggagagcttgacacaagtgaatctggaggtgcttctgaaggaactactgtgcatcaagaggatgatggacacgttaacaccacagatctgaatggcagtgctcaaaaagagattactgtctctatattagatgactctgaagaactttgcagtagtgaggaaaataatcaatcatccaatatgctaataccagagttcagcgataacttcagtgctgaagagccccagaaccaagattctgttgcaaaagaatcgtcccttgatgacatatgcaacgcattcagcgggatgcacctcaaaggagatgcatatcttgatcctactgagtccatgacttgtccggggaatagattgatcattgctaggaggaggagaacaccggaagaggaggaatatttgagaggttttaacccaagggctccaaattttcttcctcttgaactggacccagaatcagaaaaggtggacctcaagcatcagatgatggatgagcgcaagaatgctgaagaatggatgattgactatgcacttcggcgagctgtgaataatttaggccctgctcgaaagaagaaggtggagcttcttgtccaggcttttgagaccgtcctaccgcacgacgaggaagagaagaaaggcatcacaccaacaaggcctgtccaagcttgcaattgataattgtagaggtaagaatttttgacgagctctaatagttgtaacaaattcctaaatacattggcttcttacatgcccttttttgtttgtctattgcagttagtggtcgaactaatcaagatcttgactcgcgagctactaactcagtggtcgctgcagtattatcgccggagacctgcttgaagttgaatgagagaactacttactagtttactggaaatctctagtttgggttgtttttactgaggatctctagttgagtttcttaggagctcaaaactgctccacagggaaagataaccactcactgaatcaaacagattcttatctagttactgagctgcaaggtaacagctcaccagctaagtactgtaacgtgtgtataaatgtctcttgtgctagtgtctgatatttactgatgagtgatgactgagactagcaaaatgtttagggtggttgatgccttaacagagatgaatagaattcttctggagtgcagattggttctggagtatgatcatacatgtatgctagtactactaatgtgcatttgtaacataagcagctcctgataatcctgggattgccatgagtgcacattcatccattatgtccctactccctactcgtatgtgcttatgaaccaaatttctgaaatttggttaccatcgtcagtctacttcattaaccaaatttctgaaaaaaaaactaattccaatgaaaatcttgtaaaaattctgtgtttcaaaggacacagaactcctgtaaaattccggtgttctaaaggatcttgcgactgtaaatgtaaatgtttctccctgaaggggccatactggttgttcttttgtgcttcttgaaaggatgcttcaaccaatctaacaattgcaggtctaactgtacagaaaaaaaaaatccagaccaagtcatcggaatctgaatgagataaatccatttcaagcagtctcaatctgcgttgacacgacaacaacagatgggcctaaatcgtacaaggagaggcgcaaacggcagccgaccatggattttcctgacgtgacacgaaaccaaatatcggcattactctctactgtacgctgcttatccaaggtcaccaagggcgtgttatactctgcacaatttgttttagtttcaatttgcatctattttgctgtcagatagtttacttacatcttcagtaaaaaaaaaaaacttgtaggtagcaacatcatcatactacaatctagtttgagttatgacccgacttgagcatttttcatgcatttcggatgcattgttcccctaaagaaaaggcaaatactacttttgtattgtgttatttcacatcttggtatctatcgaattgaagatatttgacctacacctcaaatccgtagtgagaactgagcagcagactattacagcctcgtgatgctgaattttcgttggcgtattacagcagactattagcattgttatggccaaagaaagaaagaagattcacctttcaatcgaaaaaaaaagagtatgcttgtaatagtcacaggcaacagaaaaaaaaaatctccaactgtctcaggtagatttgctttctcagtaccatgaagaaagctcatcagatcttggcatcatacatggacttctgctatatatttttcaggccatctcaaatgtgcaccggcctaaaattgatgctatgcaggaacaaaattccttctgatttactgtcgtttgtgtctttcaagccaatcatctcatgaattcagcatcaataggagtacttgctaaacctgaatatacttggcattcacgcaacaacgatcttagttactactccctccgacctataatataagaaattttgaagggatgtgacatttttttaagtactacgaatctagagaaaaaatatgttcagatttgtaatactagctaggaagtgtcacatccctccaaaatcccttatattaatatattatgggacggagggagtacatatctttcaagaaagctttatatagccgaccataatccagtcatctacagctttacatgtcgactgtctttcctctcctgcctcctggatgatacacagtgcttatcctcaaacatctaaaatgcaccatccgcggaattttcttgcacagggctgtgcaaatttcagttttcctttacaaagatacaagccgacggttcgtgatccatggtcggtcaaaaaaggggaatttaactatttgccactttgcagttattttttttctcttcttaagagatgatttcttaactatttgtcacttttacccacgtgacataccaacatggtaacctagagtgaaaaatggtgtgagactcacagacccactcgtcagtttctccctcccccttcatctctcccctactcgtccacggcccccatcgacgccagcactgccccgccgctgaccaccgatggccccacctcgcggtcgagtacaaatgggagtggagtacgacgaggga

SEQ ID NO: 68318 - DNA, 2151 bp, Oryza sativa
agtatttggataatcgccaaactaaaagtggaaaatagttaaatttcccgtcaaaatatggagcgacgctttggaaaggggaaaaatacaaatacccctttatgaatcactggtcttttcgatctcccccctacaacttaatttggtacaaaacactccctacaagttttttttttcacttccaacttcccatctcaggccccataggtctctgttgtgatgaacgaagttgttccttgacaccaaatgggtgtactttgacctcctttcaccttttgctctttgcatgcttttattccaccagtggtatgacggtaaaaccacgacgacaaacacgtacatactactggtgtattaaatcctattcctaacaagagaaggcacatgggacatctttggtcaccacactagagatccaaaaatcacttaggctgagttcggatgggggagatggggaacctaactctcctgtgcacggaaaatggagcggtccattaacacgtgattaattaagtattagctatttttttttttaaaaatggattaatttgatttttttaagcaactttcatatagaaactttttgcaaaaaacataccgtttagtagtttgaaaagcgtgcgcgcggaaaacgaaggagaggggatgggaaaaggtgcatggaacacagccttagcgtgatgagaaaaatcacccaaaaaaactagatacaggtgggaagtttgaagggaaaatagacttatggggagtgtttcgcaccaaattaagttgtagggggagattgaaagaccattgacttgtaagggcttatttggattttcccccagtgaaaaccatcgttcgtattggcttgtatcttgggtccgttagcatgcaggtaaagaaacaatggtaattcgtactacctctgtcttaaaataagtgcagccatgagtttatgcacccaactttgatcgtccgttttatttgaaatttttttataattagcatttttgttctgataagatgataaaacatgaatagtactttactcgtgacttatgtttttaatttttttcaaaaatttttaaataagacgaacggtcgaagttgggcgcgaaaaactatggctgcacttattttaggacggaggacgtatttagttaagtccacaggctaaattaaggcatgtatatagttgagtttgggttgttgacttttttggggcccatgtcgttgacttttttctccctatcttagccgtgtttagttctttagccaaaatttttgtaagtatacgtacacatatttgaagtattaaatgtagactaataacaaaataaattacagattccgcctgtaaaccgcgagacgaatttattaagcctaattaatttataattagcaaatgtttattatagcaccacattgtcaaatcatggcgcaaataggctcaaaagattcgtctcgcaatttacatgcaaactgtgcaattggttttttttccacatttaatgctctatacatatgtccaaacatttgatgtgatatttttggccaaaattttttgggaacgaaacacacccctaatcgaacaaccagctttcttaatccaacagctacggttcaactaagggcctgttagttgaagggactaatccattagtccctaaaatcccaaacaggtgactaaaatggactaaaagtacattagtccattagggcttgtttggatctatggactaaattttagccctgtcacgtcggatgtttggatattaattagaagtattaaatgtagactaatgataaaacctattccataaccttagactaattcgcgagacgaatctaattagtctaattaatccatgattagcctatgtgatgctacagtaaacatgtgcgaattatggattaattaggcttaaaaaatttgtgttgggaattagctctcatttatgcaattagttttattattagtctacgtttaatacttctaattagtgtccaaacatccgatatgacaggaactaaaatttagtccctggatccaaacaccaccttagtccctgtgggaggagcttataggaattaaaatcgtttcttttccccactgctcccgcgcacacccctatcctcccattcctcgtctctgtctttgctccactc

SEQ ID NO: 68319 - DNA, 1072 bp, Oryza sativa
attcctgcagccctggccaactctccatttgatttggctagttaactagatggtcactctaacaaagcgcctcatcggatggccaaatgctttggctgatcagccaaagctgcctccaattcggctaaacttcaatgcatattggttagcttattttgcttaaatggctatcagcgaaagcatttggccaatgttcgctaattaatactgcgtcttccaaattgtaaccttcccatggcatataagctactaatacgttttttcctaaagcaagttccccaccaaccgtagcagccctctgatgaggcccagactctctattaatcctcttcaaaataacaatggacccacatatctctttccttttttcccccaaaacatccttcctatcgtcgaacaccacgcatcgcaccaccaacgacgacgatagaggggcggcgccggtggaggggcagcgcgaaggggcggcacggaggggcagcaccgacggaggggcgatgttagcgggagcggcgcgagcagcggggggatagaggcagcgccggcagaagcggtgcaaggatgtaggcggcgccggcgggaggatggcgcgcgcgccaatctggagacgccaccactggttcgctgtccctcccctccctccttttcctcttcttcagcacggccatcgcggtggacatctcgcaggcggcggcggcctcggggtgcctgctgctacgccgcccggcagcgccagggctcgtcaacattgccgtggcaagggaggaggaggagcggaaaggcgccgtgcccgtcgtgctcggcggagatcgtcctcgtccacggcatctctgcttcgggagaggggcaaaaggtgtggggcctaccattggagaggccattttggatggccaaagttggccagcaggagggggagtttagccagccggatggctggccatctagttggcaagtttgttagagtgtgtttttcgttcaaaattgctaaattttaacttggagagagagatagagatgcggttggagatgctaggtcatactcttcagcctaattgcctcccaaacaaccagg

SEQ ID NO: 68320 - DNA, 968 bp, Oryza sativa
attcctgcagcccttatgagtttgtctcgatctaacattccaagtctcgagttgcatccaaccccaatacgctgcaatctatactcatcgatttaagtaatagtaagagagagtgacatatggagcgtattgtgttattgactggttaattttcctttgtgatcagaaaaatcagatttttgactttcttttgtgatcagaataactcacatttttgccatccaaaacaaagtagtggacatacgcatgaatgaaccgataacaacatcaaattcaaaccgatgttattgaacatcctaagggtaagagcaatgtgtcactatatatatttagcctggggtgccaaatagactaaagaacttcaaaagccactacaaaatgcaatgtggcctaaaaccgagtcatttatgtttgaagacacacatgtggcatggcctagcccacggagccaagatttgtcccagcacataaaattacctatgtaccctcgaaatcaactagtacactgccctttgacgaggccggtacaaccatgtctcatcgcctcctcctaacagcatctccttcctctcctcctcccgcgccaccgtacgccagtctgacctcgccgacgatgaagctccggagtggcttcgtggctccggagcggctatccccaaacgcggcacagtctccactccctccggttccagccatgcacaggcttctctgaaactatctgctgctgctgctgaaagcctgaaatgtgagtggggctttgtttctttctttgctactcccgtgcatgtcttggatcctttcggtatggtctcttgctgcgccgtgtgagattcttgcatctgctacacatgggttctttggtaaagttggtttttgcctctttcagttcttggtctgcttcatctgtcttgttatcttccatttgctaatcctttgcattttatttgttgataaatggagacttgtga

SEQ ID NO: 68321 - DNA, 1850 bp, Oryza sativa
attcatcaaaccgtctagctgcagtttgtgtctagactttccgttcgactagatgatgatgagacgcagtcaatgacgacgcgcgccctgaccccgaccgcccaaccggccggcgagcagcgaccgccaagctaggtcgagcgcctgcctcctcgacggctcgactcgtttgactgtaagttgagagctgagactgtgagtagatcgtaaattcataatttgaatcaaattacgattgccataacttgaatggtcgattgaatcaaaagtaatgtgaatgtttgattcaaattaaattatttttcttttatttataaaacaggaagatgcttatttcctcaattcttattatatatatcatgcctgctagaaataagaagtatgatcctattgctgaaaagcgttagaagagatagactagaagcagcaaccaatatcaaaccagatgctagtgttgatgatggtcatggtgatgatgcggtagatattgaggctaatgctggagaagattaattatgaaaatatagtagaagatttcattccaagaaatacttgaaaaatgatgcttttttagaaattactatatattggaactagcaatatatagggtcagattaagttcgggtggagtgagagcatacccaatctgagactcaaaacacctatagcacatccatgcctaaaattttaaccatgcatgcctacactcgttgaataccggttatccattgggtacaggtgggttttctttttacgcatttactgatacctatgggtttttcaacaacatcatgtaatacatctattcataggtatagaacatcacaattactagctagtgtaaaaccacaaacaatcaataacataagttactgtaattcgtaactattaagtatataccaaaatccataattctacacctataagttagttcaacatcaaataattattagcctattactttgctgcacttattgaatgttttatttagtgttgacacgcaatcttccaaaaatcaccaatgaacatgtatgttggttattcatgggttacacagtgatatagaataaaacccacgacacgtccgaaatatctctatgtgaaacaagtagaacttttttttaaggagccatcatcatgtacttctgtattgaaaatcttttttaaagatttgaaatacaaattactccctctatttcaaaatataacttctaacattcaaaatttgctccaaattataacaacttctctatctacattatattctcaaccaatcgcaaactcctgacatttaattccatatactttcttaatacccacgtttaagcttaaaacttcctatattttaggacagaggtagtattctaaaatattattatgtaaaatatcaataaaatattctggtcgctgctacaatatgctccccatcaacaagtataggcattcctactagaatttgtccacgctactccaaaatgaatttttttttacatcttgcttttttttacaaacagactaaaagacgatccgcgtgtaaaaaggtttgagaggtatctagtaaagacaagtatgtgaaattcatggcataaatataaaacttcatggcacatttttactgttcatactttgcatcgaccccttccttatattattcttcttactaggaccgcatttaatgatcgacattgttgcaaaataaaacctaaattgtttggctttccttccactttaatctttgctaaaaggcgataagggtgcttatatttatgagtggagggagtagaaatctagtgaagtttagtattcatcactaattacgtcactttgagcgtgggttaaggtagagggga

SEQ ID NO: 68322 - DNA, 1250 bp, Oryza sativa
ctgcggcgcaccgtataatggcccatgcaaatacacctgcaggtacggtggtgcgggcggaacggaaacggaaggacacctcggcctccaaccgttcacgttaggtgacaacacgatgccagtcaatatgattttcgggtgtggcctcgaacccgaaacaaacttcggcgtgatcggcctaaacagggggagactctccctcatttcgcagctacaactcgggcggttctcctactacttcgcccctgaatacgacgacaccgccgccggcaacgcaagcttcatcctcttcggcgaatacgccgtcccgcagaccagcaatccccggtacactcagttttggtcctacgaaaacggtgcctacagctacctttacctcgttgggctctccggtatgcgagtcggcagcaacaacctcaacatgttgggtgcggggtcgggcggccgagacccactcgttgcgtacctcagcacctccgtgcccatcacctttctcgagaagaacgcctacgaccttctaaggcgggagctggtcagcacggtggggtccgacaccgtggacggctctgcgctcggccttgacctgtgctacacgagccagtacctggccaaggccaagttccccgccatggcgctcgtgttctgggacggcgcggtcatggagctgcagccgcggaactacctctaccaggacacggctaccgggctggagtgcctgacgatactgccgacggcggtggccggcgggctgtcgctcctcggcagcctgatccagacgggcacgcacatgatgtactacgacatccagatccagggccgcgggtcgctgtggttcgagtcgttcgaccagccgtccaagtcgtccaaccgggcgtcctcggcttcggctgccgcgttgccgcggatcatctcgacggctgcggcgatcgcctgttccgtgtggtctgtcgtggcgtgcatgttcgtgtgaactgcttgtgttgtgctacggatggactgagatatgtgttattagaactatcttaaaaaaaacttcgcaatttttttttataaaactttcaaatgtaagtatagtgtaactatattataataacttatatataactagaaagtaactacattgtaactcgtatataatttatacgtaactaaaataaaaatatccaaaaaattatatggcacggtggtagcatagatcctcaatgagctcaacggtgtgagatcaaattttagcagctacacttgctaat

SEQ ID NO: 68323 - DNA, 2613 bp, Oryza sativa
tgttgcattgtaaaggcctaatagaacgggggatcccaatgggcgatcgatcgtgggttagcgatcgatcccctctccctccctccctccaccggaagaaaattctctgcggcggactaccccaaaatcgaattcatcgcatcaccggagaggcagagaccaatatcacttccttcaaggctccaaccgaggagaagatatcaggtttcttgaagcgatattgaatattgatcctggcttctctttacaatggggtgctcattgggattggaattagtgtgctcacaagccctccgccgtttgagaaggggaatgcggtggatgatgccgaggaggaagcgaccgtcaaggatatcacgaatgagaagctgaagttggcggcacagaacatgccacgggagatggcggcggcggcggatgggtggggctccttggcagggggaacccgacgccccgacgggtgaggcgtagtcgtagaagccgaggagcgtcggcgggtggagcgcacgcacacggcggaggaaagcaggatcgttgacgatgcagcggaaccgaggaaggaggcgcagaccgcgcatgcgcggccgacatcagtgacggacgggaggcatatcaggacctccacgatgaggtcgtaggtgagaaccagctcctgggcgttgagtcgactatagagattggacatcggctcggctcgaaagaactcgggctacagtaaaaacttagacatgcgtcgctagactacgcggtgttgtacatgaagtgtcatgcggcatcgccgcagagaattttcttccccctccatctggtttcctttcttgggtaccacattactttcctattttagtaaatttgtacactaaagtttatacacctcaagtttacacatttaaggtttagagaccaaagtttataagtcaaaagtttatatatccgattcaaatttgaatttgaattcaaatattttttttatatatagtatttctatatatcaaaagtttatagacctaaagtttataagtcaaaagtttatatacccgtttcaaatttgaatttaaattatatctaattaaaaattgaatttgaattcaaatattttttatatatagtatttatatacatctaaaatttatacacctaaagtttatagatccaaagtttataagtcaaaagtttacatacccgattcaaatttgaatttgaattcaaatattttctatatatagtatttctatatatataaagtttatacacctaaagcttatagactcaaagtttataagtcaaaagtttacctacccgattcaaatttgaatttgaattcaaattttttatgtataagtatttccatacataaatttgagtaaattgtatattggtcctggttttcttacctgtgttgcacaatggactggatgctaccccatattttcactttaatacatatgaagttaccaaaactttcatcttggactagtggcccacatatcatgtagaaagtgttttcttccatctctcccgtcttcaccgacgaatgcatcaatctcatcttgggcccgtggttagtgaccagcagtccagaatgagtgcagctttgttggtgtgatttgcttggggttccaattgaagtccgatcttgagcaacgcaggttggccaatggatggaccgagatcgatggagcgccaggctgtacgttgtacgtgccttcacctgtcaagctcgaggggcgcccgcactcgtctcccagtggcagcgccaacgacagagcccattccatctcgcgcattgcgtcagccggtggagcggtcgtcgacgggcacaacctatggagccgacgagcggtcatcttcaagagggagggatgcagggcagagctgcagaggacatgccagcggccactcgatgttcgtgcagcctgctaggctgctacttgcttggcaaattttaaactttggggcgaagagatgagctctgcccgatcaggatagggactaataaaagaggaagatgaatggctgaggctaacatgtgagtcaactagtccaaattgcatagtttggtaacaaaacctggttcaaagtgaaaatggttgtacgttcctagtccagtatgcaacttatgtaattaaaactagtccaaagtgtaattcactccataattttttctaactttttgttttttttaaaaaaattttatggtgtactgtagtaggaagataagaaggggaggagggaggagtgtatcgagtagtataggggagagggcaggcaggtgatcgctgggcggacaggggagcgatcacccgcccattagcatttccgtaatagaataatgttttatgaaaaaactaatgaactttttttgaacgaaaaattaatgaacttcaagtagcgaaggaaggtaaaatagagagtagctttcacgaaaccatgttcaccaccagcacgagtgcacaacccaccccacgaaacaggcgatcgtcaccgccgccgggaattaaattaaaggccaaaacaaacactgtacaacaaaagcgggaaaagcaaaacaagaaaaaccaaaattacaggagataagggggaagagaaaaaagaaagccacacagggaggat

SEQ ID NO: 68324 - DNA, 1866 bp, Oryza sativa
gggacaagggtggcagcaggccattttggataatggcttgcactgtgcagtttgacttagtagagtgtgtgtagagagcttggaatcttgaggcaagaggctgatcatccagccaaatgtcgtgccagaaattgttgcgcctgccatctcggacaaccaaattagtttgagatctgagaagtggaaacagggcaatcaaggatcgccagtgggggcccagggctgaatcagcatgctccctccatatccaatttgtccagggtgaattctaggtgtacagtctgtaaagcatcttgatgagaaggcagatgttttgtgtgtgaaggcgtttgattccaaggccaccttgctttttgtctatgcagattaagtcccatgcaatgaagcatttcgagccgtgacatgattcctccccagtccataggaaagcccgacggccattgcataggtcggtagaaagtctagcactgagttcaccaagaccgccctgcctgcatagtttaagagagaggcctgccaccccgctaggtatttgttaacttttgctatgagtggttgaaaggcagtgaggggtagcttagtagctgatagtggcaaccccagataagtttgaggaaaagattctagcttgcactggaggatgtctgctaattctttgctggcttctggtggagtgtgaagggtgactagggtacttttgctgaagtttattcagagacccgtggcctgtgcaaaggagttgagaattgtttttagagcacttagctgggaggcttctgctgggcagataataagtgtatcatctgcatattgtagggtggctcctagcaggttgtgaattattgggtgcttgatagcactgcaattcttgatcatctactgcaagatatcagcaaccagaatgaacaggtagggtgagagtgggtcgccttgacggagaccttgagtgcagtttatccatcttccagggatgccatttagcaagacagctgacttgcttgaaattagcagagcttggatccacttctgccatcaattagggaaatttctagctctcagaatagcttggaggcttgaccattgcactgagtcaaaagcttttgcaaaatccaatttcaagacagccgtaggcagcttacatttgtgacaacactggagaatttctgttgcatatagaaaagtttcgagatgcttctccttttcataaagcctgtttgctcccagtctatgagactgccaagaacggattgtaggcagttagcaaggactttcgacagtagtttgagatggcagttttgcagtgagatgggtctataacaatatggggagtttagtttaccgggtttgtgaatgaggactatgtatgctctgttaagtctttcaagctgggcagagtggttgtgaaattcagtcaacaagttctgtatgtagggcttgatttgctgccatgctgccttatagaagcttggaccaaaaccatctggacctggggcattgtaattatccatgcagtccatgcagactttgcttcttgaagagtgaaaggttccgagatctgctgctagctcgcattgtggactgtattctcagggtagagatcttggagatgaaaatcccaggtggtgtttgctgagccgcccagagtttcgtagaagaactcgtaaagcgcatctgccttggtgtcgtggtcgaaaacctgcgaaccttgtagcaggagggagtggatgccattgtttctgaacctgtgtgacgcgtgtgcatggaaaaatttggtgttctcgtcagaggctttgattctcttgatcttgctgcgttgcttccagtagattgctttgcatcgatggagatcagctaacttgtcttgaa

SEQ ID NO: 68325 - DNA, 1588 bp, Oryza sativa
gctcatacacatcgaggaaagatgaaaggctgatgcgttgacctagctcgagttgcttcggccttccggtgatccagttcatcactggctcatagaaggacgaccgggtccaggcctcaagggcgatgaacttacctagtagtagaacctaagatacaatcccaagacaaacacttccgaagagtgaagctaaggaggggatacttgagtagctacagctagtgataagtaaggctgaaacattcaaagcaaaagaaatgcttaattttatatgccacttgtctttcgttttacctcagaattcttcggtatattctcgcaagtcggcaacaataggaagatggacgtgctggccattgcatgcaagacacagccaaggttaggttcatgcatcgtaacgattggggatgaaaattaataggtgaggacgcgttcaaaaaatgatcaattgctcaattgttctcggcaacataaactgtaactcgttgaccacgttgatcgtagcttaatttgatccaagttaatagggaagatttacctacatttgtcgacaaattttctctaaaaattgacaaatgtaactataacataatcgttgtgaaattacactctaacttacatgtaatttgtatggaactttcaaaaatctctttgtaactgtcagggttacgggttcggcataccctttacccttcgatatacgttgcatatcgatatggcatacccacgcgcatgcggatatttcctgtatattctaaggaaacctttcgcgtaatttacagtagggaagaatcctacccggacagaactgggtcgttgacgtattgtatagggtctgatacctccaagttctacttggagaccaccagatctgcgatataaaaaggaccccccggggagggcttaagacatcgaatctcgaaaccaacacaacccacacagtctacgaagccggagcctacaaggagcaaagccattgagatccagtcgaacctactcgactaagatctcgctggatccgacaagttccatcgttctctttgtaacctgtgttttccaccatataatcccacatcaactagattagggctattacctatcaaggggcctgaaccagtataattcttgtcttttgtttgctcgatgtcatactacgtagatccttgtaccaacataccccaataccctctatatccggtctacgggtatcacccgtcgacagtaacatgctatttcgataaaaaccggaggttttgggaacgaatcctcccacatatgtacgcgcagtgacttttttctttctccactcatacaaatcttgaagaaatctaacggttcaaaattatgtgaaagttatatgcaaattatattatagttacatgcaagttaacagtgtaataacactacgattatacgattatactgtaattatatctattaaatttttaaaagaatttatcgataaatatataacaaaattgtttcggatataggtccactgtaataggttgtcaactgcgagccgatataaagcggcggccacaagacgacatccaaggcccgaggatgggattcgatcgagtcgtgg

SEQ ID NO: 68326 - DNA, 1277 bp, Oryza sativa
gatcgatggtctctttggactctgattatcttaagccatcaagggcatgtatgcccgcaccatctcgatcgtttccttcatgtggatcataatataatcgatcaccctcggttattttttttctttcttttctttttggttgtgtgctatctgctattatctaataatgtcatttgtattagttgctggttaattttgctgtaattaaatatattgtttttaattattcaatatgcatgtaacggactatatatgtatgtataattaatccatgcacatatttttgtaagctatatatacatttgtaagatttgcttctatactcctcgaaaaaataaatgcacggatgtactagacatgatccacggcgtatattggggtggcccaatatactcaacggcgtattactatttcaaaggggtaattttatcttaggaaggagttagtccatactccgctctgtcccaaattatttttatctttaaaattcaaattttgtcctaaaatagttgtcacaataaactactacttgtcccggtccatcaatcacttctaattcaaatttctcttttctctgcccctaaccaccctcttatatccaaccatataatatttaatagagggtacaatagtttttttctcaaatcttaacctatgctaaattatctagaacgacaactaatatgggatggaggaaatatctatttattttctctcaccgcactagctaatctctcgacaagagtaccgtctcttaatcgcgtcacctgcctccctttcttgctctggaaatacgttcctcccggctggcaaccatgcatcaagaggagcaattaatcaccttagtttcactaattaattagcctccagcgagttgtttgcctttgccatgggcgagtcagatatgatcgcagtcgaagcccagaaggccagaacgaagtggccgaaagcccgaaatccgtccggtttattagcctcatcaccgatttcagctgcaagcaacataacatatatacatatatacatgacccttcccccacccccaccatgactaggacacgtggcgtgcgtagagcggacggcgcgccttttcctttttttttcttttctgtttcttttcataatttatttcttgtttttttttttagtttttttaatcgtatatatacaaactttgtacatgtgtatatatttttttatacattataactgtatacatataaaaaaattatatatatatatatgtatgtttgtttatatacatacgtataaacttt

SEQ ID NO: 68327 - DNA, 1658 bp, Oryza sativa
cggtagaggaaacttttttgataaaatgtatatttgaaacgtggagcaactaatttgaaaaagctaagaccctatttagatgggactgaaacttttaagtctctatcacatcggatgtttggacactaattataaatattaaacgtagactattaataaaacccatccataatcttggactaatttgcgagacgaatctattgagcctaattaatccatgattagcctatgtgatgctacaataaacattctctaattatagattaattaggcttaaaaaattatctcgcaaattagctttcatttatgtaattaattttgtaagcagtttatatttaatactctaaattagtgtctaaatacagaggctaaagttaagtacctgatccaaacaccacctaagcctgggctcttgatgtctagctatgatgaaaaaattattttacacatatacatcttccattgcagcagcaacaacaacaataataaaattttactcgtagtcggccctgcaccctattcatagctagctgattttgagtctcaaatggagacacgatgagaaaacagtcttttcatcattgagattatcagattattagcaaggcttttttttccctgagtcgtcttacactgttactaacgtaacttaacgtaaaggtgcgtcctagaaccattttaaccccaaaagctatcttaaaaggactgatttagacaaaaaaaaaatgctgtagtaaaattcaaggaccaaagtaacacccaggactagggatggaaatagggcgcgacgggcacgggtagtgtctacccatacccatgcccatgagattatttgtgcccgtgggtatactcattactacatgacgggtaaggatggttgctcatgcccattgcccgcgggcgccttgtgcccgcgggcgtgcctgtttacccgccacaacaaaagcagtggaacaaaaagtctacaagcttctaagtttgaattgaacttaaaacatcaaatattctccgcctcggtgtggtgtctctcctctgacggcgatagagtaaggggaagagaaataataagggaaataaaagggaaaccgtagaagaacgtggcttatgtattctagtggattttgttcctagcctacatgtaagttagacttcgcgggtaaacggtcaaagcgggcatgggtagtgattacccatacccatacccatctacccatcgggcataacttttgatccaataagatacccgtaggtataaaatagagaacaaacctaactctaatagagtttttacccacgggtaaatgggcaaacgggtacaattgccatccctacccaggacaaggagagggtccagtgccctgccttcccaactgctgatatacgagcgaaaatgatggctctgtacagttaatctgtactcctgaaaataacaagtgatggtggaccgttagtgcatacaccctccgtcccataaaaaatcaagttctaagaatgaatgtggacaaatgcttgtccaggttcatttccagaaattatctttttttttggacggagagagtacatcatttatatactccatccgttctataatataagagattttgggtggatgtgacaaatgctagtataatgatgaatcttgatagactaatataatg

SEQ ID NO: 68328 - DNA, 3375 bp, Oryza sativa
aggcctcgatgtgatcgcacaacctatgagattggcccaatccgaaatacacaccgtaatgcaaatgaataagtcgacttatactccctcaaatatagttttaatctgattcgtatggatccctcaaccataatattaaatatcttgaccatctaactattaaaaataatgcaatttgactcccttaacagtttcaagagcgttttttactgacttagcttgttgactagtctaagtggttgagtcaattttatgcgggacccacatgttagtctccgttcctcttcctcctctctttttctatctgcggtggcaacatggagaggccgatgggaggaaggatgaatagggaattggtaccatatcttcggaaacgatgctcgatcgatcggtaattgatcatatttatcatttaaattaatcagtgtcgacattactactatgtagaaagaaattaaaaaataaaatttatgtataacaaaaaacggctttgctaaaattatgtcgacatatttctgggctaaatacagtcagtttgtcgatctgccatctaatcttctcactattcgtgcaagtacatctgataagctaatcgaacaacttgctcctaagttggcgactcctttttgctttgcatgacacgtgttggtcatcaacgaatgtaattactctatttacacagtaattacacatgtgtaatttagggacttacacatataattttagtatttacattgtaaatattctaaaattacatatgtaatttagatacttacatatgtaatttcgagacttacatcgtaaatatactaaaattacatatgtaatttaggaaattacaatgtaaatacatactgactattttttggtgaaaaatatggcgccataaatatagctactccaaaaaaaaataatggtcggaaacggtaccccttatacgaaaacgatgctcgctcgatttgaaatttccgtgacccattttcactcctaccggtgagctcttggatgaccaccacactccctccaccaacgagtcgataacgagttcgctgttaccaccgccctacaagagcatgatttttcctgtctcgttgccgccaccaccggcatgctcatcgtgcgtccccgagtcccaccgcctgcgccaactcgatgtcctccgcggcggcggcgtcgttgcacccgtcatcatcgtcatgcccggcgactcggccagacacgaggggcgccagtgcgccgcccgtcgcagccatagaattcgaagaagcagtctgaaaaccggcgtggagagatcattagttcagcatcgtggaatgctagaattcagttttgcagtgcagtaagaatgcaaatgtgctagtactactagagttttccacagggagggaggcattactgtgcaagcatatatatatatatatatatatatatatatatatatatatatatatatatatatatatatatatatatatatatatatatatatataaagcagtggtaaaatcgacattaaaaaaaaaggaaacaacaatttagaagttaaagaattaaacataaattcgagattatttcagatatttcgattttttaaaaaatgaaattcagacaaccctttatacttaatgagaatgccatatgtatccgtacctccaaatactttagaaatttggtaaacggttttatctttgacatgggcctagcccagctgaagacaggctctcagactagcctgcctaacagctggcttacgccggcccaaaagacaatactattaaataagttttgatttttatctacatactaatcaagtcaatatatctgcatactagtcaaatatcaattcttcagccttttgtttcgaggaacatactaatcaattcgtcagtggagcaaagattgaagcattcaagcatatgcttcctgacttttataactggaaggattttctcaaagcaacaaaagcaaccaagaatattggggaaacaaggaagagcatgtacgggatgatctgatcgatgcccatctcaggttcgtctagggcagcgtagtagttcttctggcccccaaacttgtcgaagtacttctcgtagcccgtgttacggggcaaaggggagctgttcaccttcatgaagtccatcgccttcagatgacagcaaaaacgattagctcatagtcagtgcctttcaaggatgggtcaagatgatatatctaacttctgcattgtcctcagcctagttgagtgctttagtcaatagagggaatgcataagcatttgagatgcttacctgaaagctgaacatgaacatgtttgctttcttactgatttcagaatttggatgatttttgagtttgctgtacatgctcatggcttccttggacctatcaaaacaagatatttcatggaatacatgtccagaaaatagagagtttatgaacacaagatgcttcacaaatttaaaaaatgcagtgaagcagactgatggcaccgatgtttccatcaaaatatgcaacttaagtccaactatgcatgtgaaaatatgcaaattaacccattccattgcatagctacatgtgaacatgtgcacgcacacacgtacaattacaaaccatagaagccattaattttatagagtggaaaaatcctagttttagtaaaaatagggattatgaaattcagtatgttgctgtgcatttaagtcaaaacaggtgtatatgtggtgaaaaacatcaatgcaggggaaggacatagaaaaacaaaggaaaatacctgcagagtgaatctagacagatggaccactgcaaagcagccattccatgaagttcagtctgcgcaatttattttgcgcaacatgagtaaaaaaacatggtataaaaataagaaaggacataacagtgaagcagcaatgcaaaaaatttagaactgcatatacttgagaaataaaatgtatccgaattaatgcatctaacaggacaatatgacaaaatatcctatcatggtgtttctcatgtgatagattaccaattacgtaatggaataccttgaagtccacagcctgcatcactttttcataataaggcaatgcttgtttaagtcttccagtattcatcagctcatcaccttccttcaaggccttcagcatgtaaagttcgctgttatagatcatactaacgcagtgcatatattcagagacaactctaaactacactaacaccaaacttcaaaacttgaatgtgatctggggaaagcattttccttgggtattctaacagaaaggattttaaaatcagcacgttcaagtccataagatacctatcaggtcacctgtctgtagatatgaccatcatcttggaattaactaggtcaatcataaa

SEQ ID NO: 68329 - DNA, 1239 bp, Oryza sativa
gagcgccacgtggatactagggacaatctcttccctctaagcttggtatcactgggcccatatcaccaacataatcataaaaaaaaattcaaataagatggacaataaaaattggatacggaaactcatggctgcacttattttggaacggagggagtacaatactacaatagcatgaggacttgtcgagcaggccatggtggtcttagagcaagtttaatagtatagccaactatcaactccaaatcatctatagtcaatctaatagccaattcatatgatagttaactacaaatatatactacatcattaataattagtcccacctgtcatatacacacattgtcttggagtctgtattgcagctggctacaaatctgtagcccgcttctcttctctctcctctcttatctcctccacgtgtgcttatagctgacttatagtctactattgtacctgcttttagaggatggccctagcaggtggggacatcgagatggatagtttcctcgctgtcgtcatcgaggttccgcatatgcgcttcgtcgtcatcggcaggaagtgagctgcccaagccatcactcaccactcctcttcatcgcaggctgccccttgtcatcgctcaacccgtgcgcctccgcctcgtcgtcgttcaacttggggttgttgccagggttttgaaatttcggttcgaaattttcgaaatttcagtaatttcgccccccaccggtatgctcaaatatcgcccgaaatttttgggttttttttgcaattttttgtgaatttgtcaaattttattcaaattcattcaaattttcaactaatttcggccagaaatttctgaaatttcggtcaccgccagcataaagtccaatttcaaaattaaaaaccctggttgttgcggagacagccttcgtcgctaaggaagatgcaagggataaaagtaggggtgggcgttcggtctacccaaaatttcggtctcggtcttcggtttttcagtcaattcggtttttaaaaagtcaggaccgaatttcatcccaaaaaaatcaagaccggtctcagttttttcggtctcggtctcggtcagatcgaatttagaggagccgagccggagggcggagacacgctggcgatgtcgaggcggagggcggaggtggcggcgcggtgtgatggatccggcggccggcggcctgcgcgaccggcgaggcggcatggaggcggagggcggagacgacaccg

SEQ ID NO: 68330 - DNA, 4142 bp, Oryza sativa
ggaagggagggcgacgcgatggctggatggatagggatgcagcctgcgggttgtctctagggtttagtggtgtattgggcctattgggcctcctggacctattgggccacaattcggttttctcggttaattcggttaactgagcccaagaaccgaattacctgaacaaatttcggtctttgacatgctgagaccgaattactacccgaatttctcggtctcggtcttttcggtttcggtctcggtcttttcggttcggttcttcggttcggtcttattttgcccacccctagataaaagagagggagagaaggggacgctgacatgtaaaccccatctgctgagtgagctgatagaactaggtcaataagctacgttattactccgattcaaataaagtactacttcctccgtcccagaatatagcaacctaagatcgaatgggacgtatccccctatctagattcgtagtactaggatatgtccaatccggtcctaggttgctatattctgggacggagggagtagcctactaggcataccatgataactgaacaacaccctcaaaccgattttacataatatcataataaaccacgtttgttgagaagaaatggaattgaactactataatgcatcctaacagcaaggaaaaaaattaaaggtaattaaaagcataataatagtagtagtagttgtttcaggagaccacgttcaggcgttcagcaccacaaggcaccacacgaaacatgccatcgtcaccaccgcgaccgcgaccccccgtggctttggctgcgcggtagccgatgacgtcggattggacggcagatcggatgactgggacggcggcggatcggacgtctggaacccgagcctcgacttgtggaggtcgtagatcatgtacgtgcccgtctggatcatgctgccgatgagcgacaacccatcgctgtcgtccggcgacggcggtatcgtcaggcactccagcccggtatcctcgtcctggtagaggtagttccactgctgcagcttcatcaccgcgtttcccccgaagacgaacgctatgtcggggatcttcgccctgtccatgtgctggcttctgtagcacaggtcaagcccaagcgcggagccatcctccgtgttgttggaacccagcgcgctcaccagctccttcttcaggaggccgtaggcgttcttctcgaggtaagtcactggcacggaggtgctcaggaccgcctccagggatccccccgccgagccgccgccgccgcccccgagctgcaggtccttgccgccaacgcgtatgccggtgagctcgacgaagtacaggtcgaggttcgcgctacggactgcgccggtggtgaagaacggcgtgtagcggggacgactgccgccgctgttccctggcacggtgatgccgtcgtcgtcgccgaagacgatgaagtcgtctgctgcgttgttgtccgtggtgttcacctcgggtgcgaagtagtaggagaaccgcccgaggttgagctgcgagacgagggagagattccccttgttgaggccgagcacgccggacgcgccgaagtccccctccgttgaggagctgcacccgaaggtgacgacgccctttacggcggtgtcttcgctgtcgtcgccgaacgtgaagttttggacggcgaggttgccggtcgtctcccttccgtcgtcacccccgtacccgtacgtgtaggtgtactcgcacagatcgcccgtcgtgttgcaggtcggcttgatgatacgctggcaggtatcactctcgcatttgtacagctcctcgggccgcgcgtcgtagaccgtcacgccgggcatgttgttgttcgtgccgcaggaggagttgccggtggcgcatcacggcacccacacgaactcactggtgacgtcgagcgcgccggaaaagtcctgctgcgagccgacggcgaaagcgacgctgtatgtcacggcggtggtggcccgggcgtgccgggcacgcctcggcgtcggcgggctcggggcattgctgctgcagtgatctgcgccgtcgcgccctgtcagctgctggggctgccggtggggaggaggccgaccacgtctttcgcgtggttcttgaagaagtcccgcaacgcttttcctgtctttgggcttaccaagaaccgtgggatctttccggcggaggccattcccggcatgacgacgaggacgaggaaggcgatggcgacggcgggggctcggccggccattgaaggcaacccgatcgacctcttgtggcaaatcgaagagagagctacaatgttctctgatcattacttatggtaaacaagagtaattattctgtgtggaatgtgcgtgattacaacactggacgtactgctatttatagcctttaaatggatcggagctggctggcaaatttgatcgaccgagtcaaaacattacttggagttggttcatatatactaaaacaatcacattttccactcgttttcaagtccaatgcacactctcccgtgctttctctactctctctttcacataacacttcccctaaaatttctgtgtttcaaaagacatcacttctattgttagggagcgttggttctggtgagttagggtgagaaaacacatcgtagtccgtgcgcacgcttcccaaactactaaacggtgcgtttttgaaatttactttaaaaaatcatattaatctatttttgaaatttaaaatagtttatgctcaattaatcatgcgctaatgactcatctcattttgtgtatcttcccaatcttctcaatctcctatccctcaaactcacccttactctgcttgaaattttgtagcattgtatagcatatgactaagcctgctaatggactggattggaatgggttaaatggattggttttgtatttgggtttgctttggttggattgaaatgggcacacgctataaatgggttggatcgatttggatccaccggaaaagaggattggggcggtttggtgatggttatgattttttgagtataatgtggattcagtccatggattgaacccatggattgtgaatggtttccactaagaaggctagatcaggtctcagtcgtggacaacacactccagcggtcgatgagacgatgcatgttccctggtcgattaacaagctgcatcacggccgcctcctcctccgctcgcgctggctccggcaccgattccgctgccggcggcctcttcacatccgcggaggacggcaacggcgacaccacggctttgactgaacaaccgcgtccacctgcctctctacctccttctgcctcgccgcctccgccggaaagggaggcggcggcggcgatggcagcggcttctgcctcgccgccctgggcgccgtcgccggcgagggggaggacgaaggcggccgttgcccctgcagcagctgctgctgttgtagcagcagcatctgctggcggcggacgtgagatgggctgtagagccggtcgctcaacatgtagcctccacgggacgacgacgacgacgccaaggtggcgccagacgggtggaccatggcggcggcgccagaacaagctgcatcgcggccaccgcgtgctcggcttgacagacggcgaggtcgacacaaacatgtcgtcgacgctatgaacgccggcttgctgctgccgttcaggctgtgcgtgacgaaatgcatgttctggttgatggtgaatcaaatgggtttgtggtcgggggtggattctaaatggtctgaaatggtttgacagggtggactgaatccataggaagggaatgggttagtgcggtgtggactgaggtgagaaatggattggattggtttggattctgaaaggagatttgcgggttgggttggtttgaactatttgagctaactgctgtggtgtggattgggaatggggcgggtcttaggccattagcaggcttacatatgacaatcaactcctacgtttcttctatttctctatgtttttaaaatcctgcattccaaggatatctttctcatcctattcctattgcatagcatgtggagttttgtttgttatttttattacaatctgtacaagttaaattttaacctgcatgtttatagagtgatatattatatattgatcgggctgcaggaa

SEQ ID NO: 68331 - DNA, 1617 bp, Oryza sativa
ccagatattattgtataaagaacatgctctgggtaaacataataaatcatggatctgataatgatgtatgatatgaataggtacgataaattgcatatgaaatattgcgtacctttgtagatacatgcggatgtatctacgaaattagtagatcaatttgaaaaaccaatctaccaattaccttattgcgtactcgttggacatcatatgatctgacatcttttggtacgccgcgtatcttgaggcttggatgatctcgatagaccaagttgtcgatgacgatgatggttctgatctggttaggttggatctccccacagccgaagtcgccgagtagcttgttgtcggagagtccatctcttaaacccatctcgtcgaaatcctgaagcaccaaaatccccctacctggcgcgccactgtcgacgtttgatgtcgcagttctggtatttgcatggtatggggatcgtcggtgctagggtatacgcgagactgaggtaaaagagatggagacagggatttttatacaggttcgggcccctgaattgtcaggtaataaccctacatcctgttggccgaagccggtattgctcttattcatgatattcacaccagtacaatatttggggtagcctatctaactgttgtcgacatggcggtctgacgatctgactcgtagtcgacaacagggtagccttcctccttgaatccgtgcccggcgagatcagagatagcgctttcatatctcctaacagtatccggagacaccgtaggggactagccgtgcttatctctgaagtcgatatccggcggcgtgtcttggcgtatgtaggcttctatgttgattgtgttgggtgttgatcctctgtgtatgttgattctcccgttgggcgctgatcccgttgggtgttgattgtcccccctcctcctatggggcttgtatttatacccatagttgtctccttgtccaagtagaactagggaaaccaatatggatacaatccgagtagtccttgtcattttcatgtagaactctggttgtctttccttatccggaactcccttgaggtcagtttccgtataagacatggtatgtggtggatcctgtcaagatttagtcaactactattaggtatgtggtatccataaccctgacaaggtggtagttggatgtccatcgagggacaaaaaaatccacggtcaaatttattatttttgtttcgaattgtataagtcgaattttaacttatatgtgtgtgaaaagatacatcatatattgatctatcttgataaatttttaaaatttttaataactttttgaacgtcatgcacaaaacgaggggatgtcgagggaaaaaatccatttccaaggttatatatacactctgaggagatattgccaaatcgatcggtaaaactttggtcgctggctcgctgcctgccagagaattccttgtagacttgccagccgtcatggactcatggtcctctgatcgatcatctcgtttgtcgatcgcctccttgccgtttttctcgtcgttatcccttcttttccagcgcgccctctctgtctgcagttagcttcgacttcgaactagtggtacatgtacctggcccctt

SEQ ID NO: 68332 - DNA, 1688 bp, Oryza sativa
aagttctgtgcagactgtggtacccctgatccaaaatgggcgtaagtatcagccgtttcccagacatacaacattatccctatatttttgtttttttttataaaattaatgctccttttgttatcctaatagctgatgtggttcttgcagggccttgccttttggtgcgttgatttgcataaagtgctctggaactcatagaagtcttggagtacacatatcaaaggtgcacacgattgactctttgtagttcactttgttctcccatctgctcatctcaaatttggtttcaactcgacttattctgattcaatggttgagatgttctaagagaccaaaggttgtcacgatatgaatctatttgtctctacagtaccaataaatttacactgcaggcaaacatttcgttactcaaaagcatggacatatatgatctagtttgtaaggcataagcatatggtaactgcaaactaatagacctcatactgaagtaataattattcaacaattcactgttcaattgagcacaggtaatttccgtgaatctagacgaatggacagatgaagaggtcaattgtttagctggttcaggtggaaatgctacggtgaacacaagatatgaggcctttttgccagagaactttaaaaagcccagacatgattgcacaacagaggagcgttgcaatttcattaggtataaattacgagtaagctagtatttttgtcgttactacttctgtagattctgctacggaaagtaggattctgatcgttactccttctgtaaattctgttgacaaaactatgctttctctccatctacgtatatgcaggaaaaagtacgagtttcaacagtttgtgactgatccacagttttcatgccctttacgattgaataccaaacacgcaccagacaagaatcagcagcagcaaaactgcagtgcgcgacatggttttggccatgcttttaggaatagctggaagagaaaggacacagataacaaaggactaaagaaaatggtggggaaaacttacatattctacgtattttaagcgggtattgcactctatgaactgtttttactgcaacatggtctaattttttttttcagacggatgtgggtatggtggaatttgttggattaattaaggttgatattagacggggcacaaatcttgctgttcgtgatgtgatgtcaagtgatccatatgttatgcttaacctaggacaccaagtaagctcatcttgttaacagatgccagttatctctgaaaaaatatgcaatatatatttttcttactgccaaataacatttttcagaccatgaaaacgaaggtgataaagaacaccctgaatcctgtatggaatgaaagactaatgctatcgatccctcacccggtgccgcctcttaaattggtacatgctctttagtcataacaaatcatctaattttaatttttgccttgcccatcaatggagagtattgatcagtatctctatccagtgttgtagaatagctatgttgtgcaactttgtgtggcaagcaaattcttgatctttagtattcaagagttcaagactctaggttgcttttgaagtatagaaatttgctggctaaattcaatctgatttattgagttacctacttatggatataatgatctgaactcattttgcgtcaaaaaaa

SEQ ID NO: 68333 - DNA, 8574 bp, Oryza sativa
attcctgcagccctggctgattctttgttatccttatactattactgctagtgtgtgtagctaattttggtagttctcaagcatttccagggtgttaaggggtaaactgccagacatacagtgttcacaaactattactccctccgtttcacaatgtaagtcattctagcatttctcacattcatattaatgttaatgaatctagacatatatatccaactagattcattaacatccatatgaatatgggtaatgctagaatgacttacattgtgaaacggaggaagtaccttataagactaccacgcaagaaaaaagttcaatagaaattagtgaggctagagaattactcctagcctatgcctctttaagcatgtgaaaagggaggacttgggggtgtgtgatgtgagtgttgtgtgtttcttgcttgtaataaaaaaaatcaaaaggataaaaactggcattcaattgagaaaaagaaattgaaggaataatcaaatttgtaaacagatgaaaatcaaatggaacagacatctactccccaaatcaaaaaggtaattaagtaagccaagaagcaaagcatcagaatgaccaaattaactaggaataagtctactttgactctcttaactagtgaccgaatctgattcctattcttgaacagcaataccagatatcttgaccctcaactattaaaactagtccaaattaactccctcagcagttttggagggtggtttcactgacgtggtgcatccgtgacggtgttgacttagtctatgtctcacgtggtgtttacgtggtattagaactaaaaaatatatatggaacccatttgacatccacacaaaaaaatattgtggggcccacatgtaatcttctctctcctttccttcttcatcctccctttctctcccttctctctctttctctttctccccccttccacttccccttcggtcgtctgtagggggcgagagctggagcgacagcaacaatgggcaggcgaggtcctgggtggcggcgggcgctcgagggccaaagcggtagtgggcccttgagggccggagcagcagcgacagtcggaaggacgggagctggagcaacagcggcgggcgggcggacggctaggattgccgaagcaccgccgcctcctcctttgcctgcatcgtgccagcaccacccctaatccggtaccaccaccaagctccatccgccgcaagctagcttcttgccacccacctcgccgtctgaggccgtcactgggggaggagaagggagaggggagaggcgacaccgcctagcttgtgggtgcactggcgtggggcagagagagggaggagggagagagaggatgacatgtgggctctatgttagggtcccatatatatgtttttaattctaatcctacataagcgccatgtcaacgccatgtgggatgaggaccaggtcaacactgccacgtagacaccacgttaacgaaatcgtcctccaaaaccaccgagtgagtcaaattgtagtggttttaatagttaggggtcaagataaccggtactgcggttcaaggatacgaattagatttggccactagtgaaaaagtgagttaaagtgaagttattccgattaactatcactcgcaagcaaagtgccatccatcgagaatcgatgcggcccaagcaaacgcatcctcgggccatcacacgtttaggcttcatttcaaggaggaagcaattgcacgcatgcgggaggggggggtataagttcactttaggtctctcaatttgtcatcgagtccgaaattcgtccctggagcgcaaacctgttacaacgcatcccccaacttataaaaccattacaaacgaggtccttcacctactcgcgcggttggcctccgccatgcactacacaaccatccatcgtcgtgggggtcgtctccgcagccgtgcggaccaacgccaacaactgctcccgtgacaagggctcggggggctttggcgatgtcccccttatcgtgccgaagctccgaggagggcatctcctggtggtggttggtggtggtggcagtggcggtagcctccgacgcgttgaccgaagatcgagcgagcggcgcgaaggggaaatggatggagcgaaaaggagcggcggtgggcgaaacaaaagggcggcggcgggcgagctcctcgctctctccacctcctactcctccctcttctgtctatccttctctctccccctacactgcaagaagaagagcggagcagcggcgggcttccgttgccttcctcggcaaaccccaactctgtcggcgacgccgaggtggccgaccactgcagcgccatcgtcatgacggccacggtctccccgtctcgctgaggttgctacctaccgccgacctcgctcgccttctctgccgttctcctcgacgcctagccgccctccatcgcccgcccttccagtccgtgcagtccaggctggcgccctctctgctgccgtccctcttctcgctgcagcccccctgctccaccaacgtcggccacacacctcgcaaagctcaaagaggaccatgccgcacacctcttcgtccataccagggatgcacttgaggccaaggcggcggagacggttcagcgtgttgctgagtgaggatgaggaagaagaaagagaggagagagaggggatcaaagtttttatttcgtacgtgcaactgatatgtgtgtcccattgttttttttttaatttttggggatcgcattgccacgtcaatgccatgtgggacgtagacctagtcaaaggagccacgtaggcgccacgtcagctaataccaggcataatactgccgagggacctcgtttgcacggttttgtaagttgggggcgaaatttcggactcggcgacacataagggatctaaagtgaacttattcaattgcggagcgtacattcttgggccaaatcattttgctggcttctttttgaaccgatccgataacaaggtattactgacctgtttcagcccaactactatgcggcacgatcctgtttccggcctaaacataaccgtcatgacaaaattacggccacgaagggcagcatgcaggggacgtgcggtccgtggaattttttttatttatacattttttattaaaagatttacataaataattttttgtgttgaaaatttacaaatctaatctccccggccctcccaaaggacggcaagggacctaaatgtaaaatttttatttgtgttcaaaccctttccaccggttttaattgcttaaaaactaataatgcttattcgatacttcaaataattttaaatggaaaagtaataaactacaaagttatcgatctcatcaagatctataatttttatataaagtttatctctatccaatgtcgtttgaaatgtagatctgagattttttaaaatgtgttttatattttgtaacgaatatttggatatctaaaacatcttaaatgaaaaagttgttaactacaaagttgtagatctccttgagctctacaattttgatataaagttttatttcatctaactttatataatataattttaaattataaaagcatagagctaacaagttgtgctggaaaatttgcatttaggtcccttgccgccctctggaagggcgatttttaaaaaatcgtcctcccaaagagcggcaggtgattagatttgtaaattttcaaaacaaaaaattatttttgtaaatattttaataaaaaaatgtataaataaaataaattctccatgcgtagcgggctggtttgcaaaaccgccggtaaccgcttaccgaggaatatggttaaaggaaaatttttgataaatttaaataaatttaaaaaataatttaaaattttgataaattttacatggtttcgtacggtttgccacggttaccgcagcaaccgtgcttaccgcctaggcgcggtaaccctggttccggcgatttgggaaacccttcgtggcatgggcttttgtttgcgtgattttacagcacattcccacattctaaactactattatttatctttcattaattccaaatatcaattgtcccctagttctccggttaccacaaccccacggtttggccgttatcgtgaggtatactgttgatttaaaatttgagaaggttatcgcacatgataaccgcgataaccatgtggttttgtaaacctacaattaaatccaaaagtaaaattttaacttaaagtgacttgaacaaatcttaaacatccatttttagatgttacccttcatctacttttgatagtcatatttcatcttgacacacagatcaaggataagtaattctacttatcatctatttaaacatgctattagtcatcgctcataaacaagcgatccattaatatttacatttcttgatgcctatgcaaccaatcttgcgtggaagaatggagagtcacgcattaaattcgagaaagtcattaagatgataggttattggattggaatatgcctatcaagaataaatttttcagatttaaaaatataactatcaaaagtagatgaagggatagtgcagtggtaacggggtgtgtagtttcaattctaagatcatgtgctcaatccctactataagcttacaattttttattaaaaaaattggagagacgactctaaatacaacatgttaatagagtagtctgagagtcgtaattctacggtagattgggcagattaatttacatgaacaacacaatacagttgtacaaacaacatttatcacaaggattgatacatgagtacatgaacagtggggtactattaatcagcagggattgccagccggaacacacaatagtgtaatgcgcacacaagcaaattcaccttagctagctaagccggacaagcgtcgccaccattgagctccacgtcatcgctctccggcgtggtcgccgtcggcgtgcgccggtagagcgccgtcatgaacggcgtcgcgagcaccgtcgtcgttagcgccatgatcacgaagatggcaaacgtcgtgtcgtccagcacctgcacacacatatatacacgcgtacatacgtatatttgtacgtatcgaagtacatggacacatgtgagacgtatacgtgtataaagaagacataccttcctctccttgccgatgttgagcacgatgagctcgacgagccccttggcgctcatggccacgccgagggcggcggcctcgcgcctgggcatgccggtgccggcggccaccgcgaacgtcccggcgaacttcccgccgatggccacggccacgacgagcgcgaccatgccccacgcggccgcgccacggacgttgtcgatgtccgtgtgcaggccgctcgtggcgaagtagagcggcagcatcagcccggacaccagcggtgccaccttctcgcccgcgcgctcccgaggccgccctcccgcggcatggccagcccgaacacgaacgcgccgaacaccgggtgcacgccgatggcgtcggtggcggcgccggcgaggagcacgcacgccacggcgccggtgcacgccaggtcgcccgcgcggtcggggccaaggcggcgcgccaggcgcgccatgagcgggcggagcgcgccgagcatgaacgccacgaaggcggcacccgacgcgaggatgtacaccggcgcgagagggggccccttcggctcgccgcctccgccgccggagacggcgagcgcgagggcgaggaggacccaagcgaagacgtcgtttacggcggcggccgccatggcggtgtcgccgaagggcacgccgaggaggctgagctccttgaggatgcaggcgagcacggggagcgcggtcaccgagagcgcggcgccgacgaacacgcagagcgggaggaaggacgcgcggcgcggcgccgggacggcgacgtcgaggagcggcacgaggcccgcggcggcgaggaacgggggcgcgatgcccgccgcggcgatggccacgctgcgcggcccgacgcggcgcacggagcggaagtcgagctcgaggccgaccaggaagaggaagagcagcaggccgaggccggagacggtgtccagcgcggcggcgctccacgccgggaagagggtgcggcggaaggggccccaccggccgagagccgacggccccagcaagatgccaccctggcgagcatgcatatatgtataagtaaacaatcagatcatgtactcccttcataccattctgtgtccaactttgatcgtcggtcttttaaaaatatcttatttaaaaaaaactatggttattatttttgttgttattagatgataaaacatgaaaaatactttatgcgtgacttatatttttaattattttttaaaaaattaaataagatgaacgattaaatttggtcatggaaactcatgccctgtgtttaaaatggagtggagagagtactgatcataagtatactagaacactttatatataggttatttgttatgaggcatgcatgattcaggaaaacaagagcaaatgcataaagcatggattatctatttatcttggacatgccgtacgaatgaatgttcattgttacagtatgtcattagttttctggaaattaatgtgttctagatagctaaacaggcatatttccctccggttttgcttaaaaatatgtagccacagtttttcttagtttaggttatttttaaaaaaatgtgattgctacctcttttttaatatttaagtatgtttttacctctcccatctcccttttcatatagataattaaattttttattataattttctgatatatggtaggaaaaattatacagtaagtattaaaatttataatatagctatcaacatttgcatgataattgaagtgcaaatatatgtaatttatcgtgtaacaaatgtgactgtttctaataaaaaaatatgatgtcataaatatagctacatcggtcatctccctttccatgtaggagagttaagtgttttgaccactgaacagatacacatgcgatatatactactctctccgtccccaaaaaatttaacgggaaggatgcgacatcacctaagacaacgaatccggataacctcatgttcagatttattgttttaggtgatgtcacattttcacttatgctggtttttttttggacagatggagtacctcctaaaattttctaggtaaaataagtactcgtactaaatacagctatgcgggacttagtttgtgaatattcatgtcaattctagggcttgatcattagaaaatatgaattgtcgatcagttatgccaactacatgatttgaatctgtggtaaatctaaaactcaaattctggtgggaataactgaactgttgaagttttgtcctcgtggcttatgcataaccccaatcaaaaagtggacttaactttttttgctgtgtacaagtacaccatccaacacgtcaacatctggctgaatatatagtcaattatattcaatgacaattgggagtactttcatgatctcaacaatgttgtgctcttctagaaaatgcggctgcctagctatatactctagtttggtagtcccttgtgttgtgtgtacattaggagaatcctagattctcgggagatatatagagaacacgttcaagagaaataatgccaaacatgtgacgcgcattattaaagaattatagggccacttttgttttttttatttatgcgagacaaatctagctaagcatgtatgcactgacttaattagtcactactacttggggctgttggatggaatgtaagttcccggtggagggactaaaattttttttgagggattaaaatttttgtaagagaaatcaaaattagtccctcccatctaaacatggccttcatatcgatatcgctcatgttggtagagaaaatgacctcattaatatgtagcaaaagttttcgtcctttcgctaacatatatgcatttcttaatccggtctccttatgatctcctaattattttttaagagatacatattgtcatagaaatgtgaacgtagcggttagcaaattgtcatagaaatgtgaagaatgatatatattaatctatcatatcattttttttagaaaaaaagttatatttatttggatgacatataagagacgaatggacatgtctcaatggaaaaaaaatatttttcccagaaatatgaggagtagaatactcctcatatttttataggtaagcacatgcatcagtttaattccaaatataagcacaccaaacccatatttcaatctgtaggcaagatgctcaaggtaggcgttgttccatcgaatataatatccaacaaaataataggccgttgaatttagttttgtaataatgtttgacatatttattaagtataatttgaatatagcatgatgctaatatacctaaacaattgctactagtttacaattaagtgagtttacatcaccgggtttaaatgatctatttattttgttaggtattagatatatcgagggattgacgtgaaccagtacacgtacatgtttaggaatggaattacgaatatgatgtgctc

SEQ ID NO: 68334 - DNA, 1683 bp, Oryza sativa
cttcgatctcaccacagcccctagtaaatatcattacgatcgatcgtggtcataactgtataagagaaatgggccgggatttgttaagaaatagtaaatcaatgttgcttccttaatttgttctaaaatacaagcatttttatgtgttcctcaaaatgtatcgatcgatggacgacgatcgcctgcacggagatcagactccagttagcctctccttccttgagatcgtggcaccttccttagctgcctgaccaaactatggcgactcgggcatggtgtctcaaacgatggtgggggtgtatagcggctcatggtgtcgtggcggcgaggagctggtggcccggctgattcggagctcaagcatatatggaggcttgctagctgctgaatgtttgtgttgttttttaatttttgatttggcaggtaagtccgtgttcatcgctgtttgtgttcgtcttgttcatgttgtattgatgttttgtgatgagtttctagttcttatatgtgatgaggttatcttgtgttagagacttcgactcttcaagcaaagttgagtgtagatcattttattgatgcttgcattgcctcggttaattggatctgaatttctttcttttttttcagaaaaatgcatcgacatctgtaacggctcaagacaagcagccgttacagatgaaactcgtctataacagggcctccaaccgttacagatgattggtcacatctgtgactaattctttgtaacgactgaccaagcttacatgcagatggcaatcttgagtcgttacggatagacaaatctatactattttaaatgattaatgtctgcatacgatttgaataaatctttaaaattctgggcattaattctgtattagaataaattagtgatccaataaatttacaatattatgatagtatttttcaagaaattgtgtgcacaaaactgattatatatattgtgcagaaaatcaggataacttcagctattatatatgctgttgttcatgcagttttcaacatatgaacaaagtcagaaattagaatgccgcagaatccctgcacccccactaacccaggcagggttagtgagtgtccagtggccaccttagtaatgtatctatcaaaagctagctagcaagatcaccaaagcattgcatcacgcatgcaactatctcagaagcgtatatgtatgtactccgggcctcaaactttccagaaccctaatcctgatacgatctcgagtccatggctgatacacaagtcaatcacaagacgttactccctccgttttaaattacaagatgttttgatttttgtcaaagttaaactaatttaagtttgaccatgtttataaaaaaatagtaatatttttgatcgaaaataaatttattcaaaaaatatatttaattattaatttaataaaactaatattaatgtaaatattcctatatttatctataaacttagttaaacttaaagcttaaagcagtttgactttgaccaaagtcaaaatatcttgtaacctgaaatagagggagtaattattaataaccccctctcaaattgtatgtgtgcgtgcatgcatcaatcaaatccccttttcggccgtcggttaatcactatgccgaaaaaaggcatggcagcagagcactgaatttatcgtgccgtcgacaggagcaa

SEQ ID NO: 68335 - DNA, 1484 bp, Oryza sativa
tttattatcattagaattttttcacccgttgcaacgcacaggcatttttgctagttaagaaaagatataaccaaaaatcaaattgtgtcatctttttttttaaaaaaaaaggatggagtacaagctagtaggaaatgctctgattaagctgaacagagtgtgagatatgtcgataccgaaactactgatcaaacaaaacaaaagagtttgctccgttcggtagtggaagaaagaaagaaagtaagtttgtttcgttttccgcgggtacgtttcccgaactattaaatggtgtgtgttttgtaaaaaaaaattccgcgggtacgtttcccgaactattaaatggtgtgtgttttgtaaaaaaaaaactataggaaagttgctttaaaaaatcatatgaatccatttttaaaatttacaatagttaatactaaattaatcatacactaatgacctacctcatttgacgtatcttctcaatcttccaatcttctcttctcgcaaacagagctgccctggtgagtagtatttccctggcctgcagccatccggagcagcaagtagcagtgtttggttgcttccctgaagaaggttgtccatgctcaggcatggttgccggagtcacgccaccaaaaatgaacgcctgatccaggcgtgggcgtgtgcctgatcatcccccattgattcttaacggatgtgactactactacacttgtaaacatctcactcaaacaagcatgtttttttttatggccgtgtttagtttcccccctatttccaactttccatcacatcatatcacatcaaaaaaacttttatacacatataaatttttagttttttttccaaactcccaactttattcaaactttcaacttttttttaggactaaacacaacctatgttcaatatattcagccaggctcatgtcttcaaccaaacaacagaacatcatatatgcctgctaggcatgattcaacacgagcttttctaccacagtacaggcatagatttttctcaggcaagtcatccagatcaccaaccaaacatgcccttgctaattgtgagtgcgagcgttgcagacttgcagttcgatatatttatttatgtttcaatttgggacgtttcctgtatataggactgtaaacagtttttttttttcttttgcaatattgcatcgatttgcaccatgactaaaaaagaagtttgaacatttttttttttggcggggggtgggggggtgggtgtaatgtaaacttttgaaaagtcggcaaatataccagaacgcacaaaacttacaaaaatagagttggtataaaagcgtaggcaattaagattattatgaaatgcatgacttacaaaattccgactgaagttgttcactgtaaaatttgtgatacagaaaaaatgacggaagcatgtttgtgatcattacaaattcattttattcgcgaacgcgtaaaagaattgcattagtatattactct

SEQ ID NO: 68336 - DNA, 1936 bp, Oryza sativa
attcctgcagccctaagatatcaagatgcgcaatgccggtgcgggacaaagtgctcgaaggaatacgatgacgcaacaagagaaactcgtggagttgtgggcttccaatgttatttttggatccaaatcccaatcgtatatgtatattcggctaatgtataaattatagtgctagctaatttattgtttgttagtaccgttcctagtcgctatttgggttttgacggaagaatcaacaatattaccggggtctagtttttctcttcactcaacaatattaccggggtctagtttttctcttcactggggtcatggatggcaaaataaagaagggtaccagaggttcgcaaaagatcgtcagggtcaactgacccctatgaacgagtgtagcttcgcccctgattggtggtgtgacacagtaacaacgttgtttcgttatgtcaccaaaaccagcatgattaaaatgtttagaattgaaaataaattttagaaaagtctatttctaaaatttataaaaaatcagggtacaaataatatatattctggattgtattcacgtccttaattagaaacttaaaatccacgcccccacaaaattaagtctatcagcacatccacatacagagcagagctaacagcagcagaaccagagtggcgatgaggatcgttgcggcagatgacgggaagctcctcgtggccgccgttgctgtcgtcgtcgccgtcaccgccgccgtcttcttcttccgcttggtcgggcatgggaggggaggatgccggaggcggatgcgagctccggggtctctcatggccaccttgctcctgaccagcaccgagttggtcaccccctgcacgttgttgttcacgtagatgttgatgctgcagcagcagctgccgctcgccgccactgacatggtcgcccccgtgctccggttgctccgctcggaggagcaatcgtctgcaacacccatcgccggcgaggtaggccggtcggaacggacggaaggttgatttctgaagctggagaaaacaagatctgcaacctgcagggatgcagtgcagcagcagtttcagttatatttggcatagttagtacgttgctgcatcaccaagaaaagcatagcatatgctactacgagcacagctggggaatcacactttgcctctgcggttgggctactccccaggctccagcaatggatgtcaagaaagagcgggttaattacatgtcgctttgcgcttatctttgtatagcgtcctaacatgacataggcacatagcaaatcaacggtcatttttgtgttctattgttgaataagctgcgcgatagaaggcccatttcagttgtcaatgatattactgggctggactgtggatttggagaaggtcagaaggctataagaaaacgccagcccattctgctcttctagtcctttctttccccttcacgacgttaagaacattgtcgttttttattcaaactttgaagcatcgccagtaaaatctcgaagcatcacacgaataaaaataaaaaagaacactttgaagcaccaccagtaaaagtttggagcatcaccagtagattaagctcatgcgaagtgcaaactagggtcggcacaacattaatatactttggatccacatctgtaaataaaacacgaggctatcgactcaaatacttagtactcacatgctgcagtcatacgggccgaacggctagctgatactaccagtaaaccgtgttcaacggaaggtagtactaatgcgttaggatgagggcaagcaagttgaacttaattaatcacagtactctacattttctcaattcatccgtgcacacattttatacttgaattcaaacagaaccaaacacacagcagcaaacatttgaactaaaaccaaaccaaacggtacatacatatgattacgaacgtcgata

SEQ ID NO: 68337 - DNA, 3383 bp, Oryza sativa
agatatataggcagtcgtgtgcatgatggatggcatcgatcgattggccggtgtgtcggggtcaaattcagttagaccctgaccgcggcggcgggcttgtggtggtggtcggcggggtagtcgccgccgtagccgccggcgccggcggcgtggttgccggagaagaggccgccgtggagcatggcgacgtagagcagctgcgtgaaggcgaggatgatgacgaaggcctcgagcacgcggaggcgccacccgcggtagccgccgatgtggatctccttgcaggcgaggccgaaggcgagcgcggtgatggcccaggcgatgagcgccgacgcggcgccggcggcgaggctgtgcgcgccccaggagcggacgtggtggacgccggcgagcttggaggcggcgccgaccacccccgcgaggatggcgaagacgaggaagtagaaggtggcgccgttgccggcgacccccgggtggttggtctcgccgttgatgtagtggttgagattccagctcgcgaacccgatcacgatcaagtacatgatcagattcagcaccagcagcggcgcgatcatcgtcctccctactccggccatctcgtatcaaaatcacaaatcaacacaaattagcaacacaattagcactggtttagctagctagctgagagctactgtgattaagtgaggagaaaacgtgctggttggtggagggatatataggcggggagaggggtgacacgtgtgggtggatggggatggcacgtgtcggcgtgtggcaaggggtaggggggacacgtacgcgcggggccacgccacggacgcccggcttctggtgatttccggagaggcgcgacgcgagggagacgggggtaaagaaagcgtaaaaaagtgcagcgcgcgcggcgtcggcgtgtgcggaggtggcgacgcgcgggcgggagatcgaggggaggagaagcagatggttccggactttcgccgcaagcgcctcggctcggggtcccagaggcggcgtacgtggcgggcgtggttagagcacccgcaatgataaagtaaggtgctatctataaaacatgtacatctcagcaatagattcgattaatagtaaaccaccttaatagtatatctacattggtatctataaatctctcatgcattgtctcgtttttctctatagactatctctaagttagtagatagctttgctctctctcttcatttaataccttccaagtagaaaaatatgctgacatggatctcttgtagagagcttatagataaccattgtgggtgtccttagcggctaatttaggctaaagtgtgcgtggttttacttactctggcgggtgtggcagcagaggcagggttagctgcttgctttaggtttgatgatgatggtgttgctgcctcttttttgttcctcctttctttgacgcctagtgcaaatgtgcttccctgttttgggtttacgctgatccggcctactccgtacttcttatcgtctgcctaagtaatgcagcaatctggagtctgtactccctgcatttcaaaatgtttaacaccattgactttttaagtacgtatttgaccattcattttattcaaaaattttgagtaattatttatttttttcatatcattttattcattattaaatatacttttatgtataatgtatacatatagttttacatatttcacaaatttttttaataagacgaacggttaaacatatgctaaaaagttaacggtgtcaaacattctgaaatagagggagtacatcgatcctcagaatctttcgagcgcacatacgtggatgcagatttaaccatggtcgatacgcgccactaggccagtcagtactcccccatttgtgcattgacgaatttaaattaagaccttcaaccataaaatgcctaatcccttgtttgctgggttttaaatcttactcctctgtcaaaacaaaccaattatagatatgtatctggacaatatttatgtccagatacatcctttaggattagaatttttagatggatggaatacactatactagtacgagccaagcataatgagatcttctatccccatggggctgtcctgtcaaactggctatgtgatgtgcctatccttctaatcggaggctgttgcctctttgatattaaaaaaaaaaccggtcagaggttcgttgctcacaaccacacatgcgtgcaatttgggcagtagtgggctagtggcgtacgtaagctgccaatttgggcccggccttttcgcggtggctcctgccgccgtcctgcgtcttctgccagagtgctgtaccatctcgacatccttttttgagaaatgacaacaatctcgacatctcgtagtctcttaggcgtgggaactggcatgtgtacaacaaggagtacgttgtgattttggcctcgatcagttggctggtgattactgatggccgttatgcggtacggagttacaaagttacaacaccaaaattacgctgtcatattgtttgtaggggtagcaaacaaacaccttggctaaaatgttgtccaacaaacttcgctgtcacattgcccaagttcgatgaatcggtcacgtcctcctgcatatgaaattgatctacttaatctaggttgcgagataactactttccataacaatggataccagttgatacttttccccattccataatataagacttgtttcataatatagagcatgtatgtatgcatgccattaactaggaaatttttttcactaaaatattattatttaaatcttctaccttcgagatatctaattttaatgggtgcatgcattttatttattaggacaatccaaattataaggtgataataattatttcttgattttttggttaaggtggttgtgtcttatattttcgaatgaaaggagtatctaacatgtatcggctgatatacatataagttactactcccactgttcatattataagccgtttaacttttttagtcaaaattctttaggtttgatcaaatttataaaaaaatagtagcatcaacaacatcaaattagttttattaaatttaatattaaatatatattgattatatgtttattttgtatgaagatgttcctatattttttataaatttgattaaacttaaaaaagtttgacaaaaaaagtcaaatatataacttatgatgtgaaatggaggaagtagctctaataccgatagtactctctccgtcccattttaagtgcagccatgagtttttatatctaactttaatcgtcctttttatttgaaaaaaaataaaaacataagtcacgcataaagtaatacttatgttttatcatctcataacaacaaaaatactaattataaaaaaaattta

SEQ ID NO: 68338 - DNA, 2319 bp, Oryza sativa
tcccctccaccaccacctccccgcgccgccgcctccctttcccccccacccggaaaccccactccgccgccgccgccgcagccaagcccccgacgacgctgaccaccaagccactccgcctcgcgcgcccgctcgcctcctcatcctcctccccgcctccgccgccgccgcccgaggaggccgagccgaaggaccccatcgcgctcgccttcgcccgcgccgccgcctacaagaaggagagggacagccccccgccccctccgccgccgcctacccctgcgccgccgccgcagcccccggcggctacggaggaggactcgaggtccagcaaggagtccttcgcgcgggcggtggagtacaggaacggcaacgggggagggctgggcagcggcggcggctccccgctgctcggggcatcgcctagatttggtgagtagagaggtgacgtcggtttggttgtttttcactcccgttggtaaaaatcattccaatccactaagatgatgaatgaattgatgattactgcattcacggatagaaatgaggaatagatggagacagacagaaaaactttttcaattcggatgatagcattctgagtctgtgtgtatgcaatgtccccgggtgatatatatggttgtggtttgaaaccttttgctgattgatgcatatccccgttgtgtttttactagaagcatgtggagtaatgcagtaatggtcactgtatataggtttcaattcctggaagccttttttttttctcttttggaaagtaggcacaaactccgttgatcaaatgcctagaagcactttatttatctgtggaaacatgtttaggaggattgcgagatggttagtccaagagttggtggatccctttgtcattgtgatcttgtgagagtatgtatcttttttttctctcaatacattcttgttttgaaaatgttaccgtttgtacttgcaaacctacaacttgaaaactttcgcatgttcatttgaaccatgacactgtttacttagtttttatgtaagaatagcatagaatcctcactgcgaacagttaaaaaactttttacattgtgcgagtcttcattaacaccatcatttttattgagtgttgtccatgacacttgcttttcttttaggtcaaagtacattttctactgaagatggtgcatttggtaaattcacaaataagaaagaagagtatgagtacgatgagactgactttttgggcctagactttttcgagaaaaagagttataaggggcctccaccaggtttagctccagcagctgatccttttccagataaagattttcctgaagtggagataataataggggaccctagtaaatttgggaagactcatcgttcgacagaggttcaaccagcagatgatagtgagcctgaggagcctcacgctcaacaacagaagaaaagaaggaagaaaacaagcctgatgaaacaccaccttcaactgttactgagccagaagaggatgaagacgagtacaaaccgacagttagatcatggggaatgtttccacggccacaaaatatttctaaggcggtgatataccatattttctgtatctcttaaagcgttccatgtatatctgctttcagttattagaatctttttcatgtttgcatggtcattttattgttatatgttgaactgtgttcggaggacaatgattttttaaaatgaaactctaatatcctttttgcatacttctgttaaaaaaacaaaagattattgtgcaatcctctctttatatttagtaacttctcctttttgaattcccgtatgattgtaatgctacatttaattctgcaaattatacaacctagtggcaccaggctacttatctatagggaatcaatcaccacaagcttgtctatttgtactgcagagatccagcacaatccttcagaaaaatgtttcagttaaaagtttgccttaacaagggacaatattgacatatccaacatggctgcagaagctacctgcatatgatttataggccattatccaagaatgactgcatgtagactgtagagcgtaggagtgagtacataatatgtatgtgtttttttttaggttaatatgtatgtggtttttatatggactagcacaacctttgggacatacatgaagataatctgtgaaacaatacatttctgacgataaaaaacaatgaagattattcaagaagatgatatttggaactgcatttctttcccttgtttgattgagacaatgtatgtcgaccattgctgatgctatcataatgtatttgatttgataaaatta

SEQ ID NO: 68339 - DNA, 837 bp, Oryza sativa
caccaacctagccgacatggaaaaatccttgccatgccctaatggtggcgtgacaaaacaaatgttgttcgccaagctagtgatcaaaaagtttagaattttcaaataaaatttgagagagttgatttttaaaattgaaaactaaaagattcaaaaattgaaaataaaatctacgaacagtttgtaatttgcaatatcaaattcaatttaatttgcagaagctaataaacttaaccaagtgaaaatcaaagtcaaagtctatcttaaacctgactcgaattaatctcaaacactatactttctctaactcgactcaaactcctacgtcgcaaagataactatataaaactccttccacgtcgtagagataatgtaatgtgtaagtactttcggttagttcatcttccactttattcatcgccggagaggaagcaatcgaaacgaacgcgatggcggcgttagagggaggagcagcgggcggtgccggcggcaatcgttcgccgccaccgccaacaccggggcagcaggaggaggcgtcgtcgtcgtcgaagaactcgaaggtggccgggtggagcaaggaggaggacgacccgatcatcggtggcggcggcggggagaaagaggaacctacgccgtcgccggtgtgcctcccgctgttccctctgacgccgggattccaccaccagaagcaggcacaggcaccggcacaggcaccgccgccgcttgcggttacgccgggattccctacgccggagttcctcattcttttccccctgactccgggcctccggggatgtgatctgaaggacaatgcggcggcgatggggctgcaggaat

SEQ ID NO: 68340 - DNA, 1679 bp, Oryza sativa
attcctgcagcccgataagtacttgtaaagttcgtcgcactggcagttgaagtatcaattagataagttgtaatacagagcaagtatttctttttatctgtgttgcaaacaataatatcattgttatggaacaagtgggatggcatagtagctgaataatatattttgttaaccttaatttgatatgtaaatttactataacaattatacttttttatttacatagcaacataaaaaaaacacagcgcagcacaaacaccacaaactgagactaagaatgatatcctagttttgaacttgtaccatggtacacaactgtgtccaaaatctgtatatagagagatttaaaacctgtctgacatagtttgacaagaaatcttccagcaataaagtaaagtggcactgtaatatcatccaaatatttgcactagttttcaaatttcagaagactagaacaaggtgaaaataatataataggcaaccagctgcaaagttattatgtgatgtcacatagaagagcatatgaaaatagacctgatacacaagtacgaagttgtctttgattatgtcttcatttaaatctccaagatagtcagttaggacatcagcaacccgtgagagaaactggaagtcgcaaatcatattcacagaaccataaaaaagagcaaaagtcaaaacctgtagtcagccatggttcttggcatttcatcataaattactttagcaaattactgcaatgtgcatgtttcatggtagattggtaggacaattatgatagtgacaacaattttgtagttagttgcctgtttttactgataatgcttctaaagttccaaagttgttgaacacatcatttcataccttcaagaagctttcaagcatgacaacaaactttgataatatgcaaaacatgattccaaagaaaaattctgaaaattacatgttttacgcataccagaatggagaacattgttcaagctgacatccaaatgcaaagcatatttgataatatataattatatagattccaggatcttaatagatattatcaaagttctagaaataccgattctaggcaaaacccaccagtatgactagtattgatttcacaattattcttgctgaaagtgtgagtagtatcaaagcattcactatgctcagcaacaaataacaagtgatctctgcaactctaccctagttcaaactagctatcttcagcaactgaattatgctgtactgctgattttactaccatcacagagctcccaagcaagtaaaaaggagaagctaagaggataaaactcatacctcgatagccaacaacgggggcatctccacttgggtgcagccaagaatgtcaccccatttcgataaacttgaaacaagtaatgcgtcggtgagaccaccacctgcaagaccttccaaaaaatcaaagcaacataatcagcagagctcccccatcaaaatctaacagctaaagcagcactgcatcacaacaaatcaaagctcgaaaatccgaaagcaacagccctgaggaagagccgaacatcaaccttggaagcgtcgccggcggcgtgggcgagcacgtagtcccagaaccagccgcagatgccgcggtccacgcggtgcgccgtcatctgcttctccaccatcacctccctgccatgggctgcaggaat

SEQ ID NO: 68341 - DNA, 1923 bp, Oryza sativa
ttttttagcatatacatatacgtatacaaaatttgtatacgtgtatacaaactttgtatacgagtatgcaaactttatatacgtcgtacataaagttggtatacttgtatacgaatatatgtgatgtttttttttggttttttgattttttaatatgtacgtatacaaagtttgtacacgttgtatataaagtttgtatacatcatatataaagtttatacacgtcgtatatacaaagtttgtacacatcgtatacaaagtttgtatgtgtgtatttttttatacatcaaaaaaatatacatataaaaatatatatatttatagtagtaatctagtagtagtatagcagtagtagtaatattaatagtagtagtgtagtaatactagtagactagaactgtagtactagtcggcggtcgggcgtctgaggggccgcgcgactagtcgtgcattagcccccccccccctccccccccccgcctcgttagttgcaatatgtaattaaactctcccttctaatatattgataatatattgatgtgtaattattttgtgcgctaaactgccaatcaactcaccagcgggcagtgctgcacttcggcccgatttggagttagcttacgggttacggcccactcgagggaagtacaaggcctctaagcggcccagccgttcggccacccgccttcccctccagcctaacgcgcgggagacagcgagcgttgaaggcaaccgcagtacggtcccgtccagtgtgccccaacgcgtggccgtgctgggtcggatcatcatgatcacgtggtcatggtgtgtgtgttggatttagatcaggtgtcgttatagctgttactaaaacttaagaattacatgcaatttgattcgtccatttcgcaacactacaataaccgtataaacaatagccgtataaacagtactctactctaaagtgcttttgctaccgtataatgaacagtgcgactcactagtctggaccgttccatctgtatctgtgaatgagaaccggtgctgcctaaattgcagtgacaaaagtgactacacctgatccagattcgtgtgtagtggtgcgtgtctgtatggtttggtcccatatgttgcaatccacctatcagagcaacagcgtggtcaaggaccatgacaccatgtaccgatcaatagatcaccatctccaaaatcaaattcggtagccacaccatttagatcgccaaatctaaggacgaaacggtcgaaaaaaccttgtaccatttccatttttatattttttttcttgaaaacgaaatcggaacgataaaaccgaaaacgataacaatatcggtatattagaaacgggatcatcggaacggaatatatcgatattggttggaagtcaaaaattcatgtcggaattagcggagtgtggcatagcacacatttaactatgcacaaagatgacttttaagtttattcttgcatcatcacactccacataataccattatataataataagtttgacatataatataaacaaagttcaacaataatttaacattgataagttgaggagaccaaagtttagcaaaattcacttgtcacgtcatagggttaacaatattttctctaatcacttcttttttttatgggctaaaagcctaccaggcttcctttattcatgagcttctggtgggttgggtaggctgagccgctaggaactttcggaatttttttagaattttaatggaaattatcatacaaatacggttactgacaaaacggttggaaaaacatccatcctatttctgctaccatttccgaaagacattaccgtttccatttccaccatcgtcggttaccgatacgactgaaacggttggtggaaactgaaaacggcgctcggaaatctcgaaaatttccgtatcgttttct

SEQ ID NO: 68342 - DNA, 2622 bp, Oryza sativa
taattcctgcagcccttgatgatgaatcctcctcctaattaagtaaaccacgtgaatatataaaaaggtaacaaatgcatattggttactacttactagtagttttttaaaactaaaccggcaggagaactgccaattatatttcattaaataggagtaaaaactcagatgggctacagaaaaagaaaaaacaacctctcggcgagtagagactcgccaagcctttccaccgtggccagtacaaccacacagcacacggagctccacatcactctagccaaactatcaacgaaatgatggcggaatccaacgatgaacatcgatgtcgagatgctgaagaggcggcacacagcgttgacatcacaaggcacgtgtcatcgttgccgagctagccgcccagcgacccagtagctccgactccatggcaatcatggcatcattgtaggcatcgccaaaccgagcaaagcaacaccaagctcatactttggacatcagccaagcccctgaagcgccaaagcctgtactagcaacacccacatccctagagagaaactgcaaatgttatcgttgccaagcttcgtcgcaccccaacgacgtagcagctccgactccacccgacagagacaaacgaagaagctggatgctaccaatacaagaaaggaaccaagaaggagaaggcctcgccaagcacctaggcatctagcgcatcgagctgacacaggagtccagcagcggcaaatggtgcatgggtaaggttctccaagatgatgcccccaaggaggatacaacgtgaaacgccgccatcgcccgtccggaaaccggatcacagtttttacctggagactggtagcggtggagaaaacgctataacgacgcctccaagaagggaatgacgccaaaggcgccaccgtcgtcgtgccagccaaaggctaagcaaggctttcgccaacgatttcgtccagcgccacctacccacacaacaaccgttgctgaaccaccacatcatctcatcagccaccagttagcccagttcaccaccccacggctcaggtaggctcacggcctgctcccgcacatcgccatggcaccgtcgtcctctgcacaaaccgccacgtcccctctcccgaagctccccacggccaggacaggatctagccataggaggggaggagctccacgaggtgggttttttaagccgcccgggaagaagagacgtcgccgccgccaactgcttccccgtgcacataggccagagaagcagcagttgatgcatgtccgtgagccgctgccgcctcctccgcgcggccctcgcgccgcggccgccgcctccgccgccgacctgcgcgtccagcccagatctagccaagggagggccggatccgaactcgacggctccggatctggccgtcctcgccaagctgcgcctctcgtgctccggtctcatcggcgccccaaccgcttgactaggagtgaggggaaagggagagacccgccgccgccgtctttgcagccgcccggctttgccggcggctgctcaggcggtgggaggtgggggagaggagggagagggagggggtgacgatggggtttcgccgcccgcgtcacccctgaggcggagcgaccgggcgtcgagccgagttatatattacagtttaggaacaaaagccttcaaagatatgtttaggaagcacttaacacaataattatttgcatttttagaagagacatgacaataaaaccaaactgaccaaggaaccaaccgggcaaccattacacaaaaacaaaaaaatgtcccagcttgtctgagctgtccatgattgcaaacggtattcaatcaatcactatcacttacatacacaatcaaacacttcaccaagatcataaaaatgagtaaggaaaaaaaacatcatggaaaaataccatgaaatacaaatggaaaaaatagggtagagcccagagcattggatgtgcagattaaagctatactactagcattcaagtttttttcaactctgctgcgtaggaggcgtgtgtgtgccatgtgttgctggtgctgctgcctggactgcatccataacatacctccactcaatctcctcttcctccatttctccccccattctctctcctcctcagctgcttctgcaggtggaggagaagcagcagcagcagcagctgttgctcccatggcttccatctctgtcccaaacccagctccttcccctacagaggatgcagagagcataagaaaggcagtgcaaggtacaaatggactcttcaatctctttgtacatcatgaacatttaggatttgaatttgtttcacaatgtaaacttaaagagcactgaattctgaacactgttctttgccaaaccctgttgcttttcatgtcattgttattgttttcatctgaagtgtttgcgagtaattagttgctactactccagttcatgtggaagagacgagaaattttgtttgttcaagttggtcatggattagctaaacatgttctacatagctctgaaagactgaaacaactgatgatttcgaaatcaaatatttgaattttcttttcttttttttggttgaactgaatcaaaggatggggaacggacgagaatg

SEQ ID NO: 68343 - DNA, 5398 bp, Oryza sativa
acgtcgtccgcatcgtcggcacgaggagcaaggcgcagctcgcggtgacgctggagcggtacaggcaggagcacggcaagggcatcgacgaggtcctcgacggccgccgcggcgaccagctcgcggcggtgctcaaggccgcgctctggtgcctcacctcgccggagaagcatttcgctgaggtaaattaaaatcgaacgtcctcgataacttaaaaacttgcttcttcataaccatcttaaaaaatactttctagcaaatccgtttttccaattggcactgaacgtttaataatttatcactgaattcacatatcatgagaacagactataagtgataaatattaatcatattttaaaagtgacaaattgttaaatgtcccgtaattcaaaacgcgccttaatactacagaacatattggagcaaagtttagccgagtttagttccaaactttttcttcaaactttcaacttttccgtcacatcaaaacttttctacacacacaaattttcaacttttctgtcacatcgttacaatttcaatcaaacttctaattttagcgtaaactaaaaacaccctttgactcaattgtcttttcgcgtcttctttaggcgaacattggagtaaagtttcactcaatattttttttttctcgtcttcttcttcaggtgatccggacatcgattctagggcttggcaccgacgaggagatgctgacgagagggatcgtgtcgcgggcggaggtggacatggagaaggtgaaggaggagtacaaggtcaggtacaacaccacggtcaccgccgacgtccgcggcgacacgtcggggtactacatgaacacgcttctcaccctcgtcggccctgagaagtagccatgtagcagcttggacattttattgcttgctcatttgatttgaacaaaatacaccgtgtgatgttgcagttattagtaaaatgcgagtaggatcgatgttgttttcgttgggtggattaataatggagcatgttttatcgcaccgtggtgtatccaacacttgttttcagacgatactatcgatgtttgatcagaatcaagccagaggtgcttgaaactagtgacaataaaaccaaagaaaaggaaaggtacatgttgcatccggagtaccatggtcatcaatttgttttatgcacattactgtggcgattctcgactggaataccacgaattgaaaaaagaacaaacaagccaaacatctacttggttactacatcagcaagcagatatcatctcacttcttccttgcagcaatagctgcaatcccaccaaccagaagtccaacagcagttgtggcgatgcctattccgatcagaccatctgcagataacgcatgcagatgtttagacagaattatcataaaataagttgttgtcccagtgaaaatgaggaaaaataaataaatgttcgatttgtgagacaatccatcacgtagctcaatacaaaaccaataatataggatataactggaacaaatttctcaatgtctccctttggcaattttatcttctatagccttcctgagagacaaagcctgcctccaatcaggttgaatctgcaaggaaagtaagttatatagattaattcaggagataccaagccacaaaccaaaacatgttgaagcacaaggaaagcaagttacatataaaactcacgtttcagttggtatacagaacaagcacaatggttttacaaggatgctcacatgaaaatgttcttgcctactaagattaaaactttcaatcccatttgcattgtgaacataggtcaggcaagaaaacaatacaagcactaggaagaccaagtaaacattcccatgactacataatcatcaaaccaagcaaactcaagaaaacaatgctgagcaaatcaccacgatctgtcaacatatagcaaagcacagcacagcaagaaaaccaaaatcccgaaaaacatcttcagcggagttatgaagttgcaattatgataaagatgagcaatagcatattggagacaagcaattttataatttcagtttcagccaatgcccctaaatctctcaaaagatgcaaagaatagtaaattctgaaaggggctcgatgcattagcagctaaggcatccccaccaagcatgagctgaaaagcaatgagcttaaactcattaaccttgcttagctggaattgggttacaagtaaaagggggaaattaacgcctcgtattcgaaaacctattggtttgcctaacaacctttaaaccttggggtcgacttagtccgggggagggcaaatatttttaattaccattccgaaccaccgaaatatttcccaagccttccccattgggaaaacccagaacccttccttagggtacccaacatgtgtcacctttggctgtgaaaatccagtgaaaaaggatgacaagcttaaagtcaacctgacttccattgcatcatatggcacaaaaacagactattacgctagcaatcgaacagacttgcacaaacaatttcaaagtttgttttgcagtcacctaagaccgaataattcaatgcaacactctatcctgttttgatagcacaaaaactaaatgacatgaaagttgcttccaggaaaaaaacaccaccattaaggaatatgaattataccaatgaatctacaagctaaaaatttgcacacatacctccaaacaacggtccacaagctgccgacttcttgggtagtcaccatttctgtagtgtccaaccgccagcagatatagcttctccctagtctgcagtgggctgttggattgacctaatgatgctgtgaaaacaaaacgaaattgatcaaaacagattaggctgcaaaaattatgtttagattatcgaaaacaaaacaagatatgagaccttcaagcatgcctattccacgatttacatcctcctggttcttggaatgcacgagggcccaagacagcctcataatgctatcactcttctgctcttcatttgcagcctcagctacctccctttcacagccctaataaagcatacaaccatagaaactctgagcgcgaacgtgtaagcctaaacattatttggaatgtatctagtaacaaacagggtaatgatttttttgtaaagtgagactgatatgtgcattttcttagccaatagttgcagtgatgattgaatcagagatagttccagtgttactcttcagattgtgaaccgctaaaaaggaatcaaaatcacacagctcaataaagagaagccgccttgactcatccgcgttgcaacaaacaatcacgcgagctaatcacgggcagccgacggcagcaccaccatgatggaacaaacaagccactgtaaatgggggcaggctgccatgccgcctaaactaagcatgaaaaccactccacactcgaccattcgctccccagtacaaccctccaatcctcggagttgctaatcctcaagcaccgcgcgggatctcccgctagaactaaaacctccccccattgaataaattaaattagaaattagagtactagaaaaaagctccccacagcaggggattcgaataggagcggagagaatggattctcacggcgatgatgtcgcgggtgcaccaggggatggtgtcgccgccggagaagaagctccccaccgactcgacgagcttcccgatcttggcctccatcggggagggggggtgggcaggggatcgggccgatctggaggaggagggagaggagagcaagcacggcggcggtggcggagggcgaggcgacggggccagcagcggcggatgcgaatccggtgggtgggaatggatttgggtgcaagtcttgagtcgcgtcgcgtgggttttgtattgtttgttcgattcgctgctgctgcttcttcttcttcggcgctaagaaagaaggggaggagaacttccggcgacttctgagttctgacttctcgccgtcgcacgtgggtcccgcgtttaagccactgtttaattcaacatagtcatattataatctgaattattagaactaagttgaaacaaatagatagtttattatgatggattattacaatctataagctatattactataatctggtaatccattaccactataaaggtgttttttaaatattatgggtgtagctatatttatagcgccatatttttcatcaaaaaatagttggtatgtatttacattgtaagtctctaaattacatatgtaattttagtatatttacaatgtaagttctaaaattacatatgtaagtcttaaaattatatattgtcagggttacggataaggtataccctctacccttagatatacgctatacatcggtgtggtatatgtgtgcgtatacggatgttttttgtatgcgctaaggaaattcatcacggagtccacagatgaaaagattcctaaccggataggactgggtcgtcactgtatcatgtagaatccgatgtctccgagtcctacttggaaactacctgacctgcgatataaaagggaccccccgggaggacctaaggcatcgaatctcacatccgagacaaccaccatagcctacgaagccggagcctacaggagccaagtcgccgggtgatctagtcgactcgactacggtctcgtcggtatcatcgagttccactgttccctttgtaatatgtgatttccatcatataatcccatatcaactggattagggctattacctaccaaggggtcagaaccagtataattcctgttttctatttgcttaatgtcatattacgtagatcctcatactagcgtaccccaataccctctatatccagtctacgggtatcccccgtcgacaatggcgcgccaagtagggggacttggtgctcaagattctactactatgtcgtcaaatctcgtcaacaatagcgtcgaccccatcgtcaaccaaggagttccgacttcaacaatgctggtgtgtactcaagtcggtgaaatcgtcttcccgatttacaccatggtgccggtctcgactggtccatcaatgaccagaagtgagaatgccgtggccgtaaccccggacgaccccctgtcgaacgatcctcccgccgaagcggagaaggaatgtcgacgacatccaagcctgaggaagatcttagtgcggccaaatcttgtccttccgacaagaatcacgagccgacaaggacaacttttgaggcgacaaggtcctggtgtcctattcacaaaactaggaaatacaccctgcaagcttgctgggtttttctcaacgcacaagctgagatccgtgcctgcaaagagcatggaattcagcgtacttctccaactcgtgatatctattgtcctatccacaagacaaagaatcacgacttctcaaactgcaa

SEQ ID NO: 68344 - DNA, 2246 bp, Oryza sativa
gacatccacgaaggacatatgatcgccgacaacccactgcccccagcgtcgggtgtagagctttcaaccgttcgctacgtgatgtccgatggcctgagagattctgaccgggagcaatagagaagtacgacgggagtaccgacccagaagaattccttcaggtctactccacggtactctacgctgccggagcagatgacaacgcattggcaaattatctgcctacggcgttgaaaggttccgcgcgttcgtggctgatgcacctcccgccccactcgatttcttcatgggcagatctgtggcagcaattcgtcgctaacttccaaggaacatacaagcgtcacgcgatcgaagacgacctacatgcgttgacacagaatccgggcgaatctctgagggactatttcggcgctttaatgagtgcagaaatacaatccccgaaatcactgacgcctctgtgattcgcgctttcaaaaccggtgtcagagatcactatactacccaggagttggcgacaaggcgaatcacaactactcgaagattgttcgagatcgtcgatcgatgcgctcacatggacgacgcactgagacgtaagaacgacaagccaaagacgggaggggagaagaaaccagccaaagacgcacctgaatcaagcaagaagaaaagtaacaagagtgggaaaaggaaagctcaagtggaagtcctcgcgtcggaatatgagtgccctcctaaacacccaaaccggcagcgacacgaagagaatatggtaccccatacacaagtcggacagacattctctagaggattgcctcgtcttcaaaaagtcgctggaaaagcaactggcattggagaaaagcaagcgagtacgggtagtcgagaaagctgccgaggcaaccactcaggactcggattcggcatatccagattccggtctccatgtctcgcacatcttcggaggttccatggcatactcctcaaagcgagaatacaagaaagtggagcgtgaagtttgttcgacatggcagggggctgcacccaagataaagtggtccgaacagaagattgagttctcagatgaggaccaccccaaggctgctgttatcctaggacgatatccgatcgtggtcgaacccactattcggaatatcaaggtagcgcgagttctcatcgatggcggcagctccatcaaccttctctttgccagcaccttggatgcaatggggattccacgaagtgagttgacacccaccgatcaacccttccacggaatcactccttagtcatcgtccaagccattaggcaagatcacgcttcctatgactttcagccaagcgagcaacttccgaacagagcagattacgtttgatgttgctgagtttgacacagcatacaatgccatcatcgggagaactgcactcgcgaagttcatggccgcatctcactacgcatatcaagtactcaagatgcccgggccgaagagaacaatcactattcaagggaacgcaaagctggccgtccaatacgacaagcgaagcctcgacatggtcgagcacacgcccagcccacccaccgcaaccgagccacccaagaaagtgagcaaaacaaccaagacgccgaaaccagaaggcgtaatcaaaatcgttccactctccagcgccaaccccgacaagacagtcaagatcggggcatcactggacgagaaataggaactcgcgctcatcaccttcctccgcgacaatgttgacgtgttcgcttggcagccgtccgacatgtcgggggtccccagggaggtgattgagcacaaactcatggtgcgacccgatgccgagccaataaaacaaaaactgcggagatttgcaccagatcgaaaacaggccatacgagaagaagagctcgataaacttctcaaagctggttcatcagagaggtactccatccagagtggctagccaacccagtcatggtgcggaaggccaacgggaagtggaggatgtgcgtcgacttcactgacctcaacaaggcgtgccccaaggatcacttccctcttcctcaaatagaccaactggtggactcaacagctgcttgcgagttgttaagcttcgtagatgtttattccggctaccaccaaatcagcatggcaaaagagatcgaggagaagacatcattcatcacgccgttcgctgtattctgctacgtttaagatgccgtttggactgataaccgcaggaaacacgggctgcaggaat

SEQ ID NO: 68345 - DNA, 1406 bp, Oryza sativa
aaaatagcacagtcacacccgacatctgctcgggggctacagaggcagaatgcgtcgttgctgacatcgagacctcagatgactggcggatcccactaattaaattcataagtagcgacgagctacccgaggacgatgcaaaagccgagaaacgacgatgtgaaccttctcgaagaacatcgagaacgagttgccgtcagagcagctagctaccaacaggcccttcgccgataccatgagaagcgcatccgagcacgcacgctttcgatcggcaactacgtcctccgacgggttcaaagccaagcagcgcaaaacaagctctcacccaaatgggaaggaccgtacacgatcacgcaagtcctgcgaccaggcgcattcaagatttcagacggcgatggtcgcgagttggcaaattcttggaacattgatcaaccacgtaaattttatgtataaatcaatagcatccatacttgtaagacatattacctcttcaataaagtcttctttcaggaaaagattacaactaaagtgttccttcccgatgatccattaccccgatgacacctagcgttgaaacctatcctcatgtcctttacgccgtcttgacaaggcctccgaggaacctaagggaacttcggctggggacacccagagccgataaggccttgtcggatcctgtagagacgaaagaccatgtaagatctggtcgtgtaagagttctcgtcgtgcgtattaaccaagccgtgtaatcggaaattggattttccaacctcacggctaggggctaggattagtgtttgttcaaccaaggcaggtcaaaggtccaagagccttatcttccgagaagaattctccgatgacaaggctgggggttagggagagtgtatgactcaagtgactgatcgaagtcgctaagtgagaagacactcgcacacaccgcatacagagtaagaaagctcagttagatagatctcttttctatttcacaagtattttttacagctcgcaaaaattgaaaatatattacaatctaccctgagatgtttgtcacaggatacagaaactaccagcaagtccaacgccaatccatcgactgaaagattttctccgcaagcggtgccattgacttcgccaggtggtctatctctgcgggagtccaacgagaacgtgcaaacccttcgtggaggaactcgaggtgcagctgcggacgattatctcgtatacaggccaacacgtgccctccggcatatcggctcgatcgacggcactcctgcttcaaggcctcgtcgatacgcttgccgatgccttcaagttgggcacaggccccattcagccacgagatatacccggccaccgactcctcgggatccccgcgagatacttggagttcccggcagactccggcc

SEQ ID NO: 68346 - DNA, 3061 bp, Oryza sativa
cgtcttccgacgatttccgagcacggaggagaacttcctcccccttttcggaacattgccgccactcatcgtggcagcagcggcagcaacatcggacgcctccttggcgacgtccaccttcagcgaagccgccgcctggtggtccacgagcggtccgatgatatcagtaagagggagagcctgcactacataaagtcacaatgcgatcccggaggaaaaagacaacagggccgtcgagtacactcacattgatcgcggcttcgcgttcagctggctccttctcgcaaagagggacggggacgttgctcgccgttgtaggaccgctgatcatcacttgaccgacacggtgctccacggtttcgctgttcaattgtagatcgaaaacagaaatgataagtcaggaggaatacacacttaaggaatggagtccaaaatacaagaaaaataccctgaggagaaacctgggtcacgtcctccggcccagaatagtgaaagggtgggtgggctcaagcctagaacagctggatctgcctacgaatgaagtcggcagcgacttcataccccgacaatccttgtactcggaggtcatcgatgatatcgatgaaggactgaagggaaggggttaaggcgggtttggcggtgcaagaagaaatcttgtctggttgctcctcagggacaacgaagactggatccgaattttctatctgaagatagaaccacctcgcccgccatttactacgagaagaggggcactagaaggggatgtagcgcgacttcaggccatcccaaagtcggaaaccaacgcatccagataccctgttggatttcatccaacgcaactcgtagtagaaacgaaagaggtcgagaaatggctctactccaatataggcctcacaaagatgcgaaaagatactaaggaaggcgatggaattggggttcaaatggagcaaagaaagaccgtagaaattcaagaccaaaagcagaaattcggaaggaggaggaagaaaaccacagagaatgtagtcctcaactgcaaccatgcggcccaggactggctcagggtcagtacctcctggttctctctccatggccccgcaaccggggagagcgccgtcctcctgtaacttcttcagcgacgcgccggtggaagtggatttgtcgagatccattgccgtcggagatcgtcggaggagggacggagatgaacaagctagggttttgcgggagcggagaagatgaggagcgcttagagactgaaaagttctttcgcaacaggcggacttcaaaatggatccccaaaactcttttaaaggcgcactaccggcggtgcgatttccaaggaaagaggagagatgcccgccgaaaatttctgggtccgttacgcgcggcagtttttggacttcaatttaaattcactcacgaccgttgaacttttcatagcgttgtcgattactctttgtctctacggtccttacgccgagatcgactagacgagaacgacaacaaacccaacatcagaagtcgcgatcggttacatgagttcatttaagtagaagtcgggggctactgtcagggttacggataaggtataccctctacccttggatatatgctatacatcggtgtggtatatctgcgcgtatacggacgttctttgtatgcgctaaggtaattcatcgcggagtccatagatgaaaagattcctacccggataggactgggtcgtaactgtatcatgtagggtccgatgtctccgagtcctacttggaaaccacctgacctgcggtataaaagggaccccccccgggaggacctaaggcatcgaatctcacatccgagacaaccaccatagcctacgaagccggagcctacaggagccaagtcgccgggtgatctagtcgactcgactacggtctcgtcggtatcatcgagttccactgttccctttataatctctgatttccatcatataatcccatatcaactagattagggctattacctaccaaggggcctgaaccagtataattcatgttttctatttgcttgatgtcatattacgtagatcctcgtaccagtgtaccccaataccctctatatccggtctacgggtatccccagtcgacatatatgtaaatcctaaatacatattaattacatatgtaagtaatgtgtaagtggggtgtaactagtatgtaaatttgtataaatatataattacaacaagaaagttgactactacaaacccatagcaattccggatcaacaaataaaataaaaaaaatgcaaagcgataaacaggtggaggaacggatgtgcatcgtgcacacgatgtccagcgcagcgcatcccagccgttaaaatccgactgtactcagccacgtaatgtggcgacactttttcagcaaatccgttaattaattcttccctagctattaacttggattgtcaaagctacgatcgacatggtcagcgagcaatcgaattacagtttatgttgccgagaacaatttgatcatcttttgaacgcgtgcatcctcaccaattagttttcagacacgatgcatgaacctaattaaccaatgctcttcttcttttatgcatgcataaacgaaagatacaatcccaagacgaacacttgcaattgccgacttaccgagaacaatatactatcttctactgagttgatctgaggttaaacgagaaagacaagtttcatataaattaagcatttcctttgatttgaatgtttcagccttagtgccttacttaccactagctgactagctgtagctacttgatcaagtatcccctctctacttcatcactcttctaattgcaagtgttcgtcttgggatttactggagccggtcgaagagtgatgggcacacagtttagtactccctccgtttcaaaatgtttgacaccgttgactttttagcaaatgtttgactgttcgtcttattaaaaaaattatgaaatatgtaaaactatatgtgtacatgaaaatatatttaacaatgaatcaaatgatatgaaaagaataaatgggctgcaggaa

SEQ ID NO: 68347 - DNA, 743 bp, Oryza sativa
ttcctgcagcccatgtgatggaggagaacgccatggacgtcgtcgcgagctctgcgcaagaaagaacggcacagttgcttacagttgtaagaagcaacgagtccattgattaactgatgataaaattggcaagaaacgtaatgccaagatcattaattacgtcattctggagttcatgtgattcccatcaattctgatttccctccaactgaaatctgcatgacgaacagagccaaaggtgagatttttacaggaaaatgctgtctttttctgaagaactaggtgttggtttgcaattactgcccatgtgaagagcagtgctactgctatatctacaggtgtgctcccagaattatgtaactgcagccaagcaacaaaagtttagcgaaaaaaatgaacagatcatttggtgtcattttcatctgcagcagtaacgagaaaaaaaaaaagaacggatgcaggatggcggacgggcatcctcctccccttcccgtccgggcgatgttcgtgaccaagtcgcagggaccgacggcgagcgcgtcaccagctaccttacgttggggccgtccaactccggcgatgttgcggtgaaggacatgtggtacggagccgcttcttcattctgcccaagctggtggcggaagccgacgcgacggacgctgatccgacgaccaccactgctctcgccgtttcacaggagaaggaggaggagagggggcccgtccgcccgtggtacaccttcg

SEQ ID NO: 68348 - DNA, 1620 bp, Oryza sativa
ttgcttaaaagaggttggaaagggaaggattcaaattgtcaattttgctctgggcaggagacaatagaacacttgtttctcaattttcctgttgctagatttctttggagagtggttggtagtgtttttaacctgaaaatagcaaataatatccatcatctttttggtggatggctttgtggcttcaataaaggagataagggtttgatcgtggtgggggtggcagctctcatttgggctctttggaaggctagaaatgctgcatgtttttttaaaaaaactgtatgatcctgtggaactgatacattctatgtgttcttggatcgaatcttggtctattctgcagatatcggaggacgtgcgaggaaatctgcaaatgggggcagctctgctaaggagggtagccggtgatctctacaatgcaagtcatggatggaatccataagtcaggcgtttggggtgttgaatgctggctgtgttgctgaatgtcttcggttttttttcatctttgagctgccgtagttaacatggctgtcatgttttgggtcaggccccatgggcttgtgtgatgtttagtctttttacttgctctgaaccttttgtaagaatcttatcatttcgttaatgaaatgggagggtctccgccctctgtctcaaaaaaaaatgtgcaccaacttcttgttgcctggcccatgcatccgtcaaatcgctatgccaatgatgagcacgtactgagcacacgtctttgttgatgtttagctaacctaattggaggaccagctcaaggacggcatgtccaaactggattgagatccagtacagttactattgcaactgcacaatagcaactcaacacaatttgagccctctatttctagattcaatgatccaaatcgcttgctacagtgaattcgaaaatatattatttttcagtaaatcgctatagtactttgctacaatattctgatgcatctagatcttccattttgaatccagtggtgcttgtgtggctgcctaacttgcagtcacactagctactgcacctagacgaccgaatccgtccaaaccatatatatactcactatctgttctaaaataaataaacatagtacaagactctgctactataaaacttctaatagagaatacctattagttcatctaaatctggtacaaaggtttttctcatccttctaaacctttagatggttcaaaattaaaaaccaacacatataacacctaataaataccggacccttttattaaaaacccagtactagtatgccaattattaaaaaaccagtactagtactattacatgccggtttattatatagaaagaccggcacaaataagaaaaccatatcggcacattatcgttccaagccaaagtccggctctcccttgaccactcctttatcttatcctcctgggctcctttctctcacacaatcttcctcactggctcgtcctctctgtcctgctcaatctctccccacatccccacatttggtggtagcggagcaaacgggagaaggcggcatacacctcatctcccctcggcggcacctcctttcaacagtgcctcccctaagtgacagggcgagcgggaggaggcgg

SEQ ID NO: 68349 - DNA, 9525 bp, Oryza sativa
ggttgggaagtctgacatgtaggcaaatagcagggtgctggtagatggtctcgctgcctaaataatacggctcccatggcgttctggctctgccacaatatatatgttctgctaaatcggtagagaaaagtggttataggaaaaggcgatagtgactaactacagtgtttaaatcggcacctactgcgctcatgggttggacgtaagtactgcacgtcgctggctagctagctcgtcagctgcccgttcatgtgtgctggctgaccagccggatatatagcatcctcggtgtaaagtggggaaagtgatttcgggcttgttttgaagactactccaacttgccaagccacaagctagctcgtgccacaagtttggcgaacaatttgagagccacaacttaggctaagaaacttgtggcaaagtagttcatgagcacctaatttcttgtggcaggctaatatgtggtaagcaaacaaacatatgctaactacctgtggcacgccgaacttgaggcgcggtaaactgcggcacctatccaaacatgcccgaattcatcccctcgtttcgtgtataatacctaaaaagttataaaaaatataaaaaaaatttggcaacatagattaatatgaaatatatcactctacaaacatgcaagtttaaattcaacttctacaagttgttacaaaaataataaatatagttgtgaatgtgcgataactattttcagtttaatttgttatttttgctaaaacttgtagaagttgaatttggtcttgcatgtttgtggagtgatatatttttgtattaatctatgttgttaattgtttttaaattttttgataactatttagatgacatacaaacaacgaggggatatccactatagggatgaaaatcctcatccaagtgaatatgcttatatgatagtatatccgaaatatctagtacaagaaaagattcagagacaagaaagataaaccacatgaaaaaaaatcaccttcatatcggtaaaagaaataaaaggcatgaggcttcttgaaattcgaaactctcataccaccctaaaatagaagaaataagttgagcggctcctacaatttaatttgtattttcaccgctatgaatgagtctccaccaaataaataaatagttgtaaaatattgctatgcgtctagtcaattcaggacttagattttttacatcaatgacattagaagtttttggccatgcctgatactcacttggtttcaacatactatatgattaaactaattctttaaaatcctacaacattatatattatgtcccaaaatgctagcaaataacaatatcgccagactgaaaattagctcgctcctgtccattttctagcatacataagttacgaagaggtgtctaaataatacgctttatgactgagtatacatatttcaatctgttgctgagagaataacctccttccatagccaaaccccatccagccatcctaccctatgacatgagaccttatccacaattctatggacctcctaattaagccggagagagagagagagagagagaggaggctctctggaacgctaatcttagagaaaaaataaaaatcagtaattcacaagagaccaattgttattaagtatatacttgaatacttcgattattgccaccgttcacaaacagagacatatattttttttttagaaatagacatcctttttggaagcatgcatttagtcaaattaacctcgaaatataagatcaccaatatataattgtttaaagatgatatataaaaatggtattagcatacttgtaaataaacattcttttagttatatttttagtgcttattacaaacgtatgattagaaaggacaatatgataatatatacacttgtattagagactgttaatatccatttaatggctagcacagcatgcataactaggtacttgatggccaccgagagaccacaagatgcacgatatcaacatcaaaggagaatccggcaatatgttcgatacagttcatctggcccagattaggttccaggagataaatcatttcaccttaattaggtgcatagtgggggctgttccattgatccatccacatatatggtccttgcagccaggtcaccatgccacatgggccagcacaatgatagtccgattgatcagatcggagttaacatcagataattcgctaactgaactttttctaacaggacatatctactgatgcgtctgttatgaaaatagatgcacaacggagacacgaatttttacgtggaaaacccttgcggaaaaaaaccacgagcgccgaccggcaataatcactatagaggaattggatagcaggggatacattgggctgtcgcaccctccccgtgcggcttacaagggatatatataggagaaatctaggagtcctaataggaaactaatcctataaagtagagtcctattagataactaatccgaatatattgtgggcccaaaattcggatcacatatttaacaatctccaccttgagacgaatttcccttgtagcataaaaatcttcaacctctgaacaacctcatgatgataaaatcaatgtgcgccaaataatcacttggactataatccataacacccttaatccagaagaggtagaccatacttcaaactcgccattgggaacaattcctgaatctgctggtataacattgtggaacccagcagatacgcaaaactgatgcacaaacttcaatctcgccatgggaataaaatcctaaatctgctggcattaatttctagaattcaaacagaaacgcgaaaatttcttgtgcacaaaatgaagtacttagatcccctgataacctcctggtatgttgggtataatggtagcaaaattcgccggacaatttgatcaccttgtaatctagacaggagcgaggctccctcttgacgacttgaatgtacttttttttaatctcaggtgcacgacttatcctccttgaaacatgcgccaacttgcatcttcacttgccataacgagattgcatctcaatccaggagcggtagatcaaacttctaactcgccttgggaataaaatcctgaatctgctggtataatttgtcaaaccctaacagaaacgcgaaacactctaggtgcataaaacgaagttgatctccgtgcagaacctcctggtagactggcttgtgaatatagcacaaaattgaacctgaatctgattcacccaaacagaaccgaagcaccgcaattgaattgaatccctggtacgaaggggcatgtgcacgtagcacaaaaccaacgtgaaattcaattcacatgaacaataacaaggctgagtgcatctgctgatttttctttccttgatcaacgtgctggagtagatggattgctgctttttctccaacacgctgcacggcggcaccaaatcctgatcggagtcaacggctgactccgcttcgtaccggttaatcttatctcggcaaacaaatcaatctgacagcagtgatagatagaacaacgcgacgacacacgcctgctactgccgatcaaatcttgcgacgagcgtaccggcagcgtaccggcggctaaaacttgcagatgggatctccaagcagacgaactcgtcggcagccgagatgttagtagatcgatctccaatgctctggtaccacttgttataaaaatagatgcacaatggagacacaaatttttatgtgaaaaactcttgcgggaaaaaaccatgagcgctgaccggcaatgattactatagaggaattggatacaaacgcaggggatacttgggctgtcgcgccctctccgtgcggcttataagggatatatatgagaaatctaggagttctaataggatactaatcctataaagtagagtcctattagataactaatccgaatatattgtgggcccaaaattcagatcacatatttaacagcgtctttaattagttaacaatctgacgatcagtcatggtttgcttccttgatatggctggttttatgcggatccggttccgttgcggttggtggtgtgactgtaacttaagctgtcatactgtcgctatttgatctgactttaagagataggatcatctaaacactgttatctagagaaaaatatttagttttactatgtaggagttaagtagctgtaaatctgaactcttcgtaaagaaatggacggagatgagattagtgcaggtctagggatgactgcacctgatatcaatcggttctatgccgtgactgccgtcgcctgcggtcgtctctgcggcttcctgcttgcatgctttcagactgcagtaccgatcaatcgttgtgcaacagtctatccatctgtatagaatcaaaacacaattcagagccctataagagagaacggtgggcttgctattagtagagggaataagttaatttaaggtcccttaacttgacagcgagtttgattttcgttcttgaaccgcaataccaaatactacaggtccctcaactatcaaaaccgttcagatgagatccctcggtagtttagatgtcggttttggctgacgtggcgctttcctacatggcagtgacgtggcactgaaagcaaaattttaaaatttaaaagattttaaaagaatgtgggaccacataccagtcggaaaaaacagtgggactcttctctatctccacggcgagtcagcgcctcctctctccctcatgtcagcggcggacggcggggctagggcggcgctcggccctccgcttctccggccagggcggcgctcgccccttcgcttctcgcgcgcgacggggccagggacggcgatgttgtggcggtcagtagggccaagagcggcgccatcctctttagcctcctacctcaatgacctcgcggcggcagccgttggggaaccgagaagacggcaggcaccgtcgcgttccagtgggatggccggcgaggagggggccgcggcggtccgtagcggcgagtggcggttgcggtggaagttgccaatgaggacatgacgacagtggcttgggatggaagaaagcggcggtttcttagcagcgatgacgagatagcagtggcggcgtgcaaagtcgcggccgtcagcaggcaaaaccacaatgtcggtgcgtagtccatttagtcgtatgatgccggcaagtcgacgccatcagtgacgatgaccttagccgcatcaaggctgtggacgtaaccgtgccaggcagcgccgcgctcaccggcggatcccttcccagcggctgcagggaccacggctacacgccccgcctcggccgtcatctactccggccgccctgtgccgcctaggtgagagagagaggatagagagaagagggatgacatgttattttgtgtgtgactgacatgtgggccccacaggttttattatatttccggatagcattgccacgtaagagccacgtgggacaaagacctagtcaaaaggatccacagaggcgtcatgtcagccaaaaccatcatctaaaccaccgagggatctcgtctgaactggttttgatagttgagggacctgttgtatctggtattgcggtttagggacgaaaatcgaactcgctgtcaagttaagggacctcaaatgaacttattccttagtagagatacctgcatatgggccgaaagggtcataattcataaatccactacaacaatgtgtctgtacggttttcaattgctatttctcttctatcgtcatgtggtcaaactgtatgaaaattgcaaaatatggtccaaaatatgccgtttggggcatctgaacatggtattctctttccttcacttgactttgatagtaaaaagctttttttcattactactcacatagatatcttctcgagagtttagaatcatttccttacatagatgtacatgaatttacgaagatacaacaaacatccaatatgaacggataaattttacatccaatcacttgacaccaatagtagttgtagacctgtagtattgatccgaagatctgctacaatttgccaatatgtactagatcttcatgctcccctgctttttctgaagcctggccttccgttctcgcgacagcatctcggcgaaaagcaccagctcctcctcgttacttttccggttcatgtccggctcgttcttgccggtctcgaggtcgaccttgcacgcctgcttcttgagcagcgccttgccgacgccgacgagcctctggaggttctccggcgtggagacgtcgacggacgccgcgtcgccggtgagctcgtcgtcctggatgcggaggtagcgcttctcgcagtgcagcgcctggaagagcacggatgcgtggatgtcgacgaggtcggcgctggcctggctgaagctgtcgatcagcggcgtcgcgcccttgttgaacagccagccgaggacgccccaccggccgctctcgacggcgtcgaacttcttctcgatcttggccgagccggtgcccagcgacaggatcatgaacttgccgtagtccgccggcttgatcgggaagaagtcctggcagcccagcaggatctgcttggttacgtgtgtcatcgccagcagcgtctgcatgtgttgttggtcaggtgtcaaacatcgcacagtgtacatgagagcaacacaagtcatttccgtgccatatttaaggaagtttaggtcgacaagtttcacaagctaatttgatatgacggggctgttcagattgtagctaaaataaaccttagcaaattttggtatgctaaaattttggcaaaatgacaatattgccaaaattttggcaggatttcttatgtatttaccaaatttgacaacaaactaaacgtgaatatttttttgtcaactttactcaaaaaatggtatggttgaaaatggcatcaaagtgaatagacccgacgatttctgtttttcttaatttgacaagtaattaaattcagtagggatgtggattttcatccctcgagggacattctctcgttatttgaatgttatctaaatagttataaaaaaataaaaaaaaatttgtcaacatagattaatatgaaatatatcactccacaaacatgcaagaccaaatttaatttctacaagttgcaacaaaaataacaaattaaactgaaaatagttatcggacattcgtaactatatttgttatttttgttacaacttataaaagttgaatttaaaattacatgtttgtggagtgatatattttatatttgaatttaaacgtgtgtcgatgtgtcatcgccagcagcgtctgcacgtgttggtccagtgtcaaacgtcgcaaagtgtacatgagagcaacacaagtcatttctgtgccatatttaaggaagtttaggttgacaagtttcacaaagctaacttggtatgacgatttctgttttcttaatttgataggtactgtattaattaaattcagtagtagtccaccaagtctggacgactggattgtgtattccacaagcacggctactcaccggattgttcgcggcgaagccgccgtcgacgaggttaaattcccggggcttgccgtccttgtccgtcgtctcgaagcggtggccggggaggtacgtcggcgccgccgacgtgctgatgcacacgtccgacagaagcgcgttcttggacacgtccttgcgagcctgcacatgcgtgcaaagacacgaaacaattttaggacatgtacaattgcaacaagtttgtcagagttatatacatagagatcttcgtgacatacgttgtaggtcgagaagattgttggctggaggagcttgatgtcgaaggtcgggacgacgatgttggtgatggtgctgtcgacgcgcttgtcgccgagcagctgctgcacgacggagtggaggtgccggccgtcgtacttgggccccgtcatgctcttgaacagaccgagaggccccttgctgacgggagggaagatcctggggcagtgctcgaggtagaagtcgttgatgtccctggcggcgaacagcgggtcgccgttgtcgttaggcgcggtgagcatggcggtcaccagcccgccggtgctcgtcccggcgatcacgtcgaagtagttggcgagccgagcctcggggccgtccagctcctgcagtttctcctccaggaacgcgaggatggtgcccgggatgatgccgcgcacgccgccgccgtcgatgctcagcacggtgacgatgctcccgtacgacggcggcggcgaccgcggcgtggacggcgacagcagcgacttgccgcggctcagcacgcgctgcaccaccgggttcaacgtcagtgacccgttgctctgctccggtgtctgcacgggcgccatgggaaacactagactgtgctaaacaaaacaccgggagattttgtgtgtgtgtgtgtgtgtttctgcttcgctgatagcgtcgtctagctcgtgtttgtgcttggctctatcgttgatctcgatgtgagttcgctgcagtgcacgggcgatgaatttatacgcgaggacgccatcgtttccaacatgagaaggtctcgcggtctcgcctttgctggctgcttcgatcatcggaagcatcgcgcgtgcgttcgttcgtgcaggtgattgcattttggacgagtcagtggtgcgatggagttttgaaccagttggtcgcaccagcccagacacgagacagtcacaggttacccgtgcatgcacgggttcgatcgatcgcgtaccggcaaagagagatatgatcgatgttggacatatcatactactataggagtatgtcggagtacatcttggacgcagtctagctagctggtctttcatctttggcacgtgagaccgtgacccggttggtccactggacaggcgagacaatgttgccccagtcagctgtaggagcgtgtactatagtagcgtgccgtacactatggttgtatggtctctggataaaaataaataaatatataggaagatatataatgtaggaagatgatatggtttcagctgtttacccgttcatgatagattcttgttgaagctgcgcgcccgcgtacgtgtaccaagatatataatatttttttgttggaaaaagaccatacgattagtttggttcaatcttgacggcaatagcgccttcatcatcttcaaagttcgtcattgagaaaattcctttagttctcatcagttttcgctcaaatttttatgcgtttgaatttcctatcatttccatcacgcccttgagttttgtcatatttcactactggagaagtgatctgtagcgcccgttccgtcgtggcgcatagcgggaaaattatctcttaaaaaccctaattgcgaaatttgtttctttgcttgttgtctagtgtccatgccatctcaagatctcaatccccgatctatcgtcgagttcaaatccgaatccaaatccttccaaatcaaattcctccgcaaaagtctattttgcctcccccgggggtcgatgggccgatctcccccggcccatctcc

SEQ ID NO: 68350 - DNA, 9055 bp, Oryza sativa
ggcccatctccccctctcccccggcccatcttcccctctcccctctcccccggcgcgctcccgctctctctccctctctctcgctctctctcgccccctccccttcccggcgcgctccctctcccctctccctcagctccgctccgctccgcccgcgcgccgcgcgcgcgtgcgcgggagccgcgccgagcgctcctcctcctccgctctgtccgcgcgcgtgcgcgtgagtcaccgcgccaagcgcctcctcccctcgcaaagccggcccccgcgcgctgttgttcgcgcgtgcgcccgcgtggtcctcgcccgcaccgcgtggtcgctgcccggccccgctgccctgccgcgcctgcagccgctcggccccgcagccagcgcgtgtgccgagccgcgccctcctgttgcgagccgcgcgcgcgtgccgagtggccgaccgcctggtcgccgccgtcgtcagcgcctgccgcgcctgtcgctcgtgtcgtcgcgccgctccaaaccgccccgccgtcattgccgtcgtcaccgcccggcccccgccactccgcgcgcaagccgccaagggacggaggcagcgcccctcctccctctgccgcgtcgcccccgctcccctcctcctttttcccgaatcggcaaaagggcaagcccctttctccccctcctttttcccctttttccccgccggcgtcatcctccctgtcgccgctttggccgcgaccgccgagcgccagctcgcgccttgaccgccctaagtcggttcccaaaccgacattgccgccccctttaaacctcagctccttcccctccaatctccctcgttttcgcctcctcgccatagctgccgcccctgtgctctgttcgccgtcaccgttcgttgttgcgcgtgtcgaaggagtcggcacgagcaaggacgcggaaggggacttcggccgcaccctctccttcctcttccccggcccgaggccggagagattactcccgcgccgtcggcctctcgtcacagcgcccctcctcatctcggtgatgcctccctccgttcttcctcctcgctccatctcctccccctagctttcggtagtagctcgagtagactccccgtagttagccggcgccgccccgaccgttgccgtcgctcaccgtgtgctcgccgccgtcgccgctcgagctccgtagcacccacacgtcgccagcctcgctcggcgtagctccgtccaatccgacgctagcatcgagttcccgaaaccgcgtagatgctctcaccgccgggaatcggtccctcgtgacctcgtcggcgtttccctcttccctccccaccggttgtcgccgccgcgattcgccgccgtcgaactccctctggcgaatccgagccgttggctcgtctcccctcatcacgaacaaccgcccggtgtgctagcttttgcccgtatcgccgtggttcgctccgccgctcgccgccgccgcccaccgtccattcgcggccgggtcgtcgtctacctcctgccggcccgcgtggcagccacgtaggcgccacgtcggcgccagctcagcctagaccgggtcgagccaaccccggtcagtccctccccgtgcgcgcgttccaccgcgagccgtgaggctgcgcgtgggcccgctgcatccgcgtccaccgcgaaccgcgcgcgtgcaccgcgtccctcctccgcccgcgcgcatgagccgcgtactccctccgcatggtgagctgagccgctgacaagcgggtcccacccgggaccgcgcatggtgagcccggtccaccggctctctctctcctccctcccgcgcgcgcgcgtcttgggccgctctgggccaccttcctgggccggccggcccgttaagctcggccgagccgccctttctctcgggccgcgccctagccgcccgagggaagtctatattccctccctctccccttttcttttcttttcttttccaaaaaaaaaggatttaattaaatccttttcctttagaccaaaaatccaataatcttagaaattcaatatctttccagccgtaaatccgtttgactccgttcaaattccaaaatttctcaaatctcgagatctatctaatggcacgcttagaggtcattaatagggctttattttcgccgtttattgagttgtcccgttttgcgtgtagtttcggagcccgaagacccgcagtgcgaggatttcgaggatcaagctccagatctcaagcaaggcaagccacctttgaacatcttgagcctatatttgaaatctaattatattgcttgcaaaatattatgcattgataggattgcacttaatctgttgttctgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaatcgcggaccggggaacgtaacgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatatcgtgtgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttacttcccatggcttgctgagtactcccgtactcacccttgctctatataaataatccccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcaggactagttcggggcgtgacatgatctttgctgggtcgaccgattttcacaacagtcccgattctaataggaaccggaactaaaaattattttttagtcccggttaaattttttttgatctttagtcccggttcgtccatgtcaaaggtctgtcaggtggctaagaatctttagtcccggttggtgattccaaccgggagtaaagattaccactttagtgccggttggtaattctaaccgagagtaaagattatttagatctttagtcctggttggtaataccaacccctcgtatataatccctaaaatttatcctcaaatcctctagcttaaagtctttcttcccatcttcctctcctctctctcttatcctctcttattttcttcttatccactctttccttatcctctttccttgcagagacagagcgaagcggcggaggtggtctggcgtggcgcgggggcggcgccccgcgcggtgggggagggaggcgggagcgggcgacggcggcgccccgcgcggcggtggagggaggcggcggccccgcgcagtgacggcacagtggtggaggcggcaacggacggcggaggtgatgactttgtgatgattttggggatgattttgtgatgtaaatttgcgggtgatttttagatgctttttgaatttgttgatgatttgtgatgtaaatttgtggatgatttttagatgtttctatgaagttgccgatgaatctgtgatgtcaatttgtggatgattttgtctgtgtgtatgatttttgttgttgagtttagtgcaaaataaatatgcaagtagctaaaaacaataaaagaaaaaggaaagagaaagggtcagccacatggtgcttttattttttttctcccggttggtgactccaaccgggactaaagatcgtcatctttagtcccggattctctctcccgatttgcaacccgggactaaagagggttgtgaaccgagagagatatggggttctccaatagtgtttccttcatgttctttttaatttatacccatttcgttagttaatttatatatgtcatgaacgtattattactcttatatttatttgctaactcactgagaaaaacacaattcttaacctgaaaaaagttcatttgtaagaaaaaaaagggatagaattatttgaaaaactcaaataaactcatttgttttaataaatttcacatcacattacatgaaattcatacatcattttcacctaaatttaaacccaactagtggggtggcccgcggaattgcacgcttaccacctatatcgaattatctaatattttctaaatagtcaactcattattttagaatttaaaaaattaaatctcatcatcgttgggttttcaaatttatagttttaaagacacaccagccaccatccgtcacttatttgccactttacttgcttgttcggcccgccacggcttccatacaatcaggttttattttaatgattttctaaagtcctgtgaaacgctgccaccctacttttaaaggcccacccgctaccaactagttttggaccagttggtcgcaacaatcaagatttgttatatttttgtcctttttgaaaacatattttacaaagatcactgaaaaaacttaatcctacgtaacagcgccgtccctctaccactgtgcaacctagagatgacgtcaatgaaattggcaccatcgtcccaattaataacattggtgttggaaacggtggaggcaatgtttgttcatcctacaataattactacaacttgagaaaatgttcgcatcaatagtaatgagagtttatctagccatcaaactaggtggaccaaatattatcatattaaaacagtggtccatatttattccatctactaccttcatccaaaatgttgctatccagtactaaaaatctggataggcctctgtcaagattcgtagaacttaagatatccactactagagaaacgatctttgctagattgacccaaaatcacaatagttccggttccaaaaagaaccgggactaaaaaaacccacagctattttatgatttttaatcccgattggtaacaccaaccaggactaaaaatcatttttagtcccggttcattccctgtcagtaggatgtcagggggccgaggatctttaatcctggttggtgtcaccaaccgggactaaagatcatctttatagtcccggttggtattactaaccgggactaaagatcatattgatctttagtacaagttagtaataccaactaagactaaaatttaatacgtagtatataatccctcttccttatcctctcctccacaatcgcaacaacatctcacacgtacagatcccttccccttcctcacacttatcctcttcctcaccttcctcaaacttatcctctcctcctccccctcctcccctggcggctcgtcctgctttttttttttccggccggcggccggcgggtcgcgcggcgggtggtggcagccggcggggccgtgcccagtggcggccatggcgggcggcggccggcaggcggccggcggggccgcgccaggcggcggctgaaggtgccacgcgcggcggcggccggcggggccgcgcccggtggcggccatggcgggcggcggcgggcaggcggccggaggtgccgcgcgcggcggtggccggcggggacgcttctggcggcggccgtgccctctcgtctgccagccgacttcttccttttcttttatttttttttgataattcgtgattgattgagatatataattttgtgatggatctgagatgaatatgtgatgtatttaatttcggtgtattttttaggatttgtgatgtatttgatttgcttgtatttttttagaattggtgatgtatttgatttgtgtgtataaggaacttaagatttgggatgttactttgaattggagatttggggatatacatggcactagattcaggagaaaatatagggattaactctaagaaacaataaaaaaaggatcatctacactgcactgccgctaccctctttagtcccgattggtgaagatctatttttagtcccgggtatttgaaccgggactaaagatagcgatctttagtcctggattcgtactcccggttggaaaaccgggattatagggggttaccaaccggaagtaaaaaggctttctccaccagtgatcccatctgcagcaacattttgggacgaaggtatgaggtaatactccctccgtcccaaaatatggatagactctttatccatattcgtagtattagaatgtgttatattcacccaaatcaattatattttaggatggatgaagtattaattttgagttttgtaaatattaaataaatataaaataaagttgagactccataataagggtacaatttgccaattcagtacttactagttccgagaatttcataattattaaatcatgaaaaatgtttatagtgagactccaaacagagcacaacttttctctctatgtattaactccaaattaagttttggaattatttaatcatatggaaaaactaaagctgatctggtaagtattagcatttattatacatataatccatttttgtatttgttaaatttcaaatttgtataactgttaataaaattaaattatgtagtactttattccagatatacgacaaacaaagtttacatagtataacttttccaacaaaattaaagtacaaatgtaatagaaatatagcctgttcgaatgcatgcatgggttacgactaatgattatgctgttggttcagggagggaatttgctacacaaatagtattcgatacatgcatatatgcatgcatgtccgtgcatccatgtttactgaaggaaggccttcttctggagcctggccttgcgttcctccgacagcatcttggcgaaattctccagctcctcctcgttggtgcccctgctcatgtcgggctcgttcttgccggtctcgaggttcaccttgcacgcccgcttcttgagcagcgccttgccaacgtcgacgagccggttcaggttctccggcgtggagacgtcgacggacgccgtgtcgccggtgagctcgtcgtcctggatgcggaggtagctcttctcgcagtgcagcgcctggaagagcacggaggcgtggatgtcgacgaggtcggcgctggcctggctgaagctgtcgatcagcggcgacgagccgtcgtggtagacccagttgatcatcccccacttgccggactgaacggcgtcgtacttctcctcgatcttggccgtgccggtgcccagcgacaggatcatgaacttgccgtagtccgccggcttgatcgggaagaagtcgtcctgtttacccagcaggatctgcttgcttacgtgtgtcatcgccaacagcgtctgcaagtgccaattcatacatgtcagacatgtagacagctatatatatattaccgccattaagcacctatttggggagtttaagattctgagaagcagctgctgaaaaactagctggtgagaatctgagaagctaggaaatccggcttctgacttctagttcattttccagattatacaagtacagaatctgggtaaaaagctggcctgtttaggggagcttttggcaactggagattctaggagaagctgcatgcagctgctaaaagctccccaaatacgccctaaataggtatgggcatgttttctattgtaaagtttagtaattttcgatatctccggtaccaaatttacactagaaattttgcctttctcaaaaaacccgtaaaatttctcatatgtcagagttgtacaacacagccatgcatggtgccttaattagttaccgggttgttcgcggcgacgccgccgtcgacgaggttgaattcccggggcttgccgtccttgtccttggtctggaagcggtggccggggaggtacgtcggcgccgccgaggtgctgatgcacacgtccgacaggagagcgttcttggacacatcgatctgggcctgcatgcgatatatatatatgcatcgcatgtgtcagtacattgatatatcactaattaatatttaagttattggacacgtttaattacgtcgaatcgggagaaggtgatgggctggaggagcttgatgtcgaaggtggggatgacgacgttggtgatcgtctcattaactcgcttatcgccgagcagcgactgcaccaccgagtgcaggtacttgccgtcgtactttggccccgccatgctctggaacaatcccacaattggaatgctgcaaccac

SEQ ID NO: 68351 - DNA, 6023 bp, Oryza sativa
tcttggggcagtgcttgaggtagaagtcgttgatgtcctggcggcgaagagcggcggccctggtcgttgggcgcggtgagcatggcggtcaccagcccgccggtgctcgtcccggcgattacgtcgaagtagtcggcgatcctcgcgtcggcgccgtctagcttctgcagcttctcctcgaggctggcgaggatggtgcccgggatgatgccgcggacgccgccgccgtcgatgctcagcacggtgacgatgctcccgtacgacggcggcggcgacttgggcgtgcggcacggcgacgtcgtcggcagctgcgcgccgacgacggcgcgctgcaccaccgggttcacggtcagtggcgccgacccgctgctctggttcgtggttggcgccattgattccagctctagctagctaattatatgcaatataatgcaacggttagctagctaattatgctaccaagtcctctgctaaattaacaaagacgactgcgagagagatcgatcgatcgttcaccttttcctgctaaaaaggcaatctctcgtctggtctgttcgtcttgctcgatctgattgatagctttgtgacgcgctcgggccacgtatttatagtggaggattaaagaaagaacgtacacggcttttaatttgtacgtagcttatacagttgcagttgaagcgatcactataaaatttgtcgtttgcatgcgtcagttgcaccaccatttctgctcctaggaatggaacgggtgatcgaagaaaattttcacaagttggaagcgatcaaaccggcaagctaactaagcacacggtcagctgctacacttggcgcctacagggttttttaatttgttttctggccttcatgcatatgttgcccattgctgctgccttggcttgcgttagccggacacatacgtgaacatctgtacgtataggtgattgtgcatgccgtgcatgtgcgaattaatgcagacctgtcaactgttgtttccttggttaggtacgtagctttagccgccagtacaatattaaattaattatagttatataggcgcataactgtagaacaatatgttggttgcaatattaattaatctctcgaggtgtacgtgaaaatatacgcccccttttatatgtatcttttatatgtatgatgtgtgtcacaaaaaacttgcaatgtccgcaagagagagagagagataataagctaggttagaagaaataggaagaattaaagtacttgttgtctgtcaacaaccttttccatgctagtatggtttgtttcatgaacatggactagatcagtcatgagcatgtggttgacagacagcaagtcatggattttccttttgcatattccgtgaaagaaaaaaagcaagtcctgattttgtgtccctcacatttcaattttgtggaggagaatgatgaatttttgtggaaatgcatgctattttgcccctttgaccattgatttttgttccagagatagcgcaaagtaccctgaggccgtcttgtttagatcccaaaaaaattttggccaaaaacgtcatattaaatatggaaaaaaaattatacagattgcatgtaaattacgagacgaatctttcgagcctaattacgccatgatttgataatgtgatgctacagtaaacatttgttaataacggattaattaggcttaataaattcgtctcgcagtttacaggcggaatctgtaatttgttttgttattagtctacgtttaatacttcaaatgtgtgtccgtatacttcaaaaactttacaccaaagaactaaacacacccagagtgtcttgacgatatttctacatgtcggaagaagaatgtccaattatgttttgatttctaagaaaatcgggtctacagtaatatcttgcatgtaatttaaatgctacaaaaaatttaaaaattaactacatatatcacaatgtcatatatatatcactctacagtacaacattcaatctgtacacattccacggaagaaaaaacaaaaatttaactattgaacattacgtgtagcgcccgttccgtcgtggcgcctagcgggaaaattaaattctaaaaaccctaattgcgaaatctgttttttttttgcctgttgtcagtctccgtgtcaatctctgatctcaaatccccgatatgtcgtcgaattcaaattccgaatccaaacctccccgcaaaagtctagtttgcctccctcaggtgcggtgggccgattccctctcggcccaactctctctctctctctctctccctcagctctcccctcgctctgcccgtgcgccgcacgcgcctgcgcgtgcgcgtgagccgacgacgagccgagctccccctctctctctccccgctccatccctggcaagctcctcgccgcgttttcgcaaccccgcgcgccgttgccgcgctcgcgcgcgctcgcgcggtcgccgcccatgccacgcctgcgccgcccgtgccgcgcctgcgccgcccagccccgctgccctgccgcgcctgtggccgcgctgtcgctcggccccgcgagccagcgcacgtgcccgagccgcgccgctcgcgtctgtccaaaaccctgaggcagcgcctcccgctcccatccctctcctccccgagttggcatggctcgagctccctttccaccctccgtttcccgctttcctctcttggcccggcctctgctctccctccgctcagagctagcgccatggcagagggcagccgcgccgcgccagcccgtcctctgcgccgtttgaccgcgcccgtgatgccccgttccttcccctcgaagctccatcccgcgcccataaaatccgccctccccctctcgttcggttccccttcgctcgcccgagttcgctccaagccgccgcgccattgtcgccctgccctgctcgccgccgccgctcgtcgtcgcgcgtgtcggaggagccggcacgagcgaggacgcgtgacgtggactctgggcgcaccgtctccctcctcttccccggcccgaggccggagcgatcacgccccgcgccatcgaccatcgtcacggcgccccttcaccccgcacggtagtgcatcctccccgttctccctcctcgttcctcccctcctccttagctttcggtagaagcttgtatagcctccccgtagctagctggcgccgtcccgaccgctgccaccgctcgctgtgtgctcgccgtcgtcgccgcccatgctcgatagcgcccgcacgtcgccggcctctctcgtagtgtctccgtctaatccgacgctacgaacggactccggtagccgcgtagatgctctagtccgaaggaatcgaactcccatcgcgccgtcgccgttaccctcttttctcgccgccggttgccgccgccaaaatccgccgccgtcgaactccctccggcgaatccgagccgttggctcgtctcccctcgtcccgtgcaacctcccggtgtgctcgccttcacccgcatcgccgtagatcgccccgccgccgtccgttccggccggcgtcgtcgtcttcctctcgccggcccgcgtggctgccacgagggcgccacgtcggcgccacctcagccgcgaccgggtcaagctgaccccggtccgccgctcccctctgccccgctcgcgcgcgcggtccatcgcgaaccgtgaggctgcacgtgggcccgccgcatctgcgtcctccgcgagcagcgcgcgtgcaccgcgccccccctccgaaccctagcgccgcgttgcccgctccccgctcgcggtgagccgagccgccgacaagcaggtcccactcgggaccacgcgaggtggacccggcccaccggttccccctccctctcccccctccccccgcgcgtgcctttgggccgccttctcgggccggccggcccattagctcggccaggccgcgccccttctctcgggccgcgccctagccgcccgagggaagtctattccccctccctctttcatttctttttccaaaagggtttaattaaatccttttcctttagacaaaaatccaataatcttataaattcaatatcttctcaaccgtgtgtccgtttgactctgttcaaattcaaaaaatcctcaaatctcgagatctatctaatggcacgcttagaggtcaataatagggctttattttcgccgtttgttgagttgtcccgtttcacgtgtagtttcggtgcccgaagacccgcggtgcgaggatttcgaggatcaagctcaagatctcgagcaaggcaagtcacctttgatcatcttgcacctataatttaaatctaagtatttcttttccgcaaatattgcatgaataggtttatcacacgtaatttggccgtggcttgcgagatagcctaccggccccaatcctaaattgctgcaattaccctgcgtgaattattgaatacttaaaactcctttgtcgactgttgtgcttcgatgcacgggccttcaggcacgggcatcggaacacctcccctcaaattaaaacatccaacgatgggtaaaacttggggttttacaaaagacttggaaaacccgacacctgggtcggtgcttgcgaactaaaatgaatttccaaaatcgcggaccagaagacgtaccgggagtacggtttcccgctcttgcacttaaggaccgtttccttggaatttcatccgaacatatgacaagtgcgaccacatgggtgtaatgggacgcccatgtctgagtaattagctaatcgggggggggcatgatgccaagagacgtggattcaacggggtggtgccggggagaacccccgggtttcctggcacagtatggtctgggacctaacctggtgttggtctgggacccctctcgttggcatatggtgaacctgtgtcagctttcgaaatgccttgtcatgaaagcctcaaggtctctagatgtcacgccccgaactagtcccgaccggaactagcccgtgacgctccaaattaacctgttaatcgataccagtcccaggaaacagtgctggtatcacagggagacagagtatcatagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagaaagggtgagtacgggagtactcagcaagccaggggaaataagtgtctaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgcatcaatctttagaattgaaacaagattggcacccggccaacagcttttcaaacggccacccgggccaacaacttttcaacggccacccgggcctagctgatcccgtcagctgctgatttttcaaacatcgaatccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtgg

SEQ ID NO: 68352 - DNA, 9262 bp, Oryza sativa
tgcacccccggggcggcgttagctaactacggggaggctactcgagctactaccgaaatctaaggggaggagatggagcgaggaggaagaacggagggagacactaccgtgcgggacgaggcgatgtgacgagaggccgacggcgcgggagggcgggaaaccacgcggcgtgcgcgcgagcaacggcgcgcggggccggctttgcgagcggggagctcgcgcgagaggagggggcgctcggcgcgggcgactcccgcgcacgcgcgcgcggcgcgcgggcggagcggaggggagcggagagagaggcgctcggcgcggctctcgcacgcgcgagcagcgagggggggggaaaacgcgccggggggggagcgagagagagagagagagagagagagagagagagagagagagagagagagggcgcccgggagagagagggggggccggggaagagatgggccgagcggaattcggcccatcgaacccgggggaggcaaactagacttttgcggagggattcgatttggaaggaattggattcggaattgatctcgacgatcgatcgcggattgagatcttgagatggcacggacactagacaacaagcaaagaaacaaatttcgcaattagggtttttaagagataattttcccgctaggcgccacgacggaacgggcgctacaccagacgtggccattctgcacgggctgggtgatccgggttagtaatgttgagtaggtaaagtgtaccccctctgcagaggttattaaactgttcgaacaactgtgcccacggtcatgggcggatgtgaggtgattcctagcgtagttttgtttgactactgcttgtgaaattgctgttgtggaatgggttcgatgtttggaaaaatctgcggtggatgggatcagccaggcccgggtggccgtttgaaaagctgttggccgggagccaaccttgatctaatcaaagactgatacattgtgtcgacgtttgatgtcgcaattctggtatttgcatggtatggggatcgtcggtgctaaggtatacgtgagactaaggtaaaagagatggagacagggatttttatacaggttcggcccctgagttgtcaggtaatcaccctacatcctgttggccgaagccggtattgctcttattcaccataatcacatcagtacaatatttggggtagccaatctaactgttgtcgacatggcggtctgacgatctgactcgtagtcgacaacagggtagccttcctcctcgaatccgtgcccggcgagatcagagatagcgctttcgtttctcctgacactatccggagacaccgtagggtattagccgtgcttatccctgaagtcgatatccggcggcgtgtcttggcgtatgtaggcttctatgttgattgtgttgggtgttgatcctgtcgggtgttgatcccgttgggtgttgattgtcttttccccgctctcctcctaggggggcctgtatttatacccataggtgtccccttgtccaagtagaactagggaaaccaatatggatacaatccgagtagtccttgtcgtttccatgtagaactctggttgtctttccttatccggaactccctcgaggtcagtttccgtataagacatggtatgtagtggatcctgccgagatttagtcaactactattaggtatgtcgtatccataacactaacagtagcccccgacttcgatgcaaatgaacgagttcatattctcaaccgcagactttggaggaactgttatcgagctcacatgaccgttctcggtgagtttagagataacgttagacttcctttatcagcctcgtgcgggcaccgaaagggtttgtctaaatcaatctccgatgtcgaccgagaaagtacagagcgtacgactaagtctcccgtcttgctgtaatcgagaatttggattgaagttaagaaattttatctcggcggtacaccatctcttcattccgtattccttgtcgagatccagcaaccgttctcgagtgatcgagaaggcgtagagtctgcgacggaaccttgtcgacatttgtcgtactcgccttagtcgatcttggtgtagaaccatagagacatggagtcttcgataatgtcgaatagaattttcctgaaatcaatactcagaaaagaatattagatagaaatagcccccgagcgaatgctcaaagggtgacatgttataatatgacagactagtgaattgaatgtacagaccagtgctttgtatatgagcgtcttctttcttaccgactccgatcagtcagtttgtagagtcatacactctccctagcccccagccttgtcgtcggagaattgttctcggatgacaaggctcttggacctttgacctgcctcggttgaacaagcactgatcctagcccccagtcatgaagttggaaaattcaatttccgattacacggcttggttaatacgcacggcgagaactcttacacgaccagatcttacatggtctttcgtctctgaaggatccgacaaggccttatcagctctgggcatccccagccgaagttccctcaggttcctcggaggccttgtcaagacggagtaaagggacagtaggataggtttcaacgctaggtgtcatctgggtaagggatctctgggtaaaacacttagcgatcttgtgcacctgatatcaactttgttgaagcaggggtaatgggagaatcactacatcgctggtcgaggaccaggcagtagtcgtaactcgaccacttaaagtggaagtagtgggagaaacgctacatcgctggtcgaggaccaggcagtagtcgtaactcgaccacttgaagtggaaatagtaggaaaattgttacaccgctggtcaagaacctggtgtagtctaaactcgaccactagaagtaattgtacgagagatcgctacgattgactggttgagaaccagtgagtaggtgtctcttgatcatttgaagtcgtggtgcgaggaccgctgcgttattactgtagtcgtacctcgaccatctgaggttgcggtacgagagattgctacgtactggttcgaggaccagcgaacgagtagaattatctctcgaacaccaacggaagctgcagtgcgagagattgctacgtactggttcgaggaccagcgagcgtgtagaattatttctcgaacaccaatggaggtgctagagttggtttattacatgtgcgtctcatgtggctagcatgactcacacacccaacttgtagcatatccggatgtccattcgcaatcatgtcgggtgatcaagccgacggcgttcgtgaggaattatccgttaacaaccttttctcgagtagtccagccatggccggtgctatgagataggtcgtcggtcttcgttggtaggtcggttgcgataactccgcatttgtcgagaatgttctcgataatagagtgtactcgaccacaacctactcgagtgctcaattgttcctgaaaaatattttctagaagacaagacatatagcagataatatcgagtatgtactcaaaaaactgcatggatcttctagtattattatgacataacgagtagatgtaaatgtcagggcattatgtgaaccgtaaataagcatgatttatacagaagaagacagcgagcccccagcgttagatcgtagtcgatttaacatcggggacacccgcgcaacagatattattgtataaagaacatgctctaggtaaacataataaattatagatctgacaatactgtatgatctgaataggtacgataaattgcagataaaatattgcgtacctttgtagatacatgccagatgtatttacgaaattagtagattgatttaaaaaaccaatctaccaattaccttgttgcgtactcgttcgatatcatgcgatctgacatcttttggtacgccgcaaagcttgaggcttggatgatctaaatagaccaagttgtcaatgacgatgatggttccgatctggttaggttggatctccccctcagctgaagtcgtcgagtagctcattgtcggagaatccatcttttgaacccatctcgtcgaaatcctgaagcaccaaaatccccctacctggcgcgccactgtcgacgtttgatgtcgcaattctggtatttgcatggtatggggatcgtcggtgctagggtatacgcgagactgaggtaaaagagatggagacagggatttttatacaggttcgggcccccgagttgtggggtaataaccctacatcctgttggccaaagccggtattgctcttattcaccataatcacaccagtacaatatttggggtagctaatctaactgttgtcgacatggcggtctgacgatctgactcgtagttgacaacagggtagccttcctcctcgaatccgtgcccggcgagatcagagatagcgctttcgtttctcctgacagtatccgaagacaccgtagggtattagccgtacttatccctgaagtcgatatccggcggcgtgtcttggcgtatgtaggcttctatgttgattgtgttgggtgttgatcctatcgggtgttgatcccgttgggtgttgattgtcttgtcccccctctcctcctagggggccctgtatttatacccataggtgtccccttgtccaagtagaactagggaaaccaatatggatacaatcctagtagtccttgtcgtttccatgtagaactctggttgtctttccttatccggaactccctcgaggtcagtttctgtataagacatggtatgtagtggatcctgccgagatttagtcaactactattaggtatgtggtatccataaccctgacacattgcacatactccgaccggacgagacgcactgtctcatccgtgtcgtttgagaagcactcatctagttatttcaaaaatgagtttaattaaaatcaatcgcaaaaacaatagcccttcctttgaagcatgcatttaaacacttaattcccatgacttgctgagtactcttgtactcacccttgctctatataaataatctccccccagttgctgaagaagatgaagtggatgtcacgaccggaattaacccaacgggcgttccttacgtgcgtgtattattccttgtcccaggaggcaaggtacaccgaaagttgatatatttcagagtttatcaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaaaattgagcaagactgagtacaaccaacgtactcaacaagacacacccacaagtgcaggataaatgcaagggagtaaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataacggagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctagcagcaggacaccggccctgtgccatgacatctcgactaccgggccgcagctcgtgtagccttcatttgtcctagagatgtccatcgacccccaacttcgtccatctccatccgtgtacttttgtttataaccagactgagccacaaactaagccttactgtcacgccccgaactagtcccgaccggaactagcccgtgacgctccaatttagcctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcaggatccgcttcatcttcttcagcaactggggggggatatttatatagagcaagagtgagtacgggggtactcagcaagccaggggaaataagtgtttaatgcaggcttcaagggaaggctgttgtttttgcaattgattttatttgaactcttttctgaaaacaactaagtgagtgcttctcaaacgacacggatgagacagtgcgtctcgtccggtcggagtatgtgcaatgtgtcaatctttaggattgcaacaaagttggcacccggccaacagctttttaaacggccacccgggccaacaacttttcaaacggccacccgggccaacaacttttcaaacggccactcgggcctagctgatcccatcagctgcagatttttcaaacatcgaaccccttttcacaacagcaatttcacaagcagtagacaaacaaaactacgctaggaatcacctcagatccgcccatgtccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaagctcccccgattagcaatttactcagccaggggcgtcccattccacccatgtggtcgtacttgtcttatgttcggatgaaattccaaggaaacggtccttaagtgcaagagcgggaaaccgtacacccggtaggatccccggtccgcggttttggaaattcatttggttcggaggcaccgacccaggtgtcgggttttccaagtcttttgtaaaactccagttttacccaagttgttactcagattttaaggttgaaggcgaccgtcgatacttgcacagagtgcacgagtatcgaggcgcaactgggtggttacaaggggacatggtatagcaattaacaaaggaaggatcaaatgcgacaaattaggtaggtccgccaatctgccttgtagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactatacgcgaaatggaacaactcaacaaacggcgaaaataaagccctattaatgacctctaagcgtgccattagatagatctcgagatttggggaattttggaagttgaacggagtcaaacggatttacggttgggaagatattgaatttctaagattattgaatttttgatctaaaggaaaaggatttaaataaatcctttctggaaaagaaaaagaaaagaagggagggagggaatatagacttttctcggatggctagggcgcggcccaagagaaatggagcggtccggccgagctaaatgggccggccggcccaaggcagcccaaactcgcgcgcgcgcgggaggagggagagagagagccggtggaccgggctcaccatgcgcagtcccgggtgggacccgcttgtcagtggctcggctcaccgtgcggagggagtacgcggctcatgcgcgcgggcgggggagggacgcggtgcacgcgcgcggttcgcggtggacgcggatgcatcgggcccacgcacagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggaacgaaccacggcgatacgagcaaaagctagcacaccgggcggttgctcgtgatgaggggagacgagccatcggctcggatttgccggaggaagcttgacggcggcgaatcgcggcggcgacaaccggcggggagggaagagggaaacggcgacgaggtcacgagaggtcgattcccggcagtgagagcatctacgcggcttcgggaactcgacgctagcgtcggattgggcggaactacgccgagcgaggccggcgacgagtgggtgctacggagctcgggcggcgacggcggcgagcacacggcgagcgacggcaacggtcggggcggcgccggctaactacggggagtctactcaagctactaccgaaagctagggggaggagatggagcgaggaggaagaacggagagagacactaccgtgcgggacggggcgcagtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgaggcagagcacgggagcggcgacaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggacagaaa

SEQ ID NO: 68353 - DNA, 15434 bp, Oryza sativa
  unsure (1)..(15434): unsure at all n locations
aaagggcacaaaaacaggaaaaggagggacagaaagggggctcgcccctttgccgattcgggaaaaggaggagggagcggggcgactcggcagagggagaggggctctctgcctccgccccttggaggctagcgcgcggagtggcgggggccgggcgatgacgacggcgatgacgacggggcggtttggagcggcgcgacgacacgggcgacaggcgcgggctggcgcggcagagggtgacggcggcggcgaccgggcggttggccactcggcacgcgcgcgcgggaaacaacgggcggcgcggctgggcagcgggaccgggcgacgcggacggcgcagacgacgcggctcgggcgggaaaccacgcgggcgcgcgcgcgagcgacggtgcgcggggccggctttgcgagcggggagctcgcgcgagaggagggggcgctcggcgcggctctcgcacgcgcgagcagcgagcggggggggaaaacgcgccggggaaagcgagagagagagagagagagagagagagagggagcgcccgggagagagggggccggggaagagatgggccgagcggaattcggcccatcgaacccgggggaggcaaactagacttttcggaattgaactcgacgatagatcggggattgagatcttgagatggcacggacactagacaacaatcaaagaaacaaattttgcaattagggtttttcggagataattttcccgctaggcgccacgacggaacgggcgctacacttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattcaaaagtgtccaggtgatgagaatattcctaaagtctagagttgtaaaaccacctaatgttgcctaatgaaccagcgaagcatttacctaaaatcatactagtggtaccatgagtagagtgtccactagttggggttttgtttattctaggggaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcagcttcaacttccacgaagagcggatcttccgaagctacggcgtctacacgaccaacggaaaagaaaaggcttttactctaataaactccatataacaagctggaacaaagcacaaaaataggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggcttattgcgtcagccgaggggagggggcgcgcggaccgggtccacgggagtggggcccacgcggcagcctcacggtccacggtggaccgggtgcacctgggctcacaccgaccggcgccatgggtcccacgcgtcagccgcacccgagggcgcgggcggctgacggccgggccccacgcggcagccactcggcgcgcccgagggcggccaagccggcgtagccggcgggaggcggcgcccgcgcccctatggtcgccggcggcggccataggcacggcggagcggcggccgagagaggggaagggaaggggaaaaagaagcggcggtccacggctcaccctaggtcgacagcgacgacgaaaaaggcagccggagcggaggaaggcggcggcgcggctcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcgacggcgacggcggagagagagcgacggcgcgagctcgattccggcgaggaggaagggcggcgagaggcggaaacggacggaggaggtgcggggagggtttaaatagagttggaaaggggagagagcggccggcggggaaggaataggcgcgggaggtccggccgccatcaatggcgccggcgatatttgcgggggcaaatccgcccgtttgaacgtgagagagagagggaaaaatgggggaaaagggagaggggatcacggggagtgatttccccctctttattgcacgcggagacggcgggaggcggcgggattcgcggcggtggcggcgctagggcgcgggcgaggcggcgggagcggcgggaggaaggggatgacgggtgggccccacccgtcagcgagggtggcgggcgggcccgcccgtcagcggcgcgcgcgcggggagaggccggatgggccgcggggagaggagagggagggggagggagatgggccgagccggcccaagagggagagggagggaaaggggactttttagagattttctttttataaaatcattttaactttttttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcattttgggacgtgacagtggatcccgctgacgaggagttcttccaggagcaagtcggctacgatgagttttaaggtttcggcctagtttccaagtcgcgcctgtgataaatggtccaagtcttggcttccgctttccctttttaatgcatttgtgagctcgggatctgtccgtagcccaacatgactgtactcctactctgtaataaagagacctctgttgctgtgataatctgtcttcctgtgataccaacactatttcctggggccggtatcgattaacaggttaatttggagcgtcacgggctagttccggtcggggctagttcggggcgtgacattacggcttttattaaatgtcatctttttttttttagaaaatggatttaaacctggcctctacacccaaaagtgggtgtgtacatgtacagccaaaccttttattatgttcttaaagtactacaataattcgtttatccattgataagctctgaatattttgcggactgtcgaatgctatggccatggaaaaatatgcacgcctccttaaggaatatttaggatttaaatatatccaaaatatttttcactttagaaacatgtttaggatttaaatagaagttttaggcgacatagcctttgtggtgatctcgatgatgttatttttgacaaaaataaaatgatatatatttatcacccttatatgagctacacacatataaacatcatttggctctatatatgtacttgttcctgaaagggaaaaaaagactctggacttgttctttgatgcatgcaaaacaagtggtaaatatgagtttcttgtcctgttatggttggttgtccatgcttatgatggatagtttggcttttcttttaatcaggtaaagaaaactgttttggtgtttacccacaattaggaggtttgaattgtactctagctactttgtactcttgtatatctgaaaagaaagtgtgcatgcaagcattcacagtccttatagttcatcggtttttctattttctctacattttacagccctgttggtttaatttgagacttttttcccgcaaaaggaaaattgagacatttcaataccaacggcgcatccatttagcaggccccaaatttagctcaatcgccggcaccaaaggtttccccttgtaattaccccataccaaaatctatatactactacctcagtcccaaactgatcctaaaataattacaattctagattacttatcatatattaagatttgagaagaaaaactaagatacccttcattaaatggtgcatagctagtaagagtaggatgatgcctgaggatagaatagggataatgtcacaccccaatctgataccgccgtacaacggcacctgacaggagcgtgtcgtagggaaaacggcgcgaaccgcttcctacgaaaccgcgatctcggtaccagtcccaggacatagtgttggtacccacggtgacaaatatgaatcatagcaatccttaaaataaatagagtacttatttaccttaacttaggttgcagctcagacagcccgagaatacaaccgacgacacggatgaggcgaacaccaacaacaacagcagcagcagaaccaacggtctaacacccaacaccacaggcgacggctgggaaccaggacgaaactctaatcttcacttcactttatcttctcttcagggcggaggaactatatatatatatatttatatagagcaagggtgagtactttcgtactcagcaagtcacgggaacttaggtgtttaatgcaagtttggaagagaggcaaggttgttttgcaaatcttttatttgaagacattttgaaatcactaagtgatttatttctttctaagtttgggccgaaaagagacttgcgtctcaattcgactttaagagatgtttttcaacagctcatttagtaatgtaccgacctcccgggtcagatcattacttctcggctcccagagccattccacttgattaatcggctcccagagcctttttcattttctcggactcccagagtccagctgcccagcagcaaagcaatccgcttccactcaggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctattcgaacagttagttaacctctgcagaggggtacactttacccacaagacccgaacttactccagacactggccggtgtcagaggttcgcgacaaagcctttcccaagccgacctagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtctcattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacgatgtatgtgggatatttggtatacgtgctcagagagcacgaataccgaggtaccacaagggtggagcgacaaagaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaatttacggaattattgcaagtggaacggagtcaatcggacgagcggttggggagatatggatttcctaagattatttggattttctatctaaaggaaaaggatttatcaaatcccttggaaaagaaaaggaaggagggatgtcatttagacttactcaggcggcttaggctcggcccaaggggtcatgcgcagcgcggtcaggccattgggccagcgcgggcgcgggtggtcagcccattaggggcgcggggagagagaggccgacgcgggtggacgcggtccaccgcgcgggacccacatggcggtggttgggttcacggtggggagggcgcacacgggggcgggcgctaaggtttcgggtgcgcgcggttcgggcgcggcgcgccgggtggacggatggcggcgggcccacgtgcagccgcacggcttgccgtggaccgcgcgcacgggagggaagacggagggagggggcggctgactggcttggcccggtcaaggccgaggtggcgccgagatggcgcctacgtggcagccacgcgggccggcgggaggagaaagaaggggcggccgagatggacggcagacggcagccgagttcaccggagctcgtcgcgacgattcgagagagagggagtacacctgaacgatgggacggacgagagggagtgagccaccggatcggattcgccggagggaggccggcgacgacgaatcgcggcggcgcttgccggcggcggcaaaagagggaaacgacgacgacgcgatgagagctcgattcctagggacttgagcatctacgcgacctcctgagttcatttctagagtcggattgggtggagctacaccgaggaaggccggcgacgagcggctactaccgagtttgggcagcgacggcggcgagcctacggcgagcagcggcggcggtcggggcggcgccagcttgctactggaaggctactcgcactactgcccagagctaaggagaggagagggagcaaggagggagaacgggagatgcactacagagtcgagacggacgctgtgacgagcggccgacgacgcgggagcgagctctccggcctcgggccggggaaggggaaggagacggcgcctggagtcccgcgtcagctcctcgcgcgcacgccggcttcaccagcacgcgcgatggaggagggaagcgaggacggcggtagcaaggcggcaagggcacggtggtggcgagggaatgaacgagagggagatggggcggctcggtttaatagatggcaatgtcggtttagggaggaagaaccgacattggcggtcaaggagagcgagctggcggtcatcgacgcgtgcagccaaggcggcgacaggtgatgacgccggcggtgtcgggcaaaagtagaaaaggaggggaaaaaagtgagctcttctctttgccgagttggggagggagagggataggagcgggagctcagcctcacggttttggcaggacacacgtggagcggctcgggcacgcgctgcagagctcgcggcaggcagcggggccgagcggcagcgtagcgcaggcgctgacggaggcggcgaccgggaggtcggtcacgagcgtgcgcgcgcgcgcgggaacgagcggcacagccgaaaatcgaatggcggcagcgggaaatcggcgatggcggcagcgctggcgcgggagagagagatcgaacgagagagagagacagcgagagagaggaagaggacgagagagcgagagaatgtccgagagagggaagggagagagagacagcgctctctctctctcggtggtcacgtgcggcgcacgtggagatggagggagttgagaagagatgggccagcggcatgtttcggcccaaatcatcacgagggaggtaaaatagacttttaccagaaggtttgatttggagagaagtttgatgtggagattgaatttgaattcaatttgtatatttgtacacgagggttcaaggtggatccaagggaggggtcaaggaagggcttcaaaagcgggaattttggtatttttgggatggatttatatttggcggcacgaaggattatttcagaggatttcaaaaagggaagatcattattcaaaaatggaacaagggagatagcggtagaatgccatggatagatagatagacagaaaggtaggttgataggtagagggacggatagacagatggattgacagatggatagataaacagatagataggtatagtagatagatagatggatcgatcgatagatagatagatcgagactcagagagagatgggatggaagagaaggaagaggtggaccggaaaaaggatgaaggaatccaacctatgagggaggttaaatagactttcacagagagatttaattgggaggttttagggttggagtctggattcgaatttcgaggttgatactcggtctcgggagaataggaaggagtcaaggaagggaacaatattcggagacgagtcaaaaggggatggataatttagagaaagagagtgtaacttgggagtttgagtttgactactcaacgagatatgtgggtaaggattttggagagaagtctgaatagaagggttcggacttcgagattatttcggaacggaaatcattttggggagaactcagggcgaaagggattgaatcttgggattttgagttcaagggtggaagtgatctcgatttgcatattcagacttggatcagaagttcgagaaagagaacaagggtagattgatgaaccaatacagggagaaagatagatgaatcaaaacctgagaggttgaattcgaatttgagaatcggtttgaaggaaccaaggagagagcttatgacgcgaaggtgaatccttagatgaagttagggttcgggcattcgacaaagttcacggatggggttccaggaggggattccgaatagaaggaatcgagcttcgggactatattgggatggaaattttgaggagacgatctttgataacagggtatcgagacaagggagggatttaaattgagatctttggcacaacttagactcaacactcaaagaacgaaattttcgcaattaggattttgccgaattagtttttaacgtctcacgaaaaacggagcgttacagagaaattcaaatcaaaagtgattaatgaaatagttactactctattatgataattattttgggacaaatttgaatcctaaaaatacaattatgatggaacggatgcggtatctcggatagatatctattaacagactcataacttaaaaggatactccccctttcaggttataagatgttttgactttggtcaaagtcaaatttctttaagtttgacaaaaaaaatagtaatattttcgacccaagataaatttattctaaaaatatatttaattattaacataaaactagtttggtaatgtaaatattactacatttgtcaataaacttagtcaaatttaaagtagtttgactttatcaaaaccaaaacattttataacctgaaatggtttgaaatgaagagagtatatcttagaggcggatatagtagctacttttagatttcttttatatatactagggattaaggcaagatgagaaattaaatagggatgatctgtaatattggttaacatgacattttaaatactgttatatttttagacggagtgcgtaaataggaatgtaatttcatgttgccttttctactagcctcgtacagcttcagataatgctcctttagccaagctagcacaacgtgattacgtgaatgtgtcacgtgaccttctccaagccgcccaagtaactagctagataaactggtcgatctccgctgcgagagcaagataatgatgacaagctagctctcagtctccacgaattggagcaaagctggcgtgcgatatgatgcagcaatggacaaattcaagcagcctcagtaattaattaactcactttcaacttgctccaaaacgtgctgattaatctatcagtttgcatgcatggtcagtagttgattatcatattcattgacaatgatagacaccgaaacaatcgatttcgtgtccgctctcaaagataaactggttacgaacaaaaaaagatgcgcattttagtaagcccccttgcgtagaacacaggggatattataactggacgatacaggagaaaattaaaaattaaaactttggtagcacatgcatacaaacatatctgaatatatattccgttctgcgagttttaattttctacagtttttgaagttcataggacaactttgacacacttctatatatatctcgtattattgtgtctcgatcgatcaagtagtgtttattcaaaaaatatcgtacccgttcagtatacggtatgttaattatcatactacataattattaagtagctcgatctcacgtatcacctacggtatctgaccgtagaaaggatcagagttggaggtttattaataacaagtaaaattcaactttgtgtgcctgaaataattaagatagtactggcataaaatacacagtattgagatgacgtataatttgttcagatacatgcatccttaactgtcattagaatattgcataaaagcaactatattaattgtgtttgtggacgcatgtcatctagcgcataattgatctattttttttgctaggagtgcataaatgatatcaccgtaatatacacgacattttcttctcgatcaatgaaattgcacggaaagctcctgtttcgtcatccattgggaagacaaatattttcctttcgtagtttcgtttccaaaatatggagacgaggtactgaaaggtacatacatctagctttgtctgcgtcgtccatggtgcttaatggagtacgagtagaaacaatgaaaactaaacacggtatatatactagtggtcttgactattgactttttgaccggcatcagtaagacacaatagttttgacatttgaccggcaacacatgcacaagcacaggcacatgcatgaattcataaaagttccattattcctgtataggatgggatacttcttaggactaccaatctagacagattcattaggtagtgacaatttataacggagagatagtatatatatatatgtgtttgtgtttataaatatttaaattttacaaaactataggtactttagtcaaattattgtaaaactatagatttaaggtgttgtatcgtaaaactactgatttaacaataaacttatcacaaaactacatgtttaaggctaaatatctcaaaactacatatataataataaaattatcacaaaactaaacatgttggggtttaatatccaagttttgtgataaagttgatataaaacatatagttttgtgataattttgttactaaatttgtagtcttgcaatatttcaccttatatgggtggcaagttacgttggatgtcgtacgacaacaattttcataaactatatacccaagataatcggaaactcttttagtccctcaaaattttataataaatttcacagaaccataaatatttcgagcaaactatcacaaatctacaaatttaaagtgtcagatcacaaaactacagatttagcatgaaatttctcacaaaactaaatatttaagatagtgtcaaataaaattaagatggagtgtaaaaaataaagattaggtagcaaatttatcacacagctataggtttagcaccaatctaatcacaaaactacaccatttatatagctccaacataaagatagtgttagggatttgaactctagaatctctaattatatgatacttggcttttcatatgtagttttatgacaagttttttttttgttaaatatgtagttttgtgatagaacaccttaaatctgtagttttgtgtgatagtttgatcaaaatatatgttgtttgtaaaatttactcaaatttttataaatagtatagaaaatcaaatgtaaactcagtttaacatatcaagaaatattttaaaaaacaaattcaatgtataaacatatcggtactattcaatctaaatttatgctctatattgtgaaattttctccaccatttacgttaaatttgacaggaaaaaaaaagaagcatatgaggggaagaaattagaatcctcatcgcctcatgaacacagagtacagtatatatgcatgcatggcagcacgttcagtaccaatttggctaattggctacttgatgctcaccacacattgaagtcaacggctgcttaattaagctttgcctgcactgccattccataattcagtgaaggctatattttactctagtactacctactactatggagtattttactccagtagtaagaaaacgtgtcaacgaaaattgatctatctaatctatatactccatgcatcccaaaatattattacctccgtcctaaaatacctaaaatacttgtcgatttaagtttttatttgtaaagtttgatcattcgtctttttaaaaaaattatggaattattatttattttatttgtgacttgttttattatcaaaagtatcttaagtatgatttttttaatttgtacgaatgtttcaaataaaacgaataatcaaacattaaaaaaaatcaaaacgaccattaattttgatatggaggtagtacaacataaaaccggagtagacatatcataatactacgaatctgaaaaaccaatcctaatatcacgaatcaagatagagatctatctggattcctcggactatatatctcgtttggttagattgcaatattttggaacggaaatattatatattagttggactttaaaagaatctcacattaataaaaagaacagtgaataaatttagctattcatctaagtgcactgggactaaattattgttgtttacttgagtttacattagttagatcttcccaaatattgatgtctaattgtaaattaaatcaatatgatgctaacctgaaagtccaaaatatttaaaatttcatgtctattcattacgattttcaaattattaggtaaaacaactgagatgacaggccaagtacaactgtatttatgaactttggatttcggaattaatatatcaagaaggaatttaagttgtaactatatatatttgttatttatgggtccatgtcaattatgacttgagaattattaattgaattttataagaactaataaattaaaatagtaataaatcaaaacaccaagatggctacaactccatgcttatttttacgtttgagttttagaattattaaattatgaaaaactgtaatttggtacaaactgagtacaattttatttgtattaattttgaatttcataaatcatttcatgtaagaaaagctaaaattacaacagtataacaagtacaactttatatttattaattacgtgtacattccgtgcacatcaactaacaaatatcataaaaaaatccaaaaacaatcaatcaatagtattacacttacttataacatcttaacctgaaattcattacattttagtcgtaaaaaaacaaaaattctgacagatttaagactacaagtctattgaaattttgtctttttattttttttaacgacttgcacaagacgatacgaagttctatcgatagagaaaaaaaaactacaagattacaaccctgaagggtcataaccaggaaaaaggaaaaaatatgccaccaccccacacaccgataacgccaacacacaagtctaggagaaggctagcacaggaccggccaccgttaagcgtgaccgaccgccactagaccaacaaaggaacacagacgagatcgtcccttagggtatgccaaaatgacgttttcaagaagagaagcgacggaaaaaccgccgccgccgtccgtcggggctcaaatgagccaagactaggctttcacccggcaaccacccttgaggtgtgagacagcacgacaacaccctcaggagggtgaatgaatcatcgttgtcggtccggccaaggccggactgggttttcacccgccgctcaccacctgcgaatctacgctgacgcaccgatgctccaccaccactcaagctctgccgacatctgggacccctgcaccggcgccccccgccggccagccttcatgcgccaaagaccacgccacacccaccggcagctcctcctcgcaccgaggtcgcctcctccaccgccggccacatctctcgcgccaagccggcctcctccaccggacgcgtctcttgcaccaatccagcctccctccattggccgcgcctctcgcgccaagccgaccttcatctccaccgctcgcgcctctcgcgccaagccggcctccgctgccatcggctacgcctttttgcgccaagccggtctccaacccctcctccaaacgatgccgcgccggccagatgcagccgtctgccaagccctcggctagccgtccgaggccgtcatacctccagtgatcgcagtcacggtcaccaccaccgcaaccgctgctgctgaacgcccagccacctcgtcgtcgccatcctcacctcgccgccgtcacccaccacggccagtcctcctcccgtccacggtcgctgtccggcccatcgcccgtgcatgccgaagctgtggacgccgcctccagctgctgccggcgccgaccgcgcaagccacttggaacaattttttctagattttttatgatatttatagttggtgtacatggtgtattcatgatggtttacgtgcataggatatgttctcatataaccaaagagagatttttgtacgtaccaaaatttatatactagctaggatgtattccggtgacttctcaggagggtaagatcattcgtatataaattgtgcaaacatacaacttggtcgacggagaggaccagcaaacaagcacaaccatcgctttgatagttgacttaacgaatccggccgtacgtacgagtagggtcgcctaaacagacaatacgatatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68354 - DNA, 2744 bp, Oryza sativa
  unsure (1)..(2744): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccgaaaggccgaaccatttaagcagctcggctgttccaaagcccattacaggttccagacccgaattttagtaacaaggaataagtctacggctctcatcggatggcctaatcagccaaagaaaaaaccaaaatttaaattttcaaacttaattttgagattgattttgagatattttcaacgtaatttcttttacaacattagcttttaagtcaccaagaacacatttataaaagtttcatctacaaatttatttttatttcctaagaagcaataggaaataagccaaacaatgaggacctagtagccaactggcaaggaataagacgacaaccgttgccgcgccttcacccgtccaccgccggcctccggtggtcgtccccctccgcaagccttcgccatggccaccactcggcctttatcataatcgttgcttagcttcctcgtaccgacagtaagggcctatgaagaggttttcactgacacatgggcactgaatttatcatttttttattttttgcaaatataataccacttcaacttaccacgtcaacaaaactacttcccaaaccatcgaaatagtcgatttgcacagaattttaataatagaaaatgtgttataccaggtttaacggttgcgattcaaccgagaacaaaacatgagagaggtcaaatagacttattccaattggcaagcggtgattcggcccagtaacaagggccatcttctcttgcacggtaggagtttgctccgtattctatttctgcaagcgcagactagggctctgtttggaatattagctcagggctaattttgagagctaatgtttagtcatgaattggtaggctaaacattagcctagggtggtatgtttggatccatgggctaattcaagactaaagggtgaagagagtagaaagagaggagagagaaggagagagagagctgctttttatggttctcacataaaattagccccattaacatctcttggaggggctaatgttttgaggggagctaattcacattagctcaaaattagcccatattttagattcttaagagttaatttgagactaagaggtgagagctaaatattagcccatgaaaccaaacaaagtgtttaggtggagagcacgaggccacccactccaaacaaaaaaacgttatcctgccgtcccacgcaggccaagtcaaaccgttgaatcgccagccttggaaaagttgaaatactccgccacgtcccacgtacgcgtggtgaccgacgcgacgctgcgttgctcgccgagacgccgaccacccgccgaagttgcaccaccaccaccgtcgccggcacgcgcagatgggagagcccgacgacgagatcacgttcgagttcctgccgctgatccggtgctacaggagcggccgcgtcgaccgcctcctcccggacacccgcgtcccgccctccgtcgacgccgccaccggcgtcgcctcccgcgacgtcaccatcgacccggccaccggcctgtgggcgcgcctctacctccccgacctcgacggcggcgagaggaagctgctgcccgtcgtcgtgtacctccacggcggtggcctcgtcgtcggctccgccgcggacgcgctcgagcacgggttcgccaaccgtctctgcgcgcgggcgcgcgccctcgtggtgtccgtcgactaccgcctcgcgcccgagcaccccgtccccgcctgctacgacgacgcgtggtccgcgctgcagtgggccgtcgccgccgcgagcgccgacccgtggctccgcgaccacggcgacagggagcgcgtcttcgtgctcgggtacagctccggcggcaacatcgcccacaacgtcaccctccgcgccggggccgaggagctccccggcggcgcgagcgtcaaggggatggcgctgctgcacccgtacttcatggcggccaagaaggccgacggcgaggtgaagaacgcgtggctgaggggcaagctggaggagatgtgggcgttggcgtgcggcggcggccggaccacggcggggctggacgacccgcggatcaacccggtggccgacggcgcgccgagcctgcgccggctcggctgcgaccgcgtcctggtctgcctcgccgacgacgagctggaggtccggggcaaggcgtactacgacgggttgctggagagcgggtgggcagaggacgccgccgagctgcttgtctccggcgaggatcacgagtacgtccaccgcgatcccgacagcgccaaggccgtggttgtgatggaccggctagccgcgctctttggcgggaaaaattagaacagcaattaatcacattctagtgacctgcaatgttgttgatgaatgctggagttttgttgcattctgagctgtttgagctcacaaaaaataagaagaaatgaagagagaaaaacatgttgtgctgtgcacgttccaccttcagtaatcagcggtattatggagttgaataaaacggaacaagttgtttcttgtttgacttattatgagctttatttg

SEQ ID NO: 68355 - DNA, 2007 bp, Oryza sativa
ttcctgcagccctctgggcgaattggtcagaatttcacagctcttccaagttgtaatcattttaaaatggtttttagtagcagtaatcccattaattggaagatttgaacagcgacttggcaactactggtagatttggtatatacacttgacgaaacccaaagtctaacacgcgcccctcctcttgcgttctcgcctcggtctccaactctgcaaccaccgccgtctcttctccagatctccaccgcgccatggacgccgcacccaccgcgccgccggcggcgtcggccgacgacgagatcgtgtacgagtcgatgccctgcatccgcatctacaagaaccgcgtggagcgctacttcggctccgagttcgtcgccgcgtccaccgacgccgccaccggcgtcgcctcccacgaccgcgtcatctcctccaacgtctccgcgcgcctctacctcccccgcctcgacgactccgccgccgccaaggccaagctccccgtgctcgtctactaccacggcggcgggttctgcctcggctcggccttcaaccccacgttccacgcctacttcaacaccttcgccgcgctcgccaacgccctcgtcgtctccgtcgagtaccgcctcgcgccggagcaccccgtcccggcggcctacgcggactcgtgggaggcgctcgcgtgggtcgccggacacgccgcgggggatggcgacgaggcgtggctcgtcgaccacgccgacttctcccgcctctacctcggcggcgagagcgccggctccaacatcgcgcaccacatagcgatgcgggtggccgaggaggggctcccccacggcgccaagatccggggcctcgtcatgatccacccctacttcctcggcactaacagggtggcctccgacgacctggaccccgccgtgcgcgagagcctcgggagcctgtggcgcgtcatgtgcccggccaccacgggcgaggacgacccgctcatcaacccgctcgtggacggcgcgccggcgctcgacgcgctggcgtgcgaccgcgtgctcgtgtgcatcggcgagggcgacgtgctccgcgaccgcggccgcgcctactacgaccggctcacgtcgagcgggtggcgcggcgaggcggagatatggcaggcgccggagaaggggcacacgttccacctcctcgagccgcactgcgacgcggccatcgcgcaggacaaggtcatcagtggcttcctcaaccgttgactcgccgtcgccggcgatgacaccgtcgtcgtcggaatcggagattaccaagattagcatcggttcatacccagaataactgcagctacgtcgccgacggatgccgctgccgcgccatacttactactccactactacattttacattttggattcaggattgtgttgcatcttttgcaattgggtgtatggatggaaggaaatcgccattgatttaggtgagggtattgtagtatcaggaagttgggggagataaatgataatactacagtcatagacttcatacagatgaaattattctgctttgtttgacacattgattcattttctttggaactccagtgaaagcattgttcttaactctttgcatcaaagaattacttgcttatactcttccaaaagaatgattgcgcgattctgtatttccgctgatcatatatttgtcaactgatgacctcacatggagtgatgccctccatcaaattctttccctaccttccatcaattccttttcctatcatcatcctttgatgatactaataggcagttctttgaaattaaaatacttgctggacgcatgaattctttgattttttttaatcattttggcagattattgccgttcatcaaagaattgattgttaactcttacataaaaaaggctctattcatgcatttgtcaaggacggtgcacacacattgattcattttctttggaactccaatcaagcattgttcttaactatttgcatcaaagaattacttgcttact

SEQ ID NO: 68356 - DNA, 25254 bp, Oryza sativa
cactcatggtcactgttcagttctgatgagttttttcaagacgaaattttcatttctttagatgttatttattgagtgaaacttttcttttctgcaactttaagggatatgtcccctgccaaaaaaaaaatgtattggtacagtctgaatctgcaatttttcattcaaagcaattgctctgttaacctctcattcgtcagacacactaagaattcttagttcaatgtagaaaaactaaagtttattgcgatgatttgtaaagccttccttagtgagcccaaccatgaagattgatcctacacttttccccgacaagaaacggacacatctaaatctgccaccaaacaaatttgcagcaaatgatcaccactgagtaggtgtacttgttggttttagaatacaattattctttctttcaacaaatacgtgtattttaaaattgaggagacaaaggcaattggccaaagaatcaaagtaccttttcttgatggtaggaaacttatgtatctatcaggcaggagcttacacaaggtactgccgttgatagccaatgatcgtttcaacagtgtcttttaaaaagatttttttggcagatttgtgcaatgattaaaagatgatatatactaaaccatgtaaggctaatttccttggccagtcaaaaaatgattattttgatggacggagcagaatggaagtaaaacttggataaaaattaaccatttttacgtgacatagagattaactcaaattaagggaccacctatggcacaaccaaggagatatattccttcattctaccgtactactctttctattttctgcgaagatgtgaatcatgttattctcgaatgcattgcaattttaacgagtattttctgtcaagttgcaaaacagaaaaagcactagctcagtaatctatagtatctacacaagaatcatcgttgccactgggtcacggaacatctgtaaattaaaaataacagtgtatctaccgtattattaaatcaagggaatcaccacgttcattaggattataaatttactaggttacttaagaaagagagaaagatcagccacattaatctgatgagtctaaattgtaagggtgttgattggccaaacattgttaaagtattgctatgattgtataaaaatgcaattgtattttcaaagacatatgattagtatataaaatataattgtaatcctgattaaactataaaccttgcataattagttgggtggaaaattcaactagtttcactgaaatatttgctcaaagtatacaattaggtggcctctagcgcatattagaattttgtggagcacaatgtgagcatggggaacactttcttattgaggcacccattgtgggcatacaatgatttaaaacttgttagagagtgctaatgtggtttctgattatttggaaatacatatatcttaaagaacctttttatggtacaagttacacacaattttatatgttttgttttcttctcttaggctccatgtgctatcacggtggattatgataatcccgtttggagcatttgcttttggatgtatcgatgcttggaaaaataattttatataagggataaattgttattacacgtccacgaactactagctaggtttgtcttaaaaaacaactattaccgatgaaattggacattttacacccacaactatcaaactagccaaaaatagcccccttaagtgcaatataacctggttttacagttttgacatccaaaatataaatttacttacatttagctattctttttacatctcttactttctataggtgtcatacaagtaagatgataaattatttagaatataaaatcattaaattaagaaacgcactacggtactctctactggtagtagaaaataatttgaaccgttgatctcatttgatcaaagggtttagatatatttatattactatcctagttagcaatagtagaaatgttgaggggcattattgtaaaaaaaaacaagtgtggaggggtataatcgtcatttaactgtgactaaacccttttttacttcttttttggcttttttgatggaatatgagcgataccagtgtaatagatgaccacataccgatctagccgggaaaaaacataaatgacaaagttaccctttatcattgtattattgtattagtaaatcactgatttacccttaatactaatggtagtactatactaccatactaccagtagagagtactgaagcatcactaattataataaatcatccttagaaccggtttgtactgccttgggcagtactttgccttgttctgatagttaagggctataaaatgttcggtttcgggtgttctgtagataaacctgatagttgtaatggtcagagggtgtaacaaatgtcaaacaattacgagtgatattatagtcatataaagccttttatctaactataattaaattaatagaacaagttacaatgattataaatgttcattttcatttacacacaaattaaaaaaaatcgacacgaggtagcacaagtgcacaacacaacaacccaaactaaaaggccgtctaacataaggtacaagtacaactgtttctcatatctttctatactccctccgtaccattaccaaaaaggatacaattgtagcatttaaaagataaattaatagggaattaaatgacctagatgtcctttattaaatgagggagtagcattgaggtaaaaaaaatccacgaattgatacatggagttacaatagcctcgctcaatcgggagatttgcaataatgacactacaaacattaacctttgctataatgacattggacccacatttcatagacacagatgggcccatttttcatccactcgtagtgccaaaacagcaaagccccaatgtttgcagccccaatattgcaattttctccgctcaatattgcttacaatattgcccatttgtcatccgctcaatattgcttacaagaaaaggccaaaaatgcatttgatatcaattactctgtccatcccaaaatacaacaaaccagcaccaggggcaaagccaggtgtggggtagcttgggcttgagccccatacctggcagaaaaaatatatacaaggaatatgctaattttcttattaaaatttattcaagaagttcgtaatctagtgattaagccctactcttggcataatcctggctccgcctctgcccagtactacattagacaccgcataataatacgaatctagatatgctgatttgtgatactcaacttcatggacgtgctgatgaacggagatagtttctgaccatgccactaccacatacccatagtggtagtaccccatgtgaaaaactggggctctgattggcacttcgtcgtacactgcggcatataaaccacagcacctctctcgatctccctctataaatagtggtgagcactgaggatgcacttcacagcaaaccccgggaaacttcagaaaaacaccaggagtagagccttcagtttcatagctagctagctagctagtgatccctttagctaagatagctagatactaagctctctcttcgtctcactctccattaacattctgacatggctggacacaaggtggtattctgcacttgcattctgatcttcatcgtcgtcgtcatctcaggccaggccgaagcccggaggctggcggcggtggccaacggcaatgaggatgccgtcgccgtggaaggtgacgggagcttcagagcagtgcaagaaactgcttcttctgcgtcgactgatcatgcagctgcaggtcgaggcggcggcggcgccgccaccgccgtacaaggaagcatgccaatgacgacgacggactcccgccctactgctcccgggaacagccccggcataggcaacaaggggaagatcaacaactagcagctctcgatcgtatgcgttcctgtttaattaaggcttttaattaagcatttaagctctatagctggtgatcgatcgattgtgtgttgccgatcagctagctccttaacatctacgtatacttgggttctacttctgaatttgcctctagtttttcgcgtcattttgatttgatttgctccaagcatcgaactaagctcgatgttgtgtgaacttctgtcgatcagtatgtgtactgtgttgactgtttgtactgttaagcacttaagcaatgttgattattcaataaagttgtgagcggttgcagcttctatgccactgcatatcggtatatatatctatatatctctacagttttaattcttggatgacatttgcttttaccactcaagcagataggagtaaaggatcgaaaatactatacttgcacaggaagagcagtctataacggttcaaattaaacgacaatttctctaacgatttgttagttataaactgatagagaataagggttaagctagtgattactgcggggaatcttactgatagacatggttaaaatttaagcagacaaattaattgtaaggatcaaaagttggggtcattcttggcttcttgcgacatatatatgtatgtaaaacatgttcatatatagtactatggtttatgtggagagttcttggcaaagtgggctttggagatgagagaaaatgggaggaccaaccaatgacgtcgcgtctagcactctgctttccagttctctttataaaactgcattgaataataaaacaatactgaatataacaagacgtacactgatatccctagagataacttatttgtatttccccattttgatcagttcaagcaaagaaaaaagttcaggaatctgtacacaacaaaagttaaggtttcctgtgggtcctcgacaaaaaaaataacaaaatcaaggacggtacatttcccttgaaaatttgagggaatataacggttggctacgtgcccactcaaaagatgtcacgttgcttaaattattctgcatgcatgcaatggtcgtctaaaattaaggctatgcttgagagttgagacaaacacgaaagaaaagtgtcattcgttttctgcacgcacattttttttgaatggttaaacaatgtacatttttgtgaaaaattctatagaatagttgctttaaaaatcatgcatattaatatattttcaggtttaaaataattaatacccaattcgttatgttttaatagttcatctcgatttgtatatctttttaagagtaattctacagttcttaaggaagtatcatgaggtactaaagatttagtgtaaaatttggtacctcttggtatctaggtactataaggtactaaatttacagtagaaaaagtggtacctcatagtacctcctcaagtactgtaaaattactctctttttaatcttctcattttcccttctctcaaaactgtttaaacaaagattcggctaaacctgagacacctatccacgaactgactccgttaaccgttgcgttggatttttttttttaacgattcggcacgtagatgtgcccatacattgaatatagcagggaaaaaaactttataaagctatagctttacagctttacacagaaaaaaaaaggaaagctaattaagggatatgatgtggtgttgatatagttttgtgctacggttgatagcgtcatgctcctattttgcgtcacctgcagatagtggaagtgatcagtgatgggcttacgttttggttcactcggctaggataaggatcggacctaattaaccaattgcaattttgacctacgttaagctacgcttagcttgcagagttgcagccttgcactgtccgggcgaagacccatatttgacatttgacagctcgttgacatctgcctacctctgcaattccctctcaatcactaaaaatttgtttctgaggcattagaaatctaccgctttcgctatcatgactacttcgacgatgcattgaagatgcagtgctctctgagctgagagattggaaagatggaaaggagtggccgctaatagtagattagatggaaagcaattctctgtttctcttggccggtttgtatcaaatgtaacttgaaatgcaaaattcaggtggggaagcacctctcctgcctcgatgacatattaaaaataactaatggattgatcatgcatgataaaattatatccaacctttttaagtttttgcctcaagcctcggctatggtttaggctgtcctggtcttgatccacagctggttgggaagtccatcgaaggtttggaatctatattacaaggatagaaaataaatgtggttacttaacaacagtattggccctaattgcttggcaaacaacataagttggttttaaccgatgatagcatgaatctagctatttatcttattatttgaatctacattgaacctatagccgattgatcaaaaccctattaacattagctggcctcgctacatcacatcagcctatggccgatcgactccttgatcttatacgatctgtctatctatcttgttagttgcaggatcaaactaactgacacgcccagaacctgattgatagaacctgcattggagctaagtagatctctcaggcctttgtgtgcgacggatttcacgtcaacatcgggtcaaggagctatctgctggagcttagccatcccacgtttggttccagttggacacttgttttcttgccaatttttctctcttaataatagatgttaagcgtgcgtttggttgacggtcaagattggatgggatatggcgaaccatattttgctggatatgacgatccatttttttatttggttgagtagatatggtgattcggttttttgtttggttatagggaggaatgtggatttggtgatctatttttttttgtttgattagagggggtaggatggatgaatggttgtaattacccctttattagaggtggcaagtactccttcaattcaccaaaaccacaaaattataaatctaatacaaacaaaaaaatctaaagagaaatgaaaaatcacaaagaaataaaaagaggaaaggggaaaaaatgagaaaaaggaaaagaaagaggtcatcctccctcttctcgtcggccgtcggcttgctcctcttgccagccgctggaccgtctcctcactcggccggcacgtctcctcgcttgccagccgctatcacgctcggcagccaccacctcgtcttctcgaggccttgttcgggcggcagaacccccagtgctgcctcaccggatctaccacctccagatcccgacgaggaggagcccgggaagcggcgttggtccagatccgccatgtcctcttcccgctgccgccgtcccctcttccccctcgctatcaccttcggcctccgggctcgccgccacactcgcatctagtgccgcctgccgagctcgtcgccatgttcgcatcccgtgcagccgtcatcgtcgtgctcgtcgttcgaactggccaccgcctcgctcacttgcgtggtgaggggtgacgtgacccacctcggtcgctcgcccaggcgctcgagcagctacgtctgggcaaaacggtcggattcctccatccaacatctaagggagaatattcccctcccgaccgccctatgccaccccgcccaccaaccaaacacccataaaaaaagaggccaccatgtcctatccaccccctcccccatccaaacacactctagtccctcgttataggggtgggtagaaaaagactgaaccaaaagaccgaaccgaaaagatagagaccgagaccgaaaagatagagaccgaggaactcggtcatcaatttagtcctaggtagtgaaagaccgaattttgttcggtcaattcggttagtcttatcggttaaccgaatataccgaaaagaccgaattaacaaaaaaatatctaaatgcaacctacaatccattaagttcaataggattaaactctaattttcacatccctacttcttctaggcatgaaactaataagtgtctttactcatacgtgcttacgaatttttttttgtgatttttgtgttgaaaattttccatgttatttctttgcatatatgaaaatgctgttgaatttcggtcaggaccgagaccgagaccgaatttttcggtcctgatatttttgcattgaaattcggtcttcacttttcaaagactgaaatgaccgaaagaccgaagaccgagaccgaaattttcggtcagaccgaatgcccacccctacctccttaatacctcacgttttatataaaagccagtggaaacatgggaaaattaatattatttggttcacattgtctcaaagttataaggtccaaagattgtttcacaaagattgaggttcaagaaaaaaatttacaacacgtcttattaaataaaatgtagttaggagtgggaggttgattttaggataggaataaatttgactgggaataaatttaaaagtataattgaattatatatacaacctgataaggttctatttccataaatacaattgcaatttgtatatataaaacagatttcaaaagaatataatttgtatacagcccatcaatttgtatatatactagcaaaaacccgtgcgttgcaacagattattcaaaatagccaaaaaaatattcttggttgaaacaaaattctttgtcttaaaagacaaaaagaaaaaaaatgctatagttggtctttagttcagattgatgagtccatctgtgttatcaaaatgcatttatcatataattgtaaaatatgaaatcatcaataaattgtgttgtccgtctcattttaaactacaataaaaacctaaaaagtttgtaagtttttgtaatcaagattgcaagaagcaaatcaatagaaaattaagaactgtcttgtagagaagagtaacttaaaaaactactcctacacaactactcgtaagtcataactatattaataatccacatgtcagcagcagtggtggtggtggtggttggcagctgccatcatcactgtcttttattagtagtatagaaacaacagatttttatccatttataccgttatatcctcaatatttcatgatgcaaatctttttgagtgctgatttataggtcgtagaatgaacgtgaaagttccttctcgatctcggttaacaatgtatacatacatagagtcatagatagaggcatgggatggtatacaggggcagagcgggagaacttaggcttgagccttagacttgctccaaaactccatataaatcttttagaaatcgtatagaaattttgaaaatatgtaatttttaactaaaattatcaaattcggttgtaggcttaacaatttttttggggctctgtcactgaaaatacatacatacatagactaattaacaatttttctggggctctgtcacgttgttgttttttcccctgaaaccaagagattcatgttaatcagggtaagacttgaaagagtgaaacctaggtacgacgtgccgatggccggatcatcagcacatggccgatcttacacactctgcaagcaggcacatgtacagaataatgcgtgtacgtccctctgacacgctcgatcgatcgatctaccgatgatcctgattcccgataagattcggtgcacttccgcatccagaaccgatccgtgtacgtgagatccccgatcccgagttccccaactgcgaacttggctagccgctagctctctgctccaccgctatctcccccccggcttgatcacctttttccccatgcgccaccattccactgaactacactgaagattcctgccaacttccgctgtataattcctcaggatattctctgttgcgccggggtcctggccgtcctcctctccatcggcgtacgtcctcgcgatccagcacacattcggtggtggccaccgtttcggcgtcgtgggcggcgccggccactgggttgtccttcctcggccatcgattgattgggcgtttgggcgtgcaagcgtgcatgccgccaccgccacctcccgtcggtcccgtatcttggagctgcgccgactgacgcgctatcacggttccaacacatgaaaaacgtatatttttctagagaactgctagaccacggtatcccgttaaaacgggatagattatgatgggttaataacgagtcattgcccccaccaactgcgtccatgtgtccccacgcgtctgcatcgttcaccaatacccctcacgtgtctgctactcccccacgtgtccatgcactggcgtcaggtccctgtctagtaccaatctggtaccaatatctgatacgataccaagtatcctgaggtaccagatctagtactatgatatcagacttgatatttggggtaccaaacctcaaacctggtacgcactgtcaggtaccaaatctggtatcagtgtttgatccgataattgatacctgaggtgggtaccaaacctggtacgcactgtcatgtaccaaatctggtaccagtgtttgatccgatacttgatacatgaggtatcagatctggttgatacgtgaggtatcagatctagtaccataggtatcagatcaaatgttggggtaccgtttgatccgatacttgatacatgaggtattatatctggttgatacttaaggtaccagatctagtaccatatgtatcagatcagatgcttggggtaccgtttgatccgatacttgatacctgaggtatcatatctggttgatacctaaggtaccagatctagtaccataggtatcagatcagatgcttggggtaccaaatctggtacccatggtactaaggttagtggtaactgggtctgatacccatgacgtatcaagaccagtagttatatattaggcctggtactaaaaaaagtatcaaaccatggtacctagcggtatcatctggtaccaaacaagtcatcttcttcttcctctccctaatacgttgtgtcccaattagccgttgatccctagccatgaaataaaagcaacaatcaaaaaagaaagattgtgaataggtgcaggcaacaaactagtagaaaatccatacactcatcttcctcctccttgtggacattagccccatgcagcctctgctgctgctgcactcctgtcggcttctcgaggacggtgctgatggccagctcaaatagggtgttacgatcgacgtggcaggcgaacagctccggatggctggtggctcgtgggtgcacagagggggacacggaggaatcagcgtgcgcgtaataggtggtggatgacgttgcgttgatctttagtctatcccattaggacggtattccgttttatagattttctgatttttctataaatattttcgaaaaacttctggccgggagcgatgggagaagagaggcataattgggcgcacaagtgtcaagtgactgagtgatcagccaggcggtagctgcatgatagaacgcacgcaggtagtggtacaaacacgaggtcactagctcacgaggggcatcgtggatgtactgggccgccttatccgacctgcaggagctgtgtgtctgctctggcttgttgggttctgagtgattggaggagccaagttgccaacgcggtcaaaacctgtagggtccaaaacgtcaaaaatcttttctttttctggaatttttatgacccgtatatcaactaaaataaatcttaccaaattttagcaggatttcttatgtatttaataaagtttgacaaaaaaaattaaatgtatatatattttgtcaactttataaaaaaatgatatgatttaaaatggcatcaatctgaaccgccctttaaagcaaaactattttgattatttgcaactgaatatatattttaaatccgtacaatagcattagaattctattgattaattatttaccgatgagcttgagcaaccatccatggttgacggaccaccattgggtcatatattcccacactccacaagttgtatgaaactctattatctatcctctccgtttcatgttacaagacgttttgactttggttaaagtcaaactacttcaagtttgactaagtttatagacaaatatagtaatattaataatacaaattagtttcattaaatcaataattgaatatattttcataaaaaattgtcctgggttgaaaatgttattattttcttcttcaaacttagtcaaattaagttaaacgtcttgtaacctgaaacagagggagtagattatcggctagattattactatatattatctactttattatagagataaattaattatttttagaaataaacatcacaatagcttagaacaaatgttctaggtaatacagaagaagaatgattttttttctagaaaacatatttctaagaacatgggggaagtaattccatttactctcgttttcaattcatttaatccaaatggcttatacctttgtttatttgtactcctacacaatttttataagacgattggtcatgttcaaaacttaatgacattaaacattaaaaaccgaatagagtatcatttgataaatatttaaagcaaaagaaagtaatacgtatggtcaaaaaaagtccataagtcaacatttcaacaatcattattcccttggctagctaaactattattgtttttgaaaggtgactagttagattataaactaaggtagcgtaaacgtaggcgccgccgtgcaaagtctgcccgaaatggcataaaattctaaagcatgctgtcggaagacttcttcttttccaaatctctctccagtattctagtactatatactggagtactccataatatacttcttatacatattagtcatcggcgttcttttgcaggaatcagcattctttcgtgtcaaaaggggagcaaaagttcttctcaatttgctgaacggaggaacgcaaacgtacgtaggccaagaaatgagaaaaaccaaagtgaaaaagctcctagactttaggagccgaccagcaaatatgaaaaatgttttgttctgttgatatatagccattgcgacaaagcagatgccagatgatgcacttgcttgtttacctgggcttgtagtacaagccagctgagaattagcccagttatgcccaagttgtgtccttctttacccctgagaattagcccagttatgcacgcagcagcttgaaaattccaaacggggtagtatataggccggagatcatggaatgtgttgggccgacaatgacacgaggccctttatatgtgcctattaacatgaaagtgcaatgagtttggcctgtgtttgaaatgcagaaaaatgaaacatatgaaagcaagcataaaacagaggatataaaaatagaggaaacatatatttgtataagtgtttggaaaaaaaaattgcctgctttagtacattggaaaagaaaacaaatgaatgtttgttttccggtgttttaactaaggccttgtttagttcgcgaaaagaaaatttctgggtgtcacatcagacgtttgaccggatgtcggaaggggttttcggacacgaatgaaaaactaatttcataactctcctagaaaccgcgagacgaaattattaagcctaattaatccgtcattagcacatgtgggttactgtagcatttatgactaatcatggactaattaggctcaaaagattcgtctcgtgatttccatgcaaactgtgtaattagtttttcattttatctatatttaatgctccatgcatgtgtccaaagattcgatatgatgtttttgggaagaaaattttgggaactaaacaaggcctaagaatggaggacatgtaaatttccctttgttttccttcaatccaaatggctatagtttatgaattttgagtgaattttataaaactataaatacttcaaccaaactatcgtaaaactatatatttaaaccgttgtatcataatatatttaacaataaatttatcacaaaaaatatatattttcgttttttttacagaaatggaactataaatttaagataaaatatcacacaactatttatttagtaacaaaattatataaaaaaacaagtttagaaaatctaatcataatactataacatttatagctcgaagataacattagtgctagtgctaatgatgtaaactctaaaatatgtatttttttataacattaatactaaatctatggttttattgtacttgtattagatttatagttctctaataaatttggtgctaaatttatacttttaagataacttgatcaaagtacatgtagttccgtaaaatttactcgtaatcattttttctttaggacttaaaaacctgtgcaagtcctttgaaaacccttcagccaaacattgtgtgcagcttacatgatggtactgtagcacattgatcaaaattactagcaaatatgcgaccaatcgagcctacaatctgtaccatgtggtgacacggacaccatgcatgaaatgcataatagtgatctcttgagcaagaagtactattgtcccatctaagcttaaaagtcaataacaaaataggcatgtttagttcgcgaaatttttttttgtcatatcggatgtttgaccggatgtcggaagggttttcggacacgaataaaaaaaataattttataactcgcatggaaaccacgagacgaatctgttgagcctaattaatctgtcattagcacatgtgagttactgtagcacttatggctaatcatggactaattaggcttaaaaattcgtctcgtgattttccctcttactgtgcaattagtttttgggacaatctatatttaatgcttcatgtatatacccaaatatgatgtgatgttttgggaaaaaaatttgggaactaaacggcacctaaaccacgacaaatgaatgaatccagagcaagccaactttggattctgatatcattgtcccggattccgaatatctgatgatgatctctctctccatgctaaactgccaagtgccgaccaagccggagcagtcacagtgaggatcagttcgagcaacaaagaatcggaattggagagagacagtgtaagctttactccctccgtctataaaaaagataaacctggtttcgtgtccaacgtttaaccgtccgttttatttgaaaaaattatgaaaaaaattaaaaaaaacaattcacacataaaatattaatcatgttttatcatctaacaacaatgaaaatacgaattataaaaaaaaattcatataagacggacagttaaagttggacacggaaacctaggatttgtcttttttttttttttgtgacggagggaatacggtacaatttttcaccagtcactccaggatgtcaggcaggcagaggcaaaagcagcaagctgcactgccttttggcacatgactgactcttgaatccatttgctgctaggcaattgcccggctgcagtggccactgcccactggccataccttccgtgggctgcctgcagtgacaaacagtaactttgtggctttctgcgatggaagcaggcaggcaagcatgcacaaggtaaaaaggtatctagtggaccatggccaaagaacaatctaccatgtggttgacattttagcgtgtgttcagcaagctagtgaacctaaggtagggatgacaattttggccatgggttcggatatcagcggatacccggcccgaatgtctgatgagcactagtgtgggtgtgattttgtacccgtgggcacgtccgcccaagacccaagacgttatgggcaacagccgggtttcttttttacccgtggataacctatacccgacctgatacgtttgtattagctaatttcgactcatctcttgattcttatacccctttctcttggatcatttgttatgctaactgataagaagttgtgatgtaattcaaattatcattgataactgataattttgtaaaatattgattttatttctctttgttaaattacttatctttcgagttattattcatgtgagattcattgggtacctgccgggtatgcccgtgcccgtcgggtatgggtacgggcacggagttttgctcgctaaccctagtgggtagggtttgagccggcgacattgggcatcgggtagggcatggttttgctttacctgtgcccgacccgacccattgccatccctaagctaaggccatgtataaagcagtgtctcagacctgtcgtctcaagttctagctaggtttggatgccacgctgaaggtttagggtggtctcgcagggtggcagtggagcctgcaaaggtaaatgtggtctacggtggctctaggaaagagaataggggtttgtgtggtccaggcaagaagcaagacgtgctcacgctgaggtcactgccacactccgtcgtggccactgcacctcgctgccgccgccgatgtcgttgttgcactccgccacggccactgcaccctatcgctaccgttgatatcgttgtttgctccccacccttgtcttcccgcatggatccagcgagaacgaggccgaatccaccgccttggatctcatcgcgatggccagggagtgaccaaaacataccattttgacatagatgtgttctttcaaacataacttgactataattaatattgccaaatattttaaaaacttgataagtacttcctccgtcccataaagaatttatcttttccatctattttgtcctagaaagactttattttcaaaacaataattacattggagttttagaaagtgtctgttatagatgggggttgtatcggttcgctactgggggtccaatacttacttgttatctaattatcaagtgatatattaataggcatgtcataaattaagctaggattaattcatctatccgtggttctgtgaccccgaataggaatcgccactgttggtatatgtcagataaacttctttttagaactaaggtagtatataacattataaaagtatctttcgagacaaattaatcccattatatacaagcatccaatctaaatatctagagctagatttgaggctcaaacttttttaaatcttgccttgaaatatgtccaaaacaaaatgttagacctcgtttagatcccatcccaaaattttacaccctgtcacatcaaacgtttgaacacatatattaagtattaaatatagtctaaacaaataactaattacacaaattgcgactaatttacgagacgaatattttaagcctaattactccataatttgacaatgtggtgcttcagcaaacatgctaataacggattaattaggcttaataaattcgtctcgcggtttactgacggattctgtaattagtttttttattagtgtccgaagacccccatatgcgacaccttatataatatccgatgtgacacgccaaaactttacacccctggatctaaacacccccttagctaactaatagggagtaataagtcaaagttacttgttgaaaactgtgctacaaacctgaatagggggttctgttatggacttggggggtgatgtacaatcatctctgttgaactgatgccataaatctatactaacccttttcctctgtttgatgtttaactctatgtaaaagacacatctgcttccagtttactgacgatttttaatataatacttagtagtatatgctactatagcaattgggcagcaaagcaaaagcgaggtcacatgagtacaaccaacccgtttgaaaaacgagcgccaaccacacgtttagaaatgtcattaggcacgacaggaagcagtcttaagcagctttagttacttataagattaaccaaagaaaggttttgttggggagtagtactaaaatattgtgatgcatcttcccattatgatttgcaaacaagagtaacaacaagccaggttggttactccacaacactaagttaatgaattcatatgggtgttttgctcaaaactgctggtccagtgtcactgttagttgaaagatgatttgaacttgctgatgcttttgagctttggattccaggggttaggagagggagtttgtcttcttcttggcctctgaatctctgatgcatattcacaccggcataacaaagcccccattgctgctctgtcgtgtcttggacggtcccaagtttgaatgaatctgcttaaactaatggccagcagtgaccctctatttaatcactgtttaaactaatcgacagcacttaaagcaggaccgatgaacgtcgcagtaggatatgggcactctgtttcttcttgaaaataaacctgaccgctcatgtagtcatgtgtgcaagtgtgcaacactgtcgtttcagtaatgcacttgagatcgcattgcatgcgaatttgaatttgaattcgaattcgaatgcgactgctcataatacatttcaatgctaacagttacgagaggcatacatatacatacgtgccaccgatggctcttggattgccgtttcttgcccccgcgtcgcttccagggcaggggcgacacgggaggcaacccagctgccgccgccgtgccacccccaccgccctccttctacctcgccgccgcccgagcgggccgccagaaaccgcgcggccgcaaggacggcggcggtggggcttcctccccccgaggtcgcggcgttcggagcccacgaccccgacctagcttcggggcggcgacttcggcggctgcgacgtcgagctcgacggtggcacatggcttcggcgaggtggcggtgccgacgacggttgaagagatgggcgaccgggccgacgacgagaaggcggtgctggctcctacgctctcctgcgcggatctggtgcggggggatggatcccgagccgctggcggtggtgatgcgcgtggaggcggcgggatggccggatccggaaccctcctgtccgggtccggcgcgggaggccgagctccgaccccaggcagcgaggcggcgggggcgcgcggtgctgggcggcggtggctgaaggcggcggggatggcgatggcggcggggacggagctggccgagggcgcggaggcggcggcggcggtcccgtggctgcgacggcgcggtgcctggcggctgcggcggtggtgccccccagatccgcgcctctcggccgggtctggagggtggcggcagttggcgacggcggcggtggtgtggcgatggtggtggcggcagttggccagcggcaagtggcgatggcggtctcagccggatctggacgcgggcagcagttggcgacgacagccgcggtgtggtgacggcggcggcggcggcagttggcgatggcggcggcggtcgtggatgtggtggctgctgtgtcaactggcggcggcggcgacggaagacatggagtcgggcagctagctgctcggtgttggaggacgacggcgcagcagcagtttgcggaggcggtggttggcgtcggtggcagcgacgacggcggctgcgactctggaggcggtggcgacgtcggcggcagggaaggagtcgggtgcgaggtggctgggtgttcggcagcagcggctgcggtggtggtgaccgtgtttgcggtcaccggagtcatggcggcctcggttgactagccgagggcgtgggagacggctgcatctggtcggcgcggcatcgttcggtggaggggttggagaccggcttggcgcagagaagcgcagctgatggcagcggaggccggctcggcgcgagaggcgcgggcggcagagatggaggccggcttggcgcgagaggcgcagccgatggagggaggccggattggcgcgagaggcgcgtccagtggaggaggccggcttggcgcagagaggcgcggccggtggtggaggaggcgacctaggtgagaggaggagttgtcggtgggtgtggcgcggtctttggcgcacgaaagctggccggcgggggacgctggtgcaggggtcccacatgtcggcaaagcttgtgtggtggtggagcaatcggtgcgtcagccgtggtttcgatctcgtctgtgcccctttgttggcctagtgacggtcggtcatgcttagcggtggccgatccggtgctagccttctcctaggcgtgtgtgttggcgatgtcggcgtgtgggtggtggtatatttttttcttttttctggttacgactctccagagttataatcttgtaattttttcctactctatcaataaaacttcgcaccgtctcgtacgagtcgttaaaaaaaaaagtgccaccgatggatcatggatcgtatataggaaatctgcttcattccacaccgaagattggtagggttacgcgccactgactacgtggaccacgtcacatggacagtgtcagttcgggaagaaattttgtcgagacaaactggccaatttggctatcaaaacgagaagaaacgttgttacttgccagctccgcgactctcatctcatgtgcccgggcacaaaagctttgtatacatcatcatcaccatcgccatctctccaatgtaagaatggcgagcgtgtcgaatcgaggcacattttatgtgtgaagccggtttctagtgcattgctgatagccaacccgacgtatacatgctttgatttggatttggacgacgtaaagttctattcgttcgcaggacacgttgtaatattaacaactatgtttattgagaatattttaccttccctcaatcttatgggtgtgtttagttcctaaaaaaaattggaagtttagggaaagttgaaagtttgaaaaaaaagttaaaagtttatgtgtgtagaaaaattttggatgtgatgtgatgtgatggaaagttgtaagtttagggtagttgggggtgaaccaaacacggcctataaaattagtccagacatttcttcaccaccgtcccagccagtggaggagccagaatatgctcatagtagggctgaactagtataatctaaataaatttatcttttgtcttctattttttaaattttaaagtatgatttctatggatatttgggctttttaaattttaaagtatgattctatggatatttgggcaataggagtagagctatagctctagctgtcctgcaactatatccacccctggtcgcgccgaaaaatcaccatctcttcactcccagcttcctttaatcttcttcagacactaaccaaaaaaaaataatgttattaactagttttttttaacgactcacatgagacggtgcgattattgatagagcagaaaacaattataaaattataaccctgcaagatcgtaaccagaaaaaaataaaaaatataccaccacccacacaccaacagcaccaacacacaggtccgggagaaggctagcaccggaccgatcgccgctaagcgtgaccgaccgccgctaggctaaaaacggaacacaaacgagatcgcccaaaaaacgctcttacaaccaccacaaagcccaactctatccacgtcttcaggatttagggagagagggtgagagagaagatggagcacctctccccctaggccctccgacgtagtcaacttgtagaaactaggacgccaccacaagaggatgaaaaatctagagtgtgcttgcaccaattgctcgagtggtttcagcaaggggatgcctaaatgacaactccaaggagagaagtgacgaaaaccaccgccaccgtccaccaaggtttcaaaagagagaagactaggctttcgcccggcaaccacccttgaggggtgagacggcacgacaacgcccttaggagggggaatgacactcgagctctatcgttgtcggtccggccaaggccgggttgggttttcacctgccgctcaccacttgcgagtccacggctaacgcaccgatgctccaccactgcccaacctccgccgacatgtgggacccctgcaccggcgccccccgccggctagccgtcgtgcgtcgtagaccgcgccacacccaccagcagctcctcctcgcaccgtggtcgcctcctccaccaccggccacgcctcatcacgccacgtcggccttcttcaccaccggacgtgcctcatcgagccaatccggcctcccgccaccggccgcgccaagccggcctccaccgctgccggccgcgcctccttgcgtcatgccgacctccgctgccatcggttgcgccgagccgacctccgacccctcctccaattgctgttgcgctggtcagatgtagccgtctaccacgcccctggctagctgtccgagaccgtcgtgcctcctctcgccgtaggcacggccacggtcgccacaacaaccacagccacagccgccacagccctagttctccgccccctggcctccaccaccgccgctgtcgctccaccaccaaccccgccaccatcgccaccccgccatcgtgaagaaggccgctgcgagcgcgccatcctccacctttgcagcttccttcggatccgcagcctccgacgcctgccaccgacgtccactcgctggcccgctcgcaccggcgacccgcctcgagccgccggcctgccacagcccgccggcggccacaacagtcgcgcctccatgcctgccgcggccacccatgcctccgacgctatcgtgcttgccgccgcccccgccgccacctccacaccgccgaggccgccaactctatctgccaatgccgccaactccacgccaccgacgccgccaactcgctgacctggctctccgccgcctggagcaacagatctggccatggggggaccagatccgtgcatcccggtgccaaatctggatgctgccatcggctcttcctcggcttcggcgccttgccctgagctccatcttgccggcgccccgaccgccttaaccgtgagcgagggagagagagctccaccacctccgtccttgcagccgcttggctttgccggcggtggctcgggcagcggcgaggcggggtgggggggggtttggtggggatcgccacccgcgtcgcccccggggcagaacgaccgggcgttctgaaactatttttgttattaactagttaacattgttttccaaaacaacggggtgattagcttagtgacagtccacaaatgcagaagctttttgtaaggtcgacaagaactacagctagtacagtactatactgccatttctgcgtaggaaacgaccgataaatacggatcattttgcagcaaaaaattaaaaaccccccacacgcttttcacctacctccgtgttcctgctcgcttgtaattttgcagggcgacgtgatgcccagcttctctgcatacacacacacacacacaacacttcgtcacgaccctgtctttttcgcaaagtctctgacgatgtgctgtgcgttgaatgaacaggatagcactgcaaaagatgaactcctcacatggcagagccggcctttgcgtatgcgatgcatcatggaagcagcagcacactcgtctaaaccgaccatttggatagcattacactcgtaaacttataaaccaagctgatcctttttaaaagatcagagcttttttatatacctgacgagcctgagactcctcggcttttgctctgatctagtgttaacttgttaacagctgcagcgaccaaatttgcaggggagcaaaatgagtgctgcgttttttgtgtaagcctcgcatccactaattattttacaccgtgtcaacttggaaaagttttgtagtagtagctgcattgcttcgtaagcatatgcagctaagctttttccaaacagagcagtgatcagagtcagatcagacagctacagctaacggcaagtgaagaaaagaaggggaaggaacaaaaatactggactactacttccagggagtgccaagtggggaaagtatatggtggaaagtgaaatccacattctagacgaaaacttaaaaacttttttacaggagttctcaagtaaatctaaaaaatatcacaccatgaaaaaactcaacttcgttaatgagatataaattaacaaatcataaaggaagaacgctattccttttattattttttctttttctctcatgtttcccaaaattatatctcaaacaatgatataaaagtctttatatattaaaaagccttacaaatagctaagatagtattatacaattatgcaaagttacatggataaactcaatttcatttgtgagatataaaaattagaaacactgaaaaagaaaaaaaacaggagtgttttcctctatagtttgttaatttcatacctcagcaacgaaattgagtttgctcatgcaactttataggttgttattacctactcactctatcccaaaataatccaattgtagaaataaatttgaacatatattatatatccatattcatctctaagattcggtattttgggacaaagaatacatatttgttttttcaaagatttttttaacgttttaattaaatacttcctaagtttccatttaaggttgagttcttttgaccactatcctaacttctatccctcatttttgacgcgtaaacttgtaaaaaatgttttttttaaaaaatatagaagagccattatagaaaatcgtattacaatctattttaatttttctaatcaatttttaattaattatgtgctaatccgtaatttcgttttgcgcattaggaggaaggaatccgaactaaacacatccagatatattcccaagttatactactatttcccatgcgaaggggaaaatatgtgcgatattggaaaggtggaaagcgaggccaccacgagctcatgattgaccgcgtggccccccgtcccgtcccggccaccgctgacctgaccgacccagcccgctcttcccatcacaatattccttagccgagcccggcagaaaccatcaaaccgacccggtggatcgctcgatcgcctcggccatcccaccgcccaccacctcgtcgcgtcgcaagtcggcagcacggcgagaaacaaagaaaaatgaaaataaaggagacctcacctggcgtgaccgatcgatatcaagccgcgaataaaacggaggaagccgtagtgaagcgaacaccaccaccacccacgcggaggaggagaagaaacatcacgcgagagtacgagacgaatcgaacccgcgatcaccacttcaccgccgggttctgcctcgcattctgggctcctcctcgtctcgcggcggcggcggcgtcggttggctcctccgatcctacgtcgccgatcggacgttcgtgccagtggccacccaaccttacc

SEQ ID NO: 68357 - DNA, 28334 bp, Oryza sativa
  unsure (1)..(28334): unsure at all n locations
cccatgggagatgggcgcatgaattctttgcgtttcgaggccttttgggggtgtcttcgggagacgagttctgcgctcctttttttctttttttgtgttcttggagggagcggttgattgctacggcttcaaagctcagcagagctttctgtgttcaacaagttttgtacacctcactcctgttgctttcgcgtgccaattcggatggttttcgctctgagtttttgaaatgggctccgggggatccattccagtcgagagcagttcaaattcggtatcttgattgctccccgctcctgcagccccgcgttgtatttaattcactgtcgcttgttgcatctaaacgagtccattttgttttcttctccgccctgatcaaggtgatggagaggcccaactcgaagattccggcgatgaaggcgtcgtcctccaatgctgcggcgccccagatgatcatgaacaggagccaatccaggagagacaggaagattgcactgcagcaagacgtacattatcttttctccttgcctagaaattcagtttttgatcgaattgatcagctaaaacacaatcagttagtagcatgttcgaacgctttgccttcttgttgggttgcaggtggacaagctgaggaagaagctgcggcacgaggagaacgtccaccgagctctggagcgcgccttcacgaggccactcggcgctctccctcgccttccaccttacctgccttctcaggtaacatccagctccggccgccgccgccgccatcgccatggctgcagcttagctccagcttgtgagacggatcggatttcatctccctgatcattttgtttttttgccgaattgtgcaaatcaagacgctggagctcctcgccgaggtcgcggtcttggaggaggaggtcgtccggctcgaggagcaggtcgtcagcttccggcaagggctctacgaggaggctgtcaccatctccatggcgaagagcgcgtacttctccgacaccgaccggtgcacgccggcgcgccatggccaagttcccgaccaagctgctagtgctagctggtcgtctctgaagcgagtcaccaatgtcaagcagacgccaagaaggactattccttccatgaaccatggaggtgatcgtcctgggaaggagaaccaatcgtgtaccaccaactctttcagagatcacagccggttccctctgaaaaccgtgccaaaatgcagtaatccagaagaggagaaatgtgccgattttcaggtacaagacttagcccaatgttttgtttttgtgtgcttaaatttattttgctcgctaatgttgtttcgtttcagacagttagtgcagtgaaagatcagaaaggtactgaggacaccactgtcattgattcagaaaacatctcgacagaagcaaacaaagtgtctgaggagctattgacgtgcctactgaatatcttctcacagatgaggtcctccagtgaccaagatgaggaccgatcatcgtctccgtcggtttcaggctcctgcgagagctccgacggcgccgcctgcgccggcgacccctacggcgtcctggaattgggtagcagggacattggtccatacaagcaattcagagcagttgatgccacttcattcgatcagaatgtttttgacaacagcaactcccttcttgacaggagattgaagtgagtttccactgatctggggtaactactactactactgtactaatctgtcattacaaactagattctgctgtgtgatgagttggtttctgtttgacctatcatgttcatggaatgatcttgtctagtgtctacctggcaaaaatcagggccttgctccagaagctctcttcagttgacctagtgggcctttcccatcagcagaagttagcattctggatcaacacctacaattcctgcatgatgaatgtaagctgtccctcataattgaggcctcctttgcttttcccctcagcatgattgattgacaactttgattagctcccttttacactgatgtgaaatctccaacggttgtaagcttgtttaggtttgcttaaatacacctagatagttctggccatgtgtaattttgtgcgcatacacggcatgtctgtggactgcatgttgtcatgttattaaacgtttaaacctcagtatcaaaatgcttcctgcttccttgatcatctgcagagccataaacaactgacgaccttggctccattatcctttgacccacagctcgtcttcgctagcaaagcctgacagaattcattaatctgatcaaagtgacatgtctcctgatctaacactaatgcaggcttgtttattctgcaactccaggcatttcttgagcatggagcacctaccaccccacaaacgctggtggcaatgatgcccaaggttccatccatccatccatccacatttacttctttctctagattcattacgtgcagcatatgcatctgcaactcgagagcaaaagataaaagggtgatatggagaaaatctctgacaagagtgagttggctgtttttctttgctgccgcaggcgacaatcaacgtgggtgggcgcgtgctgagcgccatgacgatcgagcacttcatcctaaggctgccctacaatgcaaagcatgtaagagtaagatgctagcatcattgccgtgtgcctgaaaacttatctgatcgatttcatggtacaaaagattgacgccccgtcgttcgggcgtatttgcaaaagaaaaataatttgtgaataaaaaaaatcatatacatgttcttagcgatttaaaattaaaagctgaaaaataaacttcgatgaaaaaaacctcaaaatcaactctaaatttaaggttgaaaatttaaattttagctgataagcgtaaacataagcgaagagattttttttagataatggattttcattaatccggcctctatatccacaagggatatacacagccaaaaggatacaagagtactagactcacacctcaacgaagaggagaacacaaaaccaaaaagcaagaaaacctacaacctcggtaaatccctgcatcctgacatcctcaactgaaacgtcgccaccgcccctagtgcgttgtcgctgcgaatctccatagatgtcattttcatgccacggcagccgggaagcccaccctcatccatcgtcctccggtcagaactagccgaccagacactagttgaaagcaactgtatttgcttcgtcggattcttaagcctccgccgcccatagggccgccattgacttcagactcctactccgttctcggactcccagcccgctgccacctttgcgccgctgtcgccgaccaagtctgccgctgacgaaggaggggatagaggactagctccatctccatccagaacagctactcaccaagtccgcgacgccgtcggtgacaaaggaaggaacggtgggctagcccctgtcaccaccgcccattgagaccaccggtgatggagaacttgccgccatacagcaaccatgcccatcaccggagcgccccactaaccggcaacctccaccactgccaccacccccggccaaccggcgccataggcgcctgccttgccgactgccactgggcgtggccgctcccgccgtcgacatcacctccactgcgtcgctcgccggagccaggcgagacccaccgtgccgccctctctctaggaaggggactgaggaggaagccttgccgccaacccagcggacctgcactctccggtgacctgctcgaacggtggcaagttgaaaagcgacgacggcggtgaggatttacaggaccgggcaactagccagcagccgccgagcgctgagcagaaaaggtggaaaagggagaaatgggaaagggaaaaaggtgaaagggggaggtgaaaagggaggaggtgggtgggggcgccgccggcggctgcggcaccggcgccggcgccggcgaggtgggcgacgaggggaaaagcgctgggagtcctgttctcctcccgggtcgcctcagagagcgacacgggagtcaaagcgtccccacaatttccgtataatatgacgggataacaggaatcttgataagcgaagagatgaggaggatataagatgatgtttatgcctttgtggacaggtgaacccgaagggggtgaaatccggcaatggcgcggcggcggcggcgagaggggtttttggactggactggcctgagccgtcggtgacattcgcgctgtcctgcggaagctggtcttcgccggcggtaagtttctccggcgtgccggtgaattttctctctgctctcggtgtgcattctgcatgtgctagctaacttcagattgaaaaaaggaacaaaagttaacgtgtatggtactatggtgtgtatcttttcaactgctacatcatgaatttgccgggaagctctgtgtggcagctagccagctagcactctagcagcctgcgattataacaagctgcaaaggcaaaagttgaacaagctgcactttactaattgtactgaaaagtacagtaggaatatttgttagggcacaaatataagtcgtttggtgtaatcaagttggttgcagacttgcagtctagggaagagtactgaatactactaatgtgtgagaattcagcataatataaagctatcactattaggcagtaaaaatgcagaccactacaatgtgagcagggtttactatttcagactgcataaacatttaggtggtttcggaaatttaaacagattttgttaaattgatttccttttttctttttttgcaaaattcagtaaaacttgttttgttttcggaaatttcaaaatgttagtactgaaattgtgagactgaatatgatactgaactcctcactgcactggaaatgttgattttattaagagaagcgtattccagtattgattttattagagaatggtattttttacacggccaccactaggctacatttcatttggtattggaaatgctgatgacataggagtatttttctctctacgcaggtgagggtgtacacggcttgccacgtcgaggaagagctggaggcagccaagagggactacctgcaggccgccgtcggcgtctcgacggcgaccagcatctcgatccccaagctcctgcactggtaccttcttgacttcaccaaggacgtgagctccctcatggactgggtgtgcctgcagctgcccggcgagcggcggcggcacgccgtcgaggccgtcgaggccagccgccggagcccgtcgccgccgcctatccaggttgtgccgtacgagttcaggttcaggtatcttctggccacgtagacctgccacggtgtatggattggacactgtagaagggcagaatggcttgtttttttgtgtagcacaagtttgcagctaattgctggaattttttttttttgcatttgtaaagggaaatacacatgaagagttgagagtgatatatatcatgttgctttccactgaagaattggtgttccgtgttcctcctacctacagtgaccgtcagagccgacaaactaaaacttgacagagaagtattgttgctattttgatttatttaaaaaggtgacatttgaaactaacacttgaaatttcatcagttagaatcccatcgctgcctgctggtggatatgctcgaggcatcttcccccttttagatgatcagttgaacaacagcttctctctcactgagctcaatcaacagaaatccgccacaatatttttctatccatggtgtcgtagttgtaatttgtttggggatgtttaggcttcattgaggctcctccatttttcttgtggattaatgtgtatcaggttggtatccatacgtatcaggccttgtacttctgtggtattaggtctaacattcatatacgagacctgatacatataagtattagacattctgggaaatccggaaagaaaaaaatcaacggttttcgagcaaaaggaggctgtggctccttgccttatggcaaaaattgttggccaaaataaaggaagaaacacgaacttgggttcttgccggagcttaaaaaacttagcgagtttatccctccacacgtatagttatgtatagctttttttctttcttctcttaggggttgtacttttctcccgctatatttaatgaaatagcacaatctcgtgctgattccattaaaaaaaaagccttatggcaaaaataaaggaggcaaacttaggctatggcaggagcaagtggcttggagaatttctctcaaatcaaccataggcgttgtgtagccatgtacagtatttttccttacacctagaggttgtattttttatctttacattcaatgaaatagcacaatatcgtattgatttctttcaaaaaaaaattattagacctggtacctcattgctatcatatgcagggatccttagaaacctcctatcttaaaagcacactacatgtactagctattattattggagtatatttagtccaaactccaaacttaaattctgcggctatttcatgtttggcagttttgaactctaccatccaccagctagcaagcaactgcattgctagcaaactaatcgaacagcgacagaaaaaatgagttttgttttatacattgtacatatccctcttctggtccttactgaccattattagcttacagccataccagattcggtatcttctagatttcggctactattacaacccaaaattgggaattggttctgtctagtgggcctgcacagcggcacctcactggcccactaaacactagtggccgtcctgttaatgggccttactgaatcttaacactgacactgatcactcactaattccgaatttttctagaagaacttttagtcaaaaggatactcctatttttaaaaagggtatcttttgtgccatgctctatcattttgttcttttccttttctttcttctactctgaagagaaattctggagcatgcatgtatctgatacatacagatatgctcccctattaactgtcacacgtactaaagtccccctagacagaaaagaaaaggttatgtaaatggacaagcacttgaatttgaatgttgacatggcgcatcagtccagccaggacagccagaattggaatggcagcaatggagatggctcccaccagcttggcaacgccaggtgggcaagtagacaactgcagttggtatcggtggtgctacgtgtgccaatacgtgacagtcatgcgtctgactaaagctcctacgtttgtatgcttgtggactttagccaggattaagacagtcccaacattcacctaagttagtttcgtagtgttaaatatatttgacgcgtaagaaaaaactgaaatagtaaaagagttgataataagaaaaagggggaaaagggggaaaatgaaaaaaactatttcttaagtgaatgaaaaaagatggttgattggctgaaaatttattttgaagaaatcattcgttgagtgtataatttctatacataacttctatataatatgacaagtataaaaactactccctctgtttcatattataagactttttagcattgttaatatttatacatatgttaatgaatccagacatatattaacatatatagaaatatggataatactagaaagtctttatagcataaaacggacgtgcgctgctatcgtgcagggttgccgttgtgattgtaccgatccatggaataagacaacaaggagtggccatgccaggtcctctaggtactagtagttttttttttaagaccaagtcaccggagaggagagattcccctcctgaatttcattcaaagagaatagttttgagacacaaaggttacatcaaatttagagttctcagggaggaagaaaacaactgtttccaaaccgggattatatccctatctttgctatttagtctttcaacccagaagttagtatctccgtaagtattttgtcagggccgatcctagcgaagaccacattatggcgatgcagccaaagtatccggaaacaatctgcggaagtaggtggaacatcttgttgggtattcttccagacgattggtgtagataaaggaaattcgtttcttcaatgtgtaattttactatccttatgaaagcacatagagatactatattttctaatgtaaaatttggtatctttatatacttaagtatctctaggtattaaaaaatttagtttaaaatttaggtacctcaaattactttcttaagaagtgtaaaattcatcttcttcaatatttggttgaaagccgatagcccgccaaaaactctttgcgaaggggcaagcaaaacagagatggctcgccgtttcagtatctgtctgagtgtctgacagagtgcgcatagggcattgtccacaatcttctttttgagtaaattctggatgctagtagtattaacttttaacactggagatcaagcaacggctgagttggagaatttaccgtagatgtattgcgagaccactcctgcattatgtgcgtgtggaccttctgctctcgttgccgacgattaattgcaccacttcagcttgggggttccacatcatccctgtcagcatggaagcccgtcctactccaaagcactaccttacctggggtgtcaagttcggctcagttgattatttccttcacgttttctcaaaatgaattttaaaaatatatacatatattgaaaaaaaaactttcttttaccatattgcttacatcacttgtttttaagttaccatctatctattatattattaaaacagctttgaaaggaggcactacgttcgctgtggaggctagaaattcccacattaatcggagaaaaaaaaagttcaagtcgaaatacaatttaaaaagagcagaaattcagaattaaaaataagcaatattgaatgaagagtccatataagaactcaatacgagattaatcaaaattcggaataaaaacaaaataaaatccgaaattagaaaagaaaatgagagtccaagtaggaatacaatttaaaaataactgaaattcgaaattaaaaataaggaatattgaaagaagagttcatataagaaatcaataccagattaattaatatccgaaataaaaataaaattaaaatccaaaattagcaaaaatgaaaagaagagaacagttcaagtcggaatacaatttaaaattaactgaaattcagaattaaaaataagcaatattgaaaattaaaagagagttcaaataggaatacaattttgaagcaactagaattgaaaataaaaaataaaaatattaaaagaacacaatacgatattaattaaaaatcaaaattcggaataaaaataaaataaaatccgaaattagaaaagaaaaggagagtccaagtaggaatacaatttaaaaataattgaaattcgaaattaaaaataagggatattgaaagaaaagaccatctaaaactcgtgatgagataaaattaagtaacatgcctataaaggagtagagtggtggcggttcatacgacatattaaaactgttaataaaacaccaattataatcctaataacgattagaaggagggacgacaggcaggccgtgaagcaaacgggcaagacagttgccgaaacttctagaaagtaaaagaataaatcccattgataatcatattcgatttttaaaatctcattgacaataaaaaggagaagcagcgggcggggtggataggagtaaagttgcagagccgccgatgattggcgggacttctagaaaataaaaaatgaattccaacatagttatgttcgatttttagaatcccaatgacaataaagagtaggctgcagatgggccgtagaagagcatagtggcatcgtttgatgggccttctaaaaattataaaaaataaaacccaacaagacaataaactataaaaaatacaagctccaatttttaaaggttcggaacttctaaaaagtaaaaaaaaaacagtgataatcatattcgattttaaaatctgaatgataataaagaagggaggcaccaagcgagtcgtagaggagtacaatgacaaagccgttgacggtttggtgggacttcttgaaagtaaaaaatgaacccaaacaataattatgttcgatttttaaaattccaacgacaataaagagaagaggcagtggacggaccgtataggagtataacagcagcatttgacaggtcttccagagattataaaaacgaaacccgacaagaaaataaactctaaaaattacaagatccattttttttaaaggttccaagaaaaatgaatagaaatagtgatagatcgagcaagcaaataaaaaaaggaaatgacagaagtaaggggtagcaaccggtgtgacttttaaaaactatacaattagaaacacagggatgaaaatatttggtctttcaaagtcttaagacaataaattttaagtaaaaccatacttaaaaaaatatatgattttgtttggatactagccgctcaattgggcgggctacccagctagttaagtttatttatcaaaatatttaatttatctatataattaaatagataatgcatagtaaatttgttcaataatctgtttcaaaacaagtcgtttattgccaaacttatctatatccgtttagtgtatattagtcggccatacaaacataaaaagtaggaaaatgaacgcgatatggatgaacgcgatatggggcaagataaacgtcaaaactttattttagcatttaaccatccgcattttgtttaatcgtctgaataatcattgggcaatatatggttgcattgggctaggattttttttttttggttccgggtccaccatctagatccgcatatgactaccggttcatggcgttggagggaatcttctcgcccgagcaaccaagaaccagctgtggaagttttttcattgttgtttctcaccacaggctgacaaatatattaactatccaaaccatcttttaagttatcagacggtctacataattgacattctcgatggccctttgctaaacctgcaccgattttcatacaatttatatacggaggtacatccacggatccacccccaacccgagcatggtgctcattgtcaagctgaaggcaaggggatgtttgtctcttcagacttcagactttagacctactccctccgtccctaaatatttaacgtcgttgactttttaaacatgtttggccgttcgtcatattaaaaacttttgtaaaatatataaaactatatatatgtataaaagtatatttaataatgaatcaaatgatagaaaaataattaataattacttaaattttttgaataatacgaaaggtcaaacatgtataaaaaaatcaacagcgtcaaatatttaggaacggagagagagtataatttatcgatatttcccttttcgttcggtgcttcaaatgttagtgacgctaattttgtatgaatttttttaatcaaaaattgcttaataatcttgcattgtgggtttctttataagagccagataggacagtccaacttgaacctcccattcgaccagtccatcatcgcatcaatgatccggaccagtcgttcgttccctcatgcacagaccgtcctcgtgtgctgccggtacaatccgttttcgtgacaacggattgtggatggaccgtccgtttttgttgcaaagtccagaccatcctttagtccggcaggaccattcgtcctttgccacatgaagattgtccaaggttgtacagactgtctggtttgatagatgaccggatcatccgttccgcacatccggaccgtctgtgtagttattttatttattgttcgtacaatccggaccgtccttacacatgctaggctgatctggattgtgtgtttttttggcatggtaaattcggatccataccggttaagctaacaaatatcgcagccatgttggaaattgttagttatggccccatcactatctaatgcggtttgccggttctgaaacctgcaggattagcatttctgttgtagtggtggtacgttcacgaaatatttttattttttaactttttatttttaattttattaatagacttttccaaaaaatatttctgaaaactgagcaacgttgttttgccacgccagacacgttggcgttgcagaacaacactgccatgccagctgcgcgtaggggtgaaatcgggtcgggttcggtcggatctcatccttcccatatcctaacccacattttataatcggaatcgggtcgggcacggatattatcggatacgaatagaagcacggataatatcgggcataaatacggaacgaatacgtaccaagacggatacgaactctatcggttacgaatatttattcagatatcaagtcaaagcaacaaccaaatataccacatagacaatagccattcagccatttcctatatgtctattatgaatatattaggggcttatggcatcgtaatgcctatcagcaaaactgtaccaaagtagtagcaaaagtagacattcatagcttgatagcttcagactcaatgctgtacactatagttcaccataataagtagtaccatactagtaaatactaagagcatcaccataactccataagtaatagtactaactactaagtagtaccaaaatagttcacataaggtatacaatcaagccaaaagatacacttatatgactactgatcacatattaccaatacagtcatcccaaaggccagcatgttcagattcaatcaccaaaaactccagctctccaatcagcaacatgctcagcttcaaacactattcgttgcctgaccctaaaaagaacataacattcagttaatacaatgtggtgctccttaactctctcaaaatccaaagtggaaccaacagattgttcatttaaagattgcaggtccaaaatatatttttaaatgcaacacataaatatgtaattaacctcctcatcattgtcagttttagcaccatctttatcctctatctgtacatccagctcatcaagaattattgctatcttgtccttaaatggtcctgtaaataaaattgacaaaatataaacacagtctagaaatggcagattatataaatagcgaaatgaagataaacaagcagttaccttttctagatgctcttatccaatccttggtacaaactagaactgcgaaaaggaccaacaacaagaccaccagcactaaacgctgactctgaagcaacggtagatatttgaacagccattacatcacgcgcgagtgttgagaggataggaaaggtcatttggttgctcttccaccatgccagtatgtcaaattctacaccttcacctgttggatcaacccaacgaattggcttctctttcatgtagacatccaattcatttatatcgtcttctttatttgcagctgcatcatcatacaagaatttctcgatttcattgtgacccaaagaagtattaccatgtggctgagaattttcacttgatcctgcagcggtaggtttcgaagaccttgcaacacaactcttgtaagcccggaaaaatttatcgatagcagccaagacacgcttaaattcctcttcatacttgtcagggtaaatcttctgtaaaaaaaatcactagcttttgcttgtatctaggatcaagaaagcaagccacagcaagagctaggttggacttgtcccaatatttgtcatatttgagttgcatggccacagccatagaagcaatggagacatcaacacttgcacaccattctcgaagtgctaacttaatctcacaaaacttccaccaaaacaagtttgcagttggatatagacaaccggaaaataacaatgtggcatcattgaatttctccaaacaattgcatagtgattctgccataccccattcttcagcacttggtgcacacctttgatatctatcctcatctaagaataaaagcctttcaaaagcacccctgtagtaaatagcttgtttcaacatgtcatatgtagagttccaccttgtaggcacatcaaggggtagcccagaattgttgttcagtcacattctacagcacacttttgaaattcctcccattgcaacgtagaattcttcacaataccaatagtagtcctaatattctgaattgtatgtgcaatgattttcaatccatcttgagccacaagatttaatatgtgacataaacatctcacatgaaagaaagcaccatcacacatcaatggagggaccttactgatgttaaacagcttgttaagctctatcacaacttctctagcacatttatcatttgatgaagcattgtctagtgtgagagcaaataattttttctcaatattcatagacattactcccttgacaaatgcatttgctagccttgttcctgtatgtttcccatctatatgaatgaacttaagaattctcttttgcatcagccaattttcatcaatccaatgagcagtgatgcacatataagctttgttctgatttgatgtccacatatccatggttgtagaaattcgactagaaacagatttcagctcatcatacaaaattctctttctaacttcaaatatctctaatatagctttactagtggtaatgcgacacttgaattcaaaactaggccgaagagagtggatgaactcattgaaatacacatgatcaaccatagaaaatggatattcatgcataataacagctatataccacttttccaagcttacttcaggatcatacctgaaagtctgaacttcacccttcacctgaagttcttgctggccttgtttcaatgagtgaatacgattcaaatgatttcataagtgttttgtgccatttactgtctctgctccaaacactctaccacattttttgcattttgctttacgttgttgctcttccacaccagtaactttgttcttggccttgtcagtgtacttaatgaaatagtcccaaaccttcgaggtacacttcttctgcctctttgctaccggttcaacttctcctgtgaattctccatcttcttcatcgggaataacaacaggttctgaacttccacctccacctccagtggctgtggttgcatcatttagtaccaatgcatttggtgccaatgccgagtgaccagtaccaacagctacggtaccagccggagatgcacctgtgcttgcacacatactagtgtttgcatcaccactagccattctatcctaatcctacagccaaacagcaaaagtaaaataagaaaaaaaaatccttccaagttctaacgtgatgttgagaaagggcaatgaaaaactgaaactttggctaacctggatggctggatgagtcgctgagtgttgacttgactacccaagaagatgacgaggtggcgcgacgtccttcggctctcggcgttgaggagccaaaagaggcaaggggccaggcggggccttgcggtggtggtcggcgcggcggcagtctgacggtcgtcggcttgtcgcacacccacgcggcgacgtgcgacagcggccggtggtcggtgggcatggccgcgtagccacttggtggtcggcgaactgcgaaggcacgacggcggtgctggagcctggatgcacgcatgcggcgtgcggcgcggtgctgcctggctgtttgcctgcctgcgttctgccctgatctgaactgtgaagtgaaggctagggtttgtgcttggcactttgtttggtgggccttttggatgtgggctggctgttgcctgttgtgttggcctgttgggtgcttgcctgttgggctgctgtccatctatccgggtaatatacggatagattatcgggtaatacccgcataatttcccggataatccgtatccgtcggataccgctctcccgaacccgatctcatatccgcaaaaaattacccgtatttgaaccctgtatccgtgtaagggtccgggtacccgaattcccgacccgaatttgacccgaaataatgtggccgggcgggcggtcgggaaatacccgccccgttttcagtcctagctgcgcgtggcacgacatagttatttgggttctgctttagaaatacttttcggaaaggtctattgataaaattaaaaaataaaaaagtctaaaaagaaaaaaaaattctacgttcacccacccaattaatctgttcctaaaaatcaatatataatttatagaactctagttgtaaatgttgtacagagagatgagatgatcgatcgatccggcaggcaggaccatcactccagcccgtcctgctgtcatcttgagctgtaatactccgcacactgtccaagtgtcgctgtacgtggaagacacaagaggcagggcatatggccagattctgtcccaacaccaccattcgtctggatcggagacgtcgcgcgcggcgcgccatatcctgctcgcgtttccccggtttttcgtattaaaaccaacggcgcgccgccgccagacgaccggacagagtgctcgctcgctgctgtctcttcgagcttgctttgcgtttgcgttgcgttgctttgctcgatcgatcgatcgatcggtcactctctgtcttccccatatgctgaggtcagtgtccgggtccaactcgtcgaggggcatcgccgccgtggtcggcgtcggccccaggctcggctccgccgtggctcgcaagttcgcctccgagggctacaccgtcgccatcctctcccgcgacctcggcaagctcgatctccctcttcttcttcttcctcctccgttcttgcatgatggccggtgatggtggatgtggttgtgtacgttggtgcagagaagctgtcgcagctggcggaggagatcgcgcaggaggcgaaggcgcaggtgttcgcgctgcgggtggactgcgccgacgcgcggtccgtgcgcgaggccttcgaaggggtgctctcgctcggccccgtcgaggtgctcgtctacaacgcctgcgagccacccgccgacggcgacggcgacgcctccccgcgcccgactcccttcctcgccatctcccccgacgccttccaccgcgccctcgccgtctccgccgccggcgccttctactgcgcccaccaagtacaatccatcaatccacatctctcctctcgatcatatcttcgattaatcagtaatcacccatggccatgccggccactgatcgatcaaacaggttataccggggatggtcgagcggggcaggggcaccgtcatcttcaccggctcgtcggcgtcggtcaccggctacgccggctactccgatctaagtaagctgatccattcactggctcgatcgatcacacgtaattaagcaaccggattaaattcctggatccgagtcatgtttgcgcgcgagtaaaatgcatgcaggctgcggcaagttcgcgctgagagggctgtcccagtcgctggccaaggagttccagccggccggcgtccacattgctcacatgatcatcgacggcgtcatcggcgaacccaggtcagtgaaccaaaccaactcatgatctcaatttcactaaccaatacttcaagaaatcaagattacggacgtctttgcttgctagatactaatataattataaagcataaatgcataagcttattatagctttgattcattacgggtagtcaaattgcgggtaattagtttgggcaagtgcgagtggaatattgtccctagtgagctatgacaagaagaagatataccaaagtttcgggagatctctcaatcctatcgttcgctacctcgcgaaggtcggtggtcctgtggcgtcgtcgcgaacgtgtagatcagatcagctcatagggcattttcaggaaaggggaacagaggagaaaaaaaataaaattttgcgtccctctcataaatatgcaggaatacattccgcaatgatggcacggatatatacgacttccgtaataccggccactgaaaaacatgtgcgagctgcttctttcggcatcattccttgaaccctagaaagaagatagttcagtcgttcggtcaatgcgtatattttataatagatagtatcgaaataatttgttaatatatattttagaaaattgacttgaacaagtacgtaagcataccgatattttgttaaaaccgtaagtatgcgtaccgatatatatgccctcatcgggaatatgcaaagcgatggtatatgatagctatatatcctcctgatcaaccaacgagaccacttgtacaacatatcatatatatgatttgttgcattgtattgtgttggatttttttcttaaatagttatatctatctatctacttttcagaggcataaaaaaaagtcaacatattctctcttcacgtttggttgtctagatttttccacattaattgaaaaaaaaagaaaaagatttgcatcaattgatcatggagggtctaaatataaaaatatttgcatattagaccataatgagattagattataatggtacagcttggttcgcttttaaaactagcccgtgtagaatttcagggggaaaaattcaataagaacttaaaagtttccccacattccagatgaactttagacctttagtatattgcctttgttcttttcgaaaactctatcacttacaagaataacaacttttattcatgctcaaagacatttacaataggaagtggtctcatggtatgctcttgggaggtgcagcagcttaagcaagtattagtgatactatacttggacaatgcattggaacttaaatggatgtaaccgtaattttgcacttttatgccttgttccttttcactacagcctataatcttttatatttactttctaaagtgaactatcccatacaaacactatcaacataaaacagtttataaatatgctcctaccctacctgtcagccactcgtccatcatttcagcttcccacactcccatctctctccccccaccaatttctttgatcttcctccattccataccgacacaacaatatacatctttctcgatgccagcactaacaacacgagcctagcagaaagccaccttaatgagggatcgaccagcctcctacctctctatattgaaaccttaatttgggatttgtcaactacccaatgcctcttccctctctctttcccatctgtagttgcaactgtgtactccgctctattttgtaacggacaggatccccttctctccatgaacccaagcctcaacttcatctggagaagccatagcgaagtatggtgaaactgatctagatccagtatcgtcacaaaaatagcagctaaaaacattggtattatggatcaacgccatgaaaacaacctccctctccctttgtccacagcgagctacaacaattatttttccaagaaaaatagtacaaacacaagcaccaacatatatacgtgtaaactcatcgctataaacactctagaagtatatatgtccgagagactgagctagcacttccataatttagtgataagctattctttatgattctttttcaggctttttcttttctttgcagcaacatgcatgcatcagacaacatttctttttcagttctcgtgtttattccgtaccatgatctcgcttcactgcacaaaagatttccatgccctacgagagcaggacacggcgacaccatttcaaacccatcgctatgctgagttgtaaatgctcttgtctactgtccgatccaacgcctcccttccattcatggcatctccaaaaaaaaaaaaaagcaacaaaatatattctctttctagagtcatagtccgatccgacctgttcgatctcggaaactttttaaattactacttttggatcataaatcgggttggatagttgggcacctggcccaaccaccaactgccaccttatgctgcttctcccctcggctcgacacgttacgcgcggtccaacgttttcgcccggaaaaaaaaagctctcatgccgtccttgtgacctgccgcggcgccggctgccgacaccgcacgcatcggcgagcgaatcgctcgctcgatcgcgcgcacgccgcgtgcgatacgctttttcgcgctcgcgctccggcgctcggcgagcgcgcaccgagaccacgaccatcgcggctagcttttttttacagtgtgggtgggttaatcgcggggcgcgatcgagtgatgatggaagcgtacgtgatgttttcgtgtgtgtttttgttgcacgcaggtcagggagggggaggtgcggcggcgagacggcgtcgtcggcgggggcggacccggacgcggtggcgcagagctactggcacgtccacgcgcaggacaggagcgcgtggacgcaggagatggacatccggtcgccgtcgctcatgtagtcggccggccgatcggggaggtggagaggcatgcactgtagctccggcggcggaatctctactgttgccaaggaaggaaagaagaaaaaaagaaaattcattgatcgtgtcatcgtgtggtgtggtgtgcgtgtgcgcggctgcggaccgggcatcgtgtccccgttccgcgtcgcatgtcttctttttttcgcgctgcgtgcgcgcgccgcttggcgcttcgcgcgcctaatttttagtgtgtggttgatgcatcatccgtccgccgtccatcggcagcatccagcagccggtgcacggggaagttgccgacgacggcgacctgcaaaaattcatgtgatttttctgtacggttttctataaatgtatagtagtattatgtctcgttttatgtggttttctgtacggttttctataaatgtatagtgtgtctcgttttatgcatggttacctgcacttgattgcatgaacagtgatgggatggccccttgagaattaattaggtagcgcatagcaatcgagaattcgagacgctcttttgtgggaaagcatggcaaatggcactggcccagacagcccggggccgcagttgtgtcaagtggttagccagtacagggaggggatcaagtggcctttcatgtgagaagagataggccgatccaccggctgtttcatctgattgaaatgatttcggtgtgacggtgtcccagcaaatgtggacgtctactcagtttctattccaatgaaaaagaaaacgagaattggagagagacgtcccttcaaacattgttgaagaaaaaattgtgagcatgttagtgattgaacatgagatctcagggttaaaaccacgcaccccttaccactgcactatcaagtgcatctcattccattccaatgcgaaaacactactctgctaagttgcaagttgcaaggaagatacactggcctctgtaatcgaggccatcaaaattcaaaagggtcgtatgatgtcaaaattcagagagatctggttattgctaatagagctgtttcatcacagcaaagagatgccgacaatagagtggtactctttggacatgtgaatagtgttacatgtacgacgctactgaagctgggtttatgcagagttcttatcgccaccaaaggcgttttccagaacaccggtttccttaaggtggctgatgtccccgcacgccttgacaatgcaacgcccagtggcaccagacacaaggattacgcttacggatgtgttgtgtatcttaccgtgaagaggcttcattggactggcatgcctgtagagttctctgatggttccaccgtgcgagaccaagattattcgctcccctgttgatagagttacacaagctcagaaatgatcagaagctcacatgcaggtttcaataaaatgcagttgcaattacagagttatgttatggaaattaattatgttgtgtaaacactgatgtagtatctccacctaatatcaacacgaagcacgaaacagcacgagtcaattaaggatgccaataagccaactacttaagtggtattccttttgatagactgattaaagcatttcatttcatcatagcgtaatgtaaaaactctcagacaatccaattataagataaaactccaaggatgaagctcacagtttaccttgatgtttctcgactatgttgtacaagcaagagacacatcgctctgatagttgatcaagactttctccaccaccctgaaaaacaagcccaaaattcttgtaagagaagctactgcaagaaggcatatggtagcagcaaaagaagtgnnnnnnnnnnnnnnnnnnnntaaatatggcagttataaagctaacttgagaagcctctatgccaaatgttacaggtaagtgtactacaggagatttgatttgatagagagcttttgtcatttcaataaggtgaaaaattaaacttaagcacatatttgtagttgaagatcatccatgtttgacacgcctaaacttgatctcttgcaaaactgcagccctaaactataaaaccgaacatttaaatcctgaaactcataaaaccattttcattaaacccttagcctgatttactggtggtttcctccacattagcagtaacatcacaagttttcattttggcatcgcaacccagttagcatagtcttaactagctaatgtgatacagttgatggcacgtcaaatgaggtggcaaagctagcaacatgtagatgacaggtaagcaaaacaatagtagtttaggtctaggggaatgtttcaagagtttttaggttgtaatgtgtccagctttgtggttcaaggttgatatttcgacttgcgcaagggttcagggttgtatgaccttttttcaaaacctatgcaacggttgactcaatggcatcaaatgggcgtggtatcattgagaatctgcttgcaaacatccagcaattgacaaacataccacctatgtatggtcttcccatacatggtcgtcatggtctttccgatatgttccaccaagctagggatgttcagttgtggatggctagctcactaagccccgacacccaccctcaccaccagcaacccccgccatcgccactgtcgcccttcatccacgatcccctcccattagctacccaaccctagtttccctccagtcgtctagcccccatagatcccccactgctccttccccggtgaaccctaaaccctatgtatggtatcagaagcataatctgtttgctgaatcaatactgatgtgttataaaaagtaagacaatggagtgcttacaggaatttgtcggttcctcttgtgcgacaaaaatgctctgtaagcctctggcttttctttgccagcatcttcatactttaagccctgcagatctccgatgtgtctctctctcagtgctggatcaaacacaacctatgatgcagacagtttctacattagtaatcaatgaccaattgatcttctagtcttctacaaacaatacattatgcgtaactgaagcagcgtagatagtcagcctgagatatttaaaaaatagaaaagtgcatgagttgaatggacaaacatttggcaaactgcaagcttttgctattatttctgcagtctctgccgctcgcttcagatcagatgaatatatcgcagctggcttggcttcattagaaagacgccgtgcaaccttgcattaaagtcaacaagttccacataagacacaccactccaaatgtcttacggcaatctgaaatatgtcataccataccgcaacagcttgttgtcttccaatctcattcagttctacatccaggtgcccctaatacaggattttggttctatatcagttgaaaggcagtaagaaactataagtgtgataaaataaacttatgaataagacatggttagttaatgcgcaaagacaaggtaatgttggtaatcatatcatgaaatgcctttaccatactttgtttccatattacacatcagatatagtcaggtaatgtgtaaccatagctatctgacaatccactatggcgagtcatagcataagtttatcgacagccataaaaccttactgcctatcatctcttaagtttttgcattgcataacttctgttatagaaactgttccttacaacagcagatgtacgagggaattttcctagtactttagtaaacaactacgagttcagaccatgtgatgaagcacatattgcaaactgtaaatttctataaaaggaataagggaattgcattactttaacatttaacatttttcacttcaactttataaactttattatacgagaaaatcatatcaatccattaagattaggggagtgaataaacagtcactggaacaatttaattaggggagtaccacattaagggtttcatgctgaaaacaaaagaaaaacaagacctcttatgtaacgggtgcaatcaatcaatcaaaatccgttcagcaaattaaaagaactttctaaataccaacatactttcatcaaattctgcatggcatcacttgagaaaacatccattttgtccgacttgtgagcccttgtatacgatatatcgtccttatcaagacacgttctttgtcaaactattttggcttagattagatagtaaagccaactagtctgtattactccggagcattgtctaaggtacaccggagcattgtaaagtctgagcactgaatgatcaaagaactagaaacaagtgtaccaccaaactatcatttattcttcccaattttcccaaccaaagcttttccccaaagttgaagaccaaagcttcagagaaatagatggggctcggggcgggaggaacagagcacggaacctggatgatgcgcgaggcgttccaggcggtctccccgtgccgcaccaccacgacctcggtgaactccccagcctcgctctccctctccctctccgccacggacgcggacgacatccctaccgctgcccccgggtggtgcccgtcgttccggcggatctgccgggcgacggcggcggcggggccggcgggagcgagggacgcggaggcgcccggtggcggtggtagtagcgaggtgaggacggcggcgatggcggcgcgcggcggaggaggcaggcacgtgggcatgccaaggaggagcggaggcggcggaggcggcggggagaggccggcctgttagaagatagcggacacgatgggccggccaaaattggatacggtcaggttacgcacaagtttgttcggcccatcaaccagcgaatacaagatgaatattaaggctctgttcgggaggggttgggatccctcctccccggcacgtaaaacgatgttcgcattaacgcgtgattaattaaatattagctatttttttaaaaaaatagattaatatgatttttaagcaactttcgtatagaaactttttgcaaaaacatatcgtttagtagtttgaaaagcgtgcgcgtgggaaacaaggtggggagttgggaaccatggggaacaaacagagcctaaaatgttttcccataaaaaatattataattttttttaaaaaaatttcggtttggaaaaaaaaatacaaatatactcataacccctcacgccccgtcctcccagagggtgttttgtgtgacgtggcagattgttcatagtgtgacgtgatagattgttgatagctcacgttaacgaccatccgtttaggcctgtcacttttgcaagcgccacccttactattctcctatagaacgatttttgctccacctagagcgccactcaaaaaaggtaggctcgtccctctgtctccctctcaggacgaatggggctatctgtatttaaatcgttccacctagagcaccactcgaaaaatggtaggctcgtccctctatctccctcttaggacgaatggagctgcctctatttgaaatattcaaatcttaaattcgttttcttaggaagtcgaacctaggacatacaagtactacttgagtactttactactaggctacaacccctttcgcttaataaaaaaaattaaaactaaaaaattctgcaagatgacaaacctacatgcatcgttgctagcctagcccactttctcttcttccctttcctcctcttatcttcccttgtcgaccagaacaatcaagtgcatagacggttcctctttctcatcgggtaggtcgagtgtaggcaagtggtctcccactagcaagctctccctccacctttctctagcgaactccctcacgcgctctctctctctctgacgaattccaaatccaagctagcaccaactcctagccttctcacccgaccacacctccaccatcaatccatctccctaagccgccgcagcattatgtgcccccgtcctgctatctttctcatctttgatggctctccgccactagagacacccctgcctcctaactgttcggttcactttgctcccaccactaacactaacccaccatctggtgccgaccccgtggctcctgcgcttatctgccgcctccccaccatccctctaagcacaagaatccttgcttatctctttccagagcagccttctctgtaacccaaccctaaaccttgaccgtagacctaacccatagcttatcacgatgcattcatagcgtgcctatgagttaggattttcgcacatatatccatgctttcattttcaaaagtaccaaaaaaaaatcccatgtcgaagttcacctaaatcttttacagattttgaagtattataaacattttcaaaatagtttatagcaaagcaacacaatcagaggacagttgccatgcagtggcttccttgcatgcgcgcgcgaccaaacaccgcatgtgctgtgtgcaatgcagcacggatggcaagtgagtcagctgctccccaacaattacttccgtggtgtgtgtacatgtcgccgagttaaggcctcccatgactctttgtgcaaaaactcgcagatccatatcgatcaattaatctctgcaaaaaggcaaaagccacaaattaagtttctgcacgtcctgagtcctgacctgacttatctagtgcgttcataaagtttaatcaatcaaagaagcctgcatggattgatatatgataatataatatgactagtaagcattgatcatgcatttctaaactcaatggctgggcctgagcttgtctggatcctgattgtctgcagtaatgtagacgacagttactgctcatgcgaggagaacagtgaaaaatgccaggaacagtatagatccactgtaggagtactcctaaaaatactgctgatcattgtactcccaaaatactgttgatcaatgtagtagttagttactgtgtcgtatgatctaagacattgattatcatcgaacggcaggggaatgcccctaattcaggtcactgttgccctctgcagtgacatttctgaactgcacagctgaagttctaaacattatgccagacacataaagtcttaccaacagtgcagtgagagctaatcaagagctagggacttgtgagctaggaaaaagacagcatcactatttctatgcatttctttgaagcagattcacttgctccgccctaaaaaaaaagagatatatatctagtagcgttttattcggctccagcttcacatgatgaaaaatctggatatgatttgcccaataggcccttagttttaacctgttattttagctcaccttaatccagttttcttttgccaatttttagctcatatagcgatatcgatcttctaatgattgtgtgtgtacatcttaaaaaagataatcgtgcaactgacgcctaataaagcatttgatggtttaatccaacatagacaacattattagcaaatgcatatgacctcccaacatcttcttccacgcatcctccttaaatagcgacgtgatctcctcagctttcttccccatggggctccatcggagcaaagctctgcagccagccagctgctagccgcgcgtcaattcagacggcacaccaaactccacctcaccatcgatcggtgtcgccaatgccatcgctcatcgatggcgcggcctcactgcggtcactcctccggccgtcctccgatggccgccggacgacgaagctgtccggcggtgggggcggcggcggcgccggcggcgtgggcggcatcttcaagatgttcaagctgctgccgatgctcaccacgggatgcaagatggccgcgctgctggggcggcacagcggcggcagggcggcgcccctcctcgccgaccacgcgccgacggtgacgctgttcgggcaccggcgcgggcggctgagcctagccatccacgaggacacgcgcgcgccgccggcgttcctcatccagctgcccatgctggcgagcgcgatgcacagggagat

SEQ ID NO: 68358 - DNA, 1722 bp, Oryza sativa
ctgctggaggagtacgtctgggccgtgttctgcaacggccgcaaggccgggtacgccatccggcggaaggacgcgtcggacgacgaccgccacgtcctgcgcctgctgcgcggcgtgtccatgggcgccggggtgctcccgccgccgcccgccgaccgcagggggggcgcgggccccgacggcgagctcacctacatgcgcgcccgcgtcgagcgcgtcgtcgggtccaaggactccgaggcgttctacatgatcaaccccgacgacggcagcgacaacggcggcgccgccggccgcgaccgcgagtgcgccccggagctgagcattttcctagtgaggaagaagtgagcgaggaaacgagtattttacatagtatttatactgttctcttgtgaatacaactatatatatacacacacaagtacacacattatatgatcgagctatatattaatagtatgcttgtgtaattgtgatgatcagacaatcgtcccaattaatcacctcgcccctcattgcaatgatcattcgctacatgcatcttgtactcccttcctccatcctaaaatataaacattttgagactcggacatggcctccgggatactattttaactaataatatttataaaaataagatgttttaaataaaaagagttatatattatgatagtttgtttaatgataaatctaataacatcaattttacatgattgatcttttttatttttttattaatagttaaagttacaaatgtttgacttttcactatgttaaaaatacttatattttaggacggagagagtatcactctagagattgtttttacacttagatgacacatatctttttttttttgaaaatacatgcaaatagttggtacggcagttgtttttacagtacaatgcatgccataatatcgtgatgggacacgtacgtaccataataattttatctttaggtctatgatcgacaagcatgtgggggcagatgttgacacaaaggtcgtagttccgcagtactttgttcctcatcaacttgatcacaaattatatacttatatcatcatgttagatatgaagatatatatagtttaaacgttgcacatggataagtaagatgtatctccccagcagtacgcatgataagcaaacatatatagcaagcacgggtggatttaccatggggatgatggtggctcaaaccttcactattgacatgacaatcatggaaacctcccacgaccccaactaaatatttttaccatatgtagatggcaggaggggctctaactttatctaattcgtttagacccctgctattttttctggatgcattaccaataacaagtagaatctcactgcatggttagtttagtttatacataccagtatgaattacggtaatagtgttttcatcccttgatgggatatcctctcatttcattcatgccatataaataatcataaaaaatataattttttgacaagataggttaatttattttatatataaccccataatatgtaagttaaaattcaacttttacaagttgtaacaaaaataattataaatgcatgataactatttttaatttaatttattttttataacttgtagaagttaaattttgtcttgcatgtttatagagtgatatattttatattaactagaaaaaatgcccgtgcgttgcaacgggtgaaaactattttaatcttatta

SEQ ID NO: 68359 - DNA, 1206 bp, Oryza sativa
aaatgcaagaagacatgccaaaaaaacctgttatggcaagagcagtgatagctgatgtcaacacacttgaggagtttacattatcccagtaggagcaattagaggctgagggggaaagagttcagctaataggcagtgaagaaatggaatctcaggagttagggggagataacatcaaaggtaaagaagatcataagagtgaagaggaagctgaatttgaagaaggaaagaagaacaagaggctcagagataaagaagataagaagatattggaaatggcgatggaaaggaaggaagcaaaaaatgcatttatcaacaaaggtaacattcacattccttcttttatttctgagtccaatatttcgctagttcaaatggcacaagtgataggagttgatttgggttgttctattgatgctatagatgctaacacacaggttcttagagacctagaggtagccagaataaatttgtataagaaaacgatgagggaaaaggaaaataatggagagctcttgcaaaaaacagggcaacttgaccctgaagtaactctagatgtagaagagactgatgaggagaatgatttggactttgatttagcagaaattttgatgaatcatcttaagactccaagatcagggaagaaaaaggggagaaaaggaaatcttaaaatttgcaagggaacccccaagattaatagagacttgggaaggaggaaaacaagaaaataaatgaaaggtttaatctggaacattaaggagatgtgggatgatgagaaactgcaacatctaaaagaggttttacagaaagaaaaaattgatttcctgggcttgcaggaaacatgtaagaaagattttactgcttcctttttgaacaaaattaattcctcttatatcactaaatggatgtggtctccttccaatggaaggtctggagggatcttggtaggtataaatgaaacaatctttgaaattatggaagaggagtatgagaatttttttgtgagagtgttgttaagaaataaggaagataattttcttggatcttgttgtagtttatggtgctgctcagttggatcagaaaagggcattcttagcaagtttagcacatgtttgtcagaagaacaagggccctatcttgttaggaggggactttaacataattaggaaagagagtgaaaagaataagaaaggtggatataatagg

SEQ ID NO: 68360 - DNA, 1425 bp, Oryza sativa
tcggtagtagctcgagtagcctccccgtagttagctggcgccgccccgaccgttgccatcgctcgccgtgtgctcgccgccatcgccgcccgagctccgtagcacccgctcgtcgccggcctcgctcggcgtagttccgcccaatccgacgctagcgtcgagttcccgaagccgcgtagatgctctcaccgccgggaatcggcccctcgtggcctcgtcgccgtttccctcttccctcgccgccggttgccgccgccgtaatccgccgccgtcgagcaacctccagcgaatccgagccgttggctcgtctcccctcgtcctgtgcagccacccggtgtgctcgctttcgccggtatcgccgtggctcgctacgccgctcgccgctgtcgcccgccgtccattcgcggccggttcgtcgtctacctcccgccggcccgcgtggctgccacgtaggcgccacgtcggcgccacctcggccgcgaccggataagccgacccggccagccgctccctccgtttctccccgtgcgtgtggtccgcggtgagccgtgaggctgcgcgtgggcccgccgcatccgttcctccgcgaaccgcgcgcgtgcactgcgtcccagccccgcccgcgcgcgtacgccgcatactccctccgcacggtgagccgagccgctgacaagcgggtcccacccgggaccacgcgtggtgagcccggtccaccggctccctctctctcctccctcccgcgcgcgcgcgcgcttgggccgtcttgggccggccggtccgttaagctcggccgagccgccccaaatctcttgggccgcaccctagccacccgagaaaagtctatattccctccctcccttcttttctttttcttttccaaaaaaaggatttaaataaatcctttttcctttagaccaaaaatccaataatcttagaaattcaatatcttcccaaccgtaaattcgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgaccctatatttgaaatttaattatattgattgcgaaatattatgcattgataggatcacacttaatctgttgtcccgtctgcaaggcagattggcagacctacctaatttgttacatttgatccttccattgttaattgttataccatgtccccttggaaccacccagttgcggctcgatattcgtgcactctgggcgagtatcgaccgtcgcctttaaacttaaaatctgagtaacaacttgggtaaaactgg

SEQ ID NO: 68361 - DNA, 1225 bp, Oryza sativa
gacaatcatggaaacctccccacgaccccaactaaatatttttaccatatgtagatggcaggaggggctctaactttatctaattcgtttagacccctgctattttttctggatgcattaccaataacaagtagaatctcactgcatggttagtttagtttatacataccagtatgaattacggtaatagtgttttcatcccttgatgggatatcctctcatttcattcatgccatataaataatcataaaaaatataattttttgacaagataggttaatttattttatatataaccccataatatgtaagttaaaattcaacttttacaagttgtaacaaaaataattataaatgcatgataactatttttaatttaatttattttttataacttgtagaagttaaattttgtcttgcatgtttatagagtgatatattttatattaactagaaaaaatgcccgtgcgttgcaacgggtgaaaactattttaatcttattattgttagtttgttatatggtttagttaagatgaaataacaaactaacaataataagattaaaatagttttaatcttattaaaactatttaattcactgtgttaaattcgcttgcatatatattttgttagaaaatcatgagttgtaattaggagtctgatcgtctcaagttagtatacgagttttttaaaaagatttcttatacgattccttttgtatttgcaaaagcaaacgaacttaaaaaccgacacatacacggatgacataccaaagtaccagaaaaacatcttcaatttttataatagtggagatagagagatatgttatcaatttttatttttttaataactatttaaatgatatataagcagggatgaaaatccgtatcctgaattacgttcaagtacaacatggtgcatacataatgatagtagagcatcgatctgggtcggcgtcagcatgggtccaaagatccgactggaagctggcttgaggttatgtgcaccaactttggtatcgcatttgaggtgtgaggagaaggggataaagttagggtttggaggagggtggagagaggtaaaggaagtggaaggggagagagttcaatggccgcgtgaaggaatcgggggccgaaatcgagagtgggggaagacgattcacggagattcgaggagttttgcacaggtggtgagtgctgaatcatcacaatggcggataaggggg

SEQ ID NO: 68362 - DNA, 17643 bp, Oryza sativa
  unsure (1)..(17643): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaggcttttaagaaatcaacagctaagccagaaacaccaagcacagcataaatataccggtattgtacaaattgagcctcatcattcgtcattcgatgcatttacatttaatcagtatcagtcttctcatcatcagagttattgttactagtcggccgaaggtcggtatcctgaaaccgatctacgacgtcaccagcaatcttgtcggctgctttttgagcgtcgttgataagatcaagggcagcctcttcgcttgtcccgtccgcaaaaccatcaaaatatcgatcttagggtacagggatttggtcattgctaatgctaagcctactcccatgcttccggcttctctaatgttcttgaaataggtgtccggagcgattctcagcttgtcaaacacttcggaagcatcaagtctactcgggccattgttattatagaacatcgcctggacaagtggggtagcggcattggcgacctcgtccctggctccttcaagtcttttgatcttgccaaccaggacgtcgaactgggcttgggacttgatcttgcggtctacaaaaacaaatttatgtcaatgatctgctgcatcaaagagagaaacttaggttgttggctgacaataccttcaacctccttcaaagccgagtccctttgtgcagccaattctgccttgttattttctaaggcctcaattcgtttctccagttgagctatcttggcagcttgcactgtttggattccagacggttgaggatacaattataacagcacaaattaatggggcagatcttgaggttaccttttgatgagccactcagttcaaagttcgaatcctggagttgggtaatccggtcccttagatcatgctctgtctttttggcaagctctttggcttcgtgtagctgatccctaactgcttcaagggtccctaaatgaggaaccagcttttctaaagttgtggttttggcctcattacggagatggattctctgcgcgatgattcacggtttagtcttgctgagaaaaaacaaggtcaccaagggcagccacctggaagacttacatttacaatacgggtagcttctccgagtgctttcttcagctggcacacctcctcgtcttctttctgtcggtttatgacaatgcctgcaggttgcgagttctcgtcccaccatttgattaagatagggggacgagagtcagcagctgcctttatgcgagggatttcctctccgtcaccgcctagtggtcctgatgtattcccagacattagacaagtgaatcggagttattcagattagcattacttgagaagatgggttacctgaggtgatttccggttgagcgtgaggtgatccttgccctttatctggagacccaagcgttgggtcgttaccagcgtccggtccttgggaagttgtagcctgaacttcaacttcaggaattcttgatctggacctacttccgactgattgccagtcgggggctcttggttttttgcggtttctgcttctgccgactggtttccagtcgggggctggtcgcttggattgacgttatcagctgaagtctgggcgctagtcggctggtcctcagtagtcggcccagcttctttggatgaacctgtttctgtgttagccggatcagaatccttcccggatggatctatgtcggacggtttcttgcaaagtttccttccagttttcaatattatcttcatgagagaagcatgttgaagtgaaacggtaccggatggtttatacctggaggattttctaaactttggcatggggcggctagacagtttcttcttcggagcagtgtgctttggtaattttttgggtgatcccttatccccaaatttattattgtcgtcgccttcgtcgtcgttcagcataagctttctcttgtgagaatctgtctgcccagtcggattgggagtttgggattgggagtctgacctgatttttggtcctccactcccctgaccggtctgatgacgaggagatcggcgttgagcgattggggggtcagactttatcaaagcaaattcctgaatgaaatgcctccacggtcagttaattcaacaagaagacaaaattatgttttgatcacggtttgaagagttctgatacataccagcggaggtggattgaatgcattgtatggcacgactggcagcagatgcgaataactgacgacaatggcgtttgagaatatcttgtacatcctctccttcatgatcttaaagtccagagaatctgggtcttcacggtttggatcatgcttgccgtcaaactcgaatgctgtgcgagatctctctttgattggagctaatcggcacttaatgaaatgtcgagtgatttgctctccctgtaagccttgctctttgagcttcaacatgcgttccatcagttctaaggcttgggcagcttcatctcccatgggaagagagttccaggtatcttggtatactgggggaagacaggagtactcgggaagagcgggctcgggattttgaatataaaaccagttggcgtgccatcctttgtttgaagtcttgaagggcatagaaaaatacttttggctcaaggtccctctcagttgaaatccagcccctccaactacgcatggtttgtttttgttcggttggggcttaaggaagaagattcggcggaacagagcaaaatgaggcctaatgcccaaaaaagcttcgcagacatggacgaaatttgcaatatggactatggagtttggattcaaatgatgtaaactgattccatagaagttcaatatcccacggaagaactttgaggttggaagagcaaatccgccatagaaaaagtgagaaaaaaccacgacctcatgtgtatcgggggttgggaaagcttcaccacatgctggccgccatccgatgatctccttggctgggagaacgccgtgcgccaccatctccttcaagttttcctctgtcacgtcggacgacgcccattggccttcaaagctttctttttcttccgccatcgatttgatccgaatgagctgatctgattcgagggatggctggggagagatgtggaattgaagcggtgagtcgcggggaggattttggtgaactttttgaaggtggattggagcagaatggtgaaccctagtttcgccggcgcagttctatactatagcaaggaatggggaaaatggcgagagtcccggtggggaagacgaagcgcagcttagatttcgggattttctgttaagggtttcgggggtgctaatgggcctaggcctgaacagtacttcagcccaatattattaacagcgtggcccgttgtgctccttagggacttaggcatttttgctttggcaatttatgctcacaatggtgtggctcaatgctgataaaatcctttttaatgcggttatataattctttggaattattgcaatgcaaattaaaaggtacccgacagaaaagtgttatactatttttgtaagcttttttaggctgcaaaagctgtctgggttaatttgggatgacttgtttttacaatggtcattctcttggcgtgttatatgcctattttaattatggtgaagagtcatagcctaggctattagacttattaattaccataatttttataatatttgatgggttatctttagagttttctactcgggtgcctgtcaaatgtgttcatttgtgaactttttagagtgttattcactcagattctttttactatggctggaaagcagtcggctaaatgccttgttgggcgccgcatatgcttttgtcatatgatacatgattatgctataattttgttctcgactacatgtttcgtttgttaactaatcatatagtcgggggctacacctaattaggtgcatctattcgatgcacaatgttttttatcttttcgcccattacagtctttgtcttcgctactcggcaggccttagcaggaagaaattaaagcactcggattattatttttgagaaagctatgattgttgactgcaaaggtctcgggggctactgtggagattatggataccccatatctacacggcgattatatttagactggatataggataccgaatatagatagaatatctttatctgtatctcgggtttgtttcttaacttgtacgtcaaggaaataccctgagacttagtcggttacgattgtattttatctgtactctcatattctgataaggatatgagttataccttgtaatacggactccttcccctatataaggaggggtccgagtccttcctgggacatcaacttttctggagattatacatccaataatacactcggcggattcatccccggacaggagtagggtattactccttgaataagaaggcctgaacctgtataaatcctttgtcttcaaacccatccacttttctagcttgatagccacccccttttagtattgccgaaatcttgtttcgacaaacctcaaaagccaatggaacacacgtttggcggtctatccgacctactaggatcggtctgaccgaactctaaccggtctaaccgcaggtcctctcgcggtctgaccgtcagcctgaaaacagcacgacagcgcttcggtaaaaacacgatttctcttaaaccaaccgttggatcgagttgaaaacttgacagaataaactagacaaactaaggaacaactttactggagggatttgcaaattaataaacggtttaagagaaaacaccctcgaaagttagatgtatcagaattgcagcaaatctgaacaaaacctaaaagttaagcaaattcaaatctaaccagaaccaatcaacgaaactttccagatgtgatctatgaagtattagaaaggttttggatgaattaacttgaacaaaatcacagcaacacgaacaatcacaagttaataccaaaaccaaacataaacgtaaaacttacgaaaccggaatagatcgtcgatgccttgacgattgaatatgatctttattgctaaagtatattgttcacaaggtgcagccagagaacccctcaaaagtttctcacaaaaccctatctaatatctcaaacttggcttcctaaaactgatacaggagggccacaccctctccctctatttataccgaaaacttcctactcaaattaggagcataactcctagttccactaggactttatccaaattacaatctccaaactcatctaaaccggaatcctgatctcagcggactccatccaacgcaagcaaatcgtctccagttcggactgcctcctcggccgactcgatctccatccaaccgagccgctgcatgctgctattgcacagaacgcacaaacacacacgcatgccaacctactagctgcacatgtacagccacatgtacatgctagcccacacagtacgcatacacatacatgtacgtactgcacgctacagtacctccacgtactgtagcacatcttttatccttcatgaacaccgacggttgcacgcacacctcgtgaagcccgttgtgaagatctctcccacacggtgtccatccaccgtatgccatctcgtatccaacttcgtcatccggtatccttgaccgtctgatccccaccgttgaccgaagttgacctccaagaatcctgactctagtcaccttctcacatggtatcccgaccgcactagacctctgctcctccctgagcatagtcccagtcctcaccattgaccaaggttgacctcaagtcacctgcacacaatcagacaaaacaaccgtttctgggcacagatatcacaacatgacccacattagtcacacgcactcacaccaacatccacacatctttttaaaccaattcattgattaaatcatttacacagccaattgtttatcacaaatattaatcatgacaataatttcacaatttgacgagcataccaatttaaaaccatggactgattgttttatgtaatttcagctacgagtctgacgaagatatgtgcaaaaaaccaataacttcgtcctcatcaagaaaaagagcagctaccttagctgtttatgtagtggctccagtgcttgtagtcgccatgcttgttgtagcatatttgatctggagagccaaaagaaagccccattgtgtgtactactataatctgcattgaaaaacacattgtttaatatctgcattttaatactgctaaatctgttctttctgcaccagtttctacagatgattctcccatggtaccagaacagataggtcctcccagacattggataaatcattgggaccatctacaaaaacctaagaatcatcgattcacatatgaggaactagcgaagttcactgatagcttcaaacgtttaattggacatggagggtttggaaatgtctattacagctgtttagaagacagtactgaggttgctgtcaagatgcgaaccgaatcatcgtcccacgggcttgatgagttcttagctgaggtgccaaatatagttagtattatgtttaaccacaaataaaatcaatatttacagtttttcagtaaaaaatattcaatatttagaatggcatatatgtgcatgtaaacttagggtgagtttgagagacaggggattgagaagattgggaagatacgtaaaacgagatgagccattagcgcatgattaattgagtataaactattttaaatttcaaaaatagattaatatgattttttaaagcaactttcctatagaaaatttttgcaaaaaacacatcgtttagtagtttgggaagcgtgcgcgcggaaaacgaggtgttttctcaccctatctcacacaaacgaacacagccttagtcacatccactgtgaggtttcgtacccatcaagagatttgaccatttgttttatcacattacataggttcagagcttgaccaaggtgaatcacaggaatcttgtttctttgattggttactgctgggagaaggatcatttagcgcttgtctacgagtacatgtctagtggcaatcttagtgattatctgagaggtttgtccattgcaatctttaagtattgaatatttgggaaatctgcactacgccggaccaggttatctctgagggcccaaaccctcacctttgacgggtttggtcttggtcactgattagtggtcactgatgacaaaatcacctgtgacgggtgaacccatctctgaccggtatataagtcatctctgacgggttaaaacttgtcacccgtcacagatgagtcatcagtgacgtgtcgtaactaccggcactgatgactcatctctgacgggttgtaacttacgacccgtcactgatgacaaagcaagaaatataatttttgaattttaaacgcaacaataaaaacctcaaaaaaatattttgaattttaatagccatcctatacatcactacctacaaattcacaatttttcacacaatataacttgcatgctacacgtgagattcgaactcaagacctcaacctccatatagagctcccttaccaatacacctactcagcacatattgactactcacccaatgttgttattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtattttgaacatgtaaactttgtgaaatgaaaatattttcaattataatgttgtagatctgattgagttctatgactttgatacggggcatgtatccatccatgtcatttgaaaaaaactcaaaattttgtttttaaaagtagatctgatcaacttgtaatgcatgttcggggatgtaaacgatctctaatagaaatgttgttagttataaagttgtggatatcattgagagctacaacttttatgtaagacatgtctcaatctgaggttttttgcaaaattttaaaatttgaattttcactcatcactgacgggtcataactaccacctgtcagagataacgttatctgtgacgtgtgttagttaaagacccgtcagagttgagtggtctcttttgtgatggttcataatactacacccgtcacagatgacatgtcatctgtgatgagccatggttgtgaccgtcacagacgatctgtgacgggttacaagtgcaagccgtcacagatgacctcacatctgtgacgggtcctccctggtagccatatattgaagaggatattttttcggcccgtcagagatgactcatctttgacgagttgcgttggcctgtcacagatgacccgtcactgaagtccggatctgtagtagtgctgagggaggatattggacatatacattacgcagacaaactagttggctatagtcatctttccttctttacaacttaaatactccgcgtgtgcccgcagacaaactagttgactcatgttgcacaacagtttgcagaactatgacaagtagtactgcttacctggagagagcatagttagactttttgaggaaaaaaaagactggagagagcatagtttttttttttttttttttttttcggggatggagagagcatagttagtctctacctaaggggcttcatggccatcgcttaaactcactaaagatatcataatatatttagagcaatttttggatactaaaatgtgccctaccaatcaattggttttttgaatagtagatgtgagtagttcgcattaaagctaaactattagcaatgcctaaattaatatggtaactctacatgtaccaatcaaatttgactctaaattggttctaaccaaagatgatccatgcaactctaccctaaaaaaaaaattagtagtacccaaactttccatggttctaatagtgccaattatttagtacgatagaaaacaaaaaactacccttaattctgccctcacgtatggaatatgttaatcttgcagtaccatttttttgtcataattgttcatcatctcattatcaagacatctcattaagacaacacaataataaattgcgtggatgtttaaaattgtatacaaaataattgtttttgcattattgatggtctatctcgactgattgtgcagacatagtaatatcaagacatggttgtatctatctaataaatcattacattgattctatccttttgttaaaggaataatactgttttgacttgtcaaataacaccccccccctcttcccctccctcccccaccttctaattgcgtataagtaatgtatgaaggcaaaactagcatgggtggaaccatgaattgggcaacacgcataagagttgtgcttgaagctgcacaaggtatgctacagtaagaaggcaatgacaaatacacagagaaagaatctattatatgccactgaatttatcctactttaacaatttgtcatcaactttatctccctctataatatggcactgactttacactactacaataagcattttcccgtgcggatgaattcaatttttgcgtgcgcaggtttcgactgtctggaaggtatcgtctgcaaaaatcgtgattttttcgtgcgggcgacgcacccgcacgcgaaagtcgcgtgcggcgcttaagccgcccgcacgggaaaatgaaaaatcgaaacaaaaaaaaaagaaaaaacaaaccctaaccctaatccagtcgccaccgccgccggcaccgccaccctagccgaggcctgccgccgtcgcccccgcggtcgccggcgacggatccgccgccggctaccgtcgctgatgccggatccgccgcccgtgcactcccgcggctgccggggaggggatgggaggggagagggaggggaggagccgcggccgcccatcgtcgccgccgcctgcgcccgccgccgcctcctcacgtccgctcgccgcgagcccgctgccacgagctcgttgccgcacgcacgccgctcctgcccgcctctcccgccagccgccgtcgagcccgctgtgtggagaaggaggcgtcggccatatggtgagaagaaggtgagagagagaggaaaatgagaggaggagaaggaaggtgagaagataaaagagagagagaggagagaagggggcctggggggagagagagaaggaagttaattttcttttaatatgatgggagagaagtctattttcctgtgcgggtggattaggaggcccgcacgtgaaaatagggttattttcgcgtgcggacctgttaagtgacccgcacacgaaaattaatttttgtgtgcgggcgatgacccagcttcgctcccctcatttttccgtgcggtctaacttacggactgcatagaaacaaaatggggtggtgtccagaaaaatcaatcctgtagtagtgttacagtatgctattgtggtggatacttttctgaaatgcctagaatgcccttcgagttatccaagagttgacaattgtttaacccactagaagttttgaaaaaatatgaaagtttttgtgtacttagccttcttacaaaatatagaagtttgtgtgtatatttcaaatttttctttcaagttttttaaataataatttcatatagtgtttgaaagaggaatcatatacacaaaagatagccacatcacaataaaaaaggaacaacatgtgaatgatgatatatgttgtcgaatggacaactacgtcacgccgaaaggcgtggttttctcaacagtggttggaaataaagacaattgtattgctttgtaaaaatttttggatccccccattacaaggcctaagggggctatttatagctctattacaggttccttcctttagggtttagattttacaggggaatttatatggctacccagtgtcctttacatgtattgggcccttattgggcttagatggcttggcccattcgttcgtcgaatcctcctcgagagtgtaacggcccgttgggcctcctcgcggtagggttcggcgctcggcgaagcccgtgtctccgtgctaaggctttcgcctcaccatcttcgcccgcggaacccttcgacaaggtctttgcctggcgaagcccacgttaacccaagccacagccttcgccaatacggtttcctcttcggccttggccctttgctttcggactgagccttatcgcccgagcgggtggtttcgacaggtctggccgaaggccctttgtggtatacctccaacaagcccctcacgggaaagggtgagtaggaagcttcggccgagaccgtgcaagtcatgtggtataccgcgaggcgctcctttcggccgatgttcatgctgaaacctatgctacgcacctgcgatagtaaaaagtttgctcttgtgttaacgaaaaatttgaaggaaatttccttactatgttcgcaaatgggtggcgaaggggttagattgcccgtcatgctgttattgaacagtgatgggctccatgggctttgctgtttctgctttcggcttttcactgtttggcctcggcccgatgggaatttatcgtttcgtctaccaccggacacgtgtcgggctctgattggttggtagacgaaacgtcgcgtgacggggttatataaccctgccgctggttaccgcttctccccctccactttccatttttaccgctgccccatctctgcgctctctgccttttgctttcgcacttgctccttggacattctcactccctttcgcttttcgacccctcctttcgacacggacttaatggctccttgcaaacccaccaaagccgggtcaactggcaaagaccccgggggcctcggcgaaggttggtcgtgttaccttggcaagtcacttgtcaaggaatccgacctggctgagttcgtccactccggcgcccttgcaaggggccaggcaacgtgcgggggcgaggccgttgtcccttcgcctggtgataggcgaacgattgttttcgccgccttcctcaccgcagggcttcgccttccatgcgacaattttcttccgcccgtgctggagatgtacgagctcaagctaccccagctcagtccctcggcgttccctaagctggccgtcttcacatggatgtgccgaacatgcgggttcgctcctaccgccgagctgttcgccatcttgttcacggcatgcgctatgaccaaagacgtaaacataccggccagttcaaggaaaacggtcttcagctgtgtcaactttatgcttcggccggagcgttcggatgcatggccggtgcctgcgttgatggtgaaatgggaccgcagctgaatgcagaagtggttctacgttgccaacccgtaccctactgaggacgacaaggcgaactggcttcgctttcgacggctacttgtttccatcgtcgctaagccaagtgtggaggtcgaccgcacactcgagtccaggctcatcctccttcgcaaggttgcacggaggctaagtgcccgcgacctttgtgaggagttctgccttcttcgaatctctctccttgctcatgaatgagtggtgtgttaacaaccaaatttggtaattttagtatcggagatgaggatgaaaccgaagcagaatccaagagatagatcgtgctgaaagcagagcaagaatcggctaaagtccgaattggctacgattgaatcaacagagttcgagtcagacaaggttagccgattgagccgattctgacaatatgactcggtgtacatcatcgggttaagtttaagtgcttcatatggattgccatacatggctagtgtcctgaaaaggcaattgtacttattaattagggtattttatgtaatttccttagagataagcttgggcaaaagtctgccgcaaagacttacggtatcttagagtttgttagagataagagtcgtgtccgacatggacatattttgtaatctcgggtataaatagaccctgagccctatgtaaaaaactaacacacgttcaaatacaatctctgcgcatcgccacccttttactttcgttttgtttcgacgagttcttgctttcgagttgagctacatcgatttcgatcttcaattagaggtaaaacttgttatggcggcttgcgttctcgggattagtgcttccatctttatgatgctctaatcttgtttatgtaatttgtcaagttatcatatattctatataatcttcagcaatattgttatcgaacattcaatcggctaacatctattgctagaaggcagccaattaggttagattccgatgttgatctagattatataggatatccaccaccttatgaaacattcaacagcttgattgtctagatattattcttcttttcatacttatagctgtatcagttgagtttgatcttataagtagtgattagaatcatagtctctagcctgcttttggttgccgattaaggtagtatcggggtttcagccgatcttacctgatttagccttatatttcatgtgcttaattggtatgctagatctgccctttatattgagatctttgttgcttttaggtatattaagcttcttgtttgatatatttagcttgctttaatatattaatatagagtagtatcagagtattagccggtacttgctagatctatctgatcgtctatgctataaacatttataatctccttgctagtatatatttcgatctaagtgatttatactgtctcggcatggcgaccgatctatcccaatcacttgatttaagtatatatcgacataaggattgtatactgttaatatctacagccgatcgagtagatttagttttttattatttactaacatatgccgatcgatgcaaagatgacatcggctcaaagataaattatatgtcatcggcaactagccgatcggctatcgtttatggatttaagctcggtttctttgtctttatttcttgttgtttgcaagatcaaattaactggcacgctcatagttccaaaggcaagatttcttggacctgcactggagttaagcagatctcccaggccttgtgtttttcacatcaacacgcttttggcacgcccggtgggacaagggtttttgacaacttcttcccgatggctgagaaaccaccaccgtcaccggggacaggagtcaagcctcccgtgggtaaaacgggaagcgaacaaccgtcaactgaagtggatcccagcaacattgttccgatcacattggataagctgacgaccgagcaaaggggcgagctcgaacagatgatcagcaatgtcaaggatcagttcatgaattcttttcgggagactcgcaaagggaccatcgttcagagatacaagctgaaggtagttacagctgatgaggttggctcaagctcgtctcagggcgataaaggtgctgcagctggctcgggtgataaaggtgatggtcttcaggaggggatggtcgaagatcttggaccagatggcaatggactagaactgcagtttgacaatttctaggatcaggtcaattatgccgtgcaacatgctttgatcaaccaatctggagtgctggttaatactctaacaaacatggtgaaatctgtggtcgatggttcaatagctgagcatcaagctacaggaccagtgtatttgccaggtggtgttttccaaattacaggcctttggttacaggcaatcagcaaaatcctgctagtgcaccactaactcagccgatggcatcggttacggctcccgcttcagctgcacaagttgcaccatcatcggcatcaagacaaatgactaatcctaggctactgaccagggaacagccataggatgccggtcaaaacatcaatcggctgactcaggagcaggtggctaccatgttcttgccaaatccaccagctgccgatccagcactgccgattcagcaaacgccatcaagacagcaggctacccagccgattcagcaacaaaacttgctaaatgcatcggctaggatgaggacgcctgataatcagctaaggcagcatgttacaactcaagttgtcccggagcacctggttcataatgtgcaaccagatcagacaatgatacctcaagttatacctgaacacttggtgcgtaatatacatccgaatattcagaactataatgggggatacttgaattatcaatatcagcctccttcacctcatgttcatcaagggggatcacctcagcctcagtttgctcctcagttcaatcaattcgagcttgtgtcgcaacaagcacaaggggcacctcagcatagacagtgggccgatatgatcgcagatgtaatgagagagaaatttgggctcaagccgaaggatactgggaacttgtatcggcatccataccctgagtggtttgaaagaattccattgcctgcccgatacaaggtaccagacttctcaaaattttcagggcaagataatgtttctacttatgagcatattagccgattcttagctcagtgtggtgaagtatcggctattgatgccttgagagttaggctatttcctttgtccttgtccggatcggcttttacttggttctcttctctaccatacaattctatcaatggttgggccgatttggagaaacagtttcacagctattgttacagtggagtccatgagatgaaactgtctgatttgacagccattcggcaaaggcatgatgaatctgtgcaggattatatccagaggtttagagaaacaaggaatagatgctacagcttggctttaacagattctcagttagccgatttggcttttcaaggtttgatagctccgattaaggagaaattttcatctcaggagtttgagagcttatctcaccttgcacaaaaagtgactctgcatgagcaaagatttgcagaggctaaaaacaactttaaaaagatcaatcatgtatatccatgcatgtataattcggatgatgaagatgatgattccgaagtagcagcagccgaatgggttagaagcaagaaggttgtgccatgcccatgggagaggagttctggaaaagaagagaagtttgattttgatatcaccaaggctgacaagatttttgatttattacttcgggagaaacagattcagcttcctgctggtcatgtcataccatcggctgaagtgctaggaaaaaggaggtattgcaagtggcataattctggctctcattctactaatgattgcaaagtcttcaggcagcagatccaggtggccattgaaggaggaaaaatcaaatttgatgattccaagaagccgatgaaagttgatggtaatccttttccagttaatatggtgcatacatctgggagggcagccgatggaggaaggaatagaaattttcagatgaattcggctagaattatcaacaaataccagaagaagtatgacaagcagcagcaggagaggtattatgaagaagatggtggttttgatcctcattgggggggctgtgagtttttcagattttgctggaacgagggtatgagactaccatctattgaagattgtcctggatgcagtaatgttgcagaaagttcaatgtcacgcccggaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaataacgatctagcgatggcttcagctccactcccacaggcagctcaactggggtataagccaaacgtcttctccttctggaacctttatcttcaactgaggtttgatgattattgcaagaatgagcatacttaacaagccacacagcaaatatgcaagtgcacaaggattccaaaggatggcataatataggctcatttgcaaaagcagcatttagcaaagatttaagataagtaaaacagtggagtaattaatcataaattttaatcaacactgaacaacacacccatgttgcacaggcccaaccattctgaacaaccatacccggctgtacagatctaactccaaaccaggagctaaacaaattattaccagattataacatccataattattgtgagaggtgtgagactaatcacgaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcaccccctcaaaaaccagaggcatggactccccagcgacccccacggacttctcgccgcttctcagtctggcaccccgcaatgaatcatgctatacaaaaggtaaagccgttgcccacgctggcttgtggttggca

SEQ ID NO: 68363 - DNA, 4571 bp, Oryza sativa
aatcaaattataacccataggaaaataaagtcatcttcggccattaattaattgggaaaggttcaccacccggtgacattcgaaaacaatgcatagttgaaataaaataataactttaaacgggttcaacatgctcaaagggttgtttgggatctgtgtgacttgccttgggcttccgcaaacacttccgaaccttcctcaacgaaaacgctctccttcggaacgtcggaaactaaagcgaaagaacaaaattcaacaaaacagtacaaaaacaagcataaacagtacatgtggatatttttaacatgtagatcttgattttagaaaaatttagcaacttgaaccacctgaaacggatctacgattatttagttatgattttccgaagatttaatctattagaaaatcgggaaaaagaaaagccgatgatgacgtcatgatgacatcatcaatggccggaccaagatggcgacctcgccggagattggatgattggctgcgaatttggaggatatgtacacgtagaggacgacgagacgaacccaacggtacttaccctcgagccaaacgacgaccgacggtgaccggcgacgaggtgaacggcggcggcggctcggacctcgccggcggtggagctccggtggccggcgacgaagggggacaggaggccgggcttcccctcgccttggcgcaccccacggtggtgacggcgaccggcggcgacgacggaagcggcggcgcgacggcgccgaagatggccggcaacgacggcaagcaagacggcggcggcgacgaggctacggagcactagagagctcgggaaagagggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttggggaaaaggatagaggaggataagaggaatatttcccctcaactaattttgcaaacggagctcgggatgtggcggatttaacggaggaagcggtggctgcacagggcacagcacgggcggctcggctctgtccaagcttgaagatgaacagtgccagggaggaaagtagacttcttgccgggcttttctacttccaaggactgattaaaggagggacgcaaagcagacttcgggaaagagaggaaaagggctgcaggctgagaggagactgggccgagagtgagaggacttttcctaattcggcccgaaaaggaaaaggtgaattttaattacttttccaattaaattaatcactgaaatgatctttgaattgttaaaaatacttccaatgctcaaataattccaagaaaaatcttgaacatacttggacactcaaagtacttaacaaaattataattagaccatttaatgattaatttaatatgtgggtaattactgaaatgctctttgtatgattaaaaattaggaattgagctccgaaaaatctgagaggatttcagagagaataattaaccatggagaatttaataaaaattaaatccatccatgctttatatttaggaaattttatttccctcatttaacttcactagtaaattaatgaacatttaatataaattctgataataatttattaaataatttataaatcctgaaacgaaaatcagggtgtgacattcaagccgatcttacaatagaggtaatcggctgagacaaacaagagtttttgttcattaaagattaggcccagtaaaccaggggtatgatcaaggagatgatgaggatagaaaggcttaatagtgtccttctggtattttcacaaagaatcagaagaggagggttcaaaggttgaggaacagagaacgttttcgagaggtagagcaggagatcagtcatcggctgaggaagacaaagccagggcaagagtggcgtgttaagaaccaagctgccacagccgatgaggttgaagcggatgaggcaaagaggttggctaaagggaagagtgtcgtaattgcatcggtgaacatggtttttacactacctgccgaatttagggccaatcaagccgatgttgatgaagttgaggaaacctctgcaaaattggttttttcaccagagcaagcagtttttgagaagccagaggggacagagaatcggcatctcaaaccattgtacattaacggttatgtcaatgggaagccggtgtctaagatgatggttgatggtggggctgctgtgaatttgatgccatatgctacattcaggaagttgggcagaaattctgaggatctcattaagataaacatggttctcaaagattttgggggcaatccatcggaaacaaaaggagttttgaatgtggagttgacagtcggtagcaaaaccgtccctacaacattttttgtcatcgatgggaagggttcctatagtttgttgcttggaatggattggattcatgctaattgttgtactccttcgaccatgcatcaatgtttgattcaatgggaaggcgaccagattgaaattgtgccagccgacaggtcagttaacgttgctagtgcagatttagctatttgggagatgggtggaattgattgcctgtctggaaaagtttgggatggaggttttctaaaagtgtccgattgtgatatacagccaattgaagatggagagcccaagttattattttgagggagtcgtggagggttcaaacgtctacaacaaggacacggcagatgatctcgatgacaagcaaggacagggtttcatgtcggctgatgatttagaagaagttgatataggtccaggtgatacaccaaggccgacttttattaagaaaaacttatctccagagttcagaaccaagttgatagagcttttgaaagaatatagagattgctttgcttgggagtattatgagatgccaggactcagccgatcgattgttgaacatcggctacctatcaaaccgggggtcagaccataccagcaaccgccaaggaggtacaaagccgatatgcttgaagctgtcaaggctgaggtcaagcgtctatatgatgctggttttattcgtccatgccgatatgctgagtgggtttccaatatagttccatttatcaagaaaaatggtaaaattagggtgtgcattgattttcgagatctcaataaagccactccgaaggatgaatacccaatgccgattgcagatcaattggtcgatgctgcttccgggcataagatattgagttttatggatggtaatgttggttacaatcagatctttatggcagaagaagatattcataaaacaacttttagatgtcctggtgcaatcggcttgtttgaatgggttgtgatgacttttggtttgaaaagtgctggagctacatatcaaagggctatgaattacctaatcggctggttggttgaagtttatattgatgacgtggttgtcaagtctaaggaaatagagaaccacatagccgatttgaggaaggtttttgaaagggctcggaaatatggcttaaagatgaacccaacgaagtgtgcctttggcgtatcggctggtcagtttttgggattcttagttcatgaaagggggattgaaataactcaatggagtattaatgcaatcaagaaaattcaacctccagagaataagaagaagttgcaagagttgatcggcaaggtaaattttgtcagaaggtttatctctaatttgtctggccgattagaactgtttacacctttgttaaggttaaaggctgataaagaattcacctggggggcagagcaacagaaagctttggataatattaaggaatatcttagttccccaccagtgttgattcctctacagaaggggattcctttcaaattgtatctatcggctggagaaaaatcaatcggctcggtgctgatccaggagcttgatgggaaagagagggttgtattttatttaagccgaaggcttttagatgcagaaacaaggtattctcctgtggaaaatttgtgcttgtgtttgtatttctcttgcactaagttaaggcattatctattatccaatgaatgcactgtgatatgcaaagccgatgtgatcaaatacatgttatcggctccaatcttgaaaggcagggttggcaagtggatatttgctttaacagagtttgatcttcggtatgagtcaccgaaagcggttaagggacaagctatagccgattttattgtggatcatcgtgatgactcaatcggctcagttgaaattgtgccttggacattgttctttgatgggtcagtttgtactcatggttgtggtatcggcttggttataatttcctctcggggggcaagttttgagtttgcctatactattaagccttatgcaactaacaatcaagacaagtatgaagcggttctcaaggggttgcaattgcttaaagaggttgaagccgatgctattgagattatgggtgattccttgtttgtaatcagtcaattagcaggagaatatgagtg

SEQ ID NO: 68364 - DNA, 25708 bp, Oryza sativa
  unsure (1)..(25708): unsure at all n locations
tgtctcgagagcaaaatgtagaagctaatgatttggcccaaggagtatcagggtacaagctgatcttacctgatttagccttatatttcatgtgcttaattggtatgcttgatctgccttttatattgagatcttgttgcttttaggtatattaagcttcttgtttgatatatttagcttgctttaatatcttaatatagagtagtatcagagtattagcctgtacttgctagatctatctgatcggctatgctataaacatttataatctccttgttagtatatatttcgatctaagtgatttatactgtttcggcatggcgaccgatatgtcccaatcacttgatttaagtatatatcgacataagtattgtatactgttaatatctatagccgaccgagtagatttagttctttattatttattaacatatgccgatcgatgcaaagatgacatcggctcaaagataaatgatatgtcatcggcaactagccaatcggctatcgtttatggatttaacctcggtttctttgtcttcatttcttgttgattacaggatcaaatcaactggcacgctcatagttccaaaggcaagatttcttggacatgcactggagttaagcagatctcccaggcctcgtggttttcacatcaacagggtgtccgtggatgagggcgaagaggtgattgggcttccacgcctcgttcttccttccgacacccagcgtgagtttttcttttgattttcgacatgcttttcgacgtcatcttcattttcttttatgaagatatgtttcgactcactccgcttttccttgttcccttcttacgcagttcgcacattggaagatatggaagcggaagcggcaaagatggtcggagctctgaccaccaccgaattcggctgcttgcttcagcgccaagccgatgggagggcgaaccgcgtctatgtcggcgacctggctgttcggtcgattatttcgaacgccaccgatgacgacgctgggacatcgaaaaaaagcaagcgggccgttgcgaagggtgtgcgagcacaagctcatcgcgccagcaaggacacggtcgacagcgacgcggataacgaggacgaagaggccgggtcagacgaggatggcggatcgcgcggctacacccccagtcccgtccaggcgaaggttggagcgggtgctcatgtttcgcccgtgcgtccgcgagacgtcgctggtgcgaatgggctcctggcgatctccagttctgcggcgaagccaggggcgccagctaggaagaagaagggggtggtgcaaatcgccgccggcttttctaacagcgaggcgtcttccgacgggacgcctacttcgcccgtgctgcggcgcgctggtcctcggaggcgccggtcaccaccgcccgctagcgacgccgaagcgccaacaggtggcaatgtttcggcccctgctgccggctccggttggggtgatcgaatcggcggcggcgaatgccccaggtaccgggagtgttgctgcagctccttcgacgagccatcggcgggacggaaaggggccggctgtcgaaatgactgtgtctgacatgacactttccgccccgcattttgtttccgccgatttcacctctcggaccaaaattacccccttcgtggatggggtgtgccaaattgtggccccatccgacggtttgagtcttttcaccgagctcaacgagttcggcaaaaactacgcagttacagagagcctttttgagcgggtatggactattattattgtgttccctttcgcttgcgcaatgcttttatccttttttgcctttgttataataaatggcttcggcttctcttactcagggtcttgcggcgcatctaagcgcgaaacggtccgcctcggagcgactagacgggtaccgactccgtcttcggaaagctgaggaggaccttcaccacaaagaggacgaacgccgggtcgtggcggacgccctgaagaaggcgaacgcggagaacaaatccctcacgggggaaaacaagtctcttcgcgtcgacctggaaagggcgaacgggagggccgccgaacaggagcgtcaacttgccgcggccgaggagaagattaggtccctcgagacccggcttattgcggccgaagctgctactgaggctttggcgccggcgacggagtctgccaagcaagcctgctacacccttcggctggctctcaatgacatcggcgcgcgtgcggaaggcgctccgggtgaagatgggacggtgttcaacttctccgagtggacgcaggatgcggccggctcggttgtcgaagtggctagcgcctatggagattgctgcgcgcgcgtttctgcgggttttgtgctcagcttgcttcacgagcatggttgcggccatgttgaaaatttttccgagctcgtgaaaggggactggcctgaaaactcccagccttccggagcggctttgatggccttccgaaagggcttttgggaggatggcggtaaagtctgcgcgaagacacgtctgcgcgagaaactcgagaagatggtgaaagccgaagacgccgctgccgccaacgctggggaagaccctgggccgtcggagcctgctgttgagcgtgagggcgaaggagacgaaggccaagaccaccctgaggtgtgagaccgttcgctctcgtgttccttttgccttttaggctttttgtagtttttgtttatgtatatagttttgcatgtttggctaatggccgctatcgccttgtagccgttatggctgtcctttattaatgaaaagtttgtatttcgccaatcgtgcgtttttattggaatgtgggattgatttcgttagcatttctcccttttgcactgttcctttgtgccttgctggcagggttgtagccggaaaatgtgagttcggcctcccttcatggattggcgaaataagaacgagaagttcatggcggagaagggcatacccaagactaaatgtcctttttggcccgtttatcgcgaaatgttaaaaaacggcaacagctacaaggttataaaggttgcaggatggatgcgagcacatccgagccgaaccctagaggattatgaccgctatcatgtggtgcgtcgcgaagatagcacaattttttggcgaaactttaagaggtcgattcgctaagaggcgatcgctcgtcgccgttatagtttggtttgtgcttggcccccatcccctttaagggttgtgtataatgttagtagtgacgacgaaactggttcgccgggttgtaatatagatgagggcgaaagtgtaaacgatgatgtaatctttttgtgaggttctcacgtgaatacaacatgttttttattttgtttagtttatgctttgtaaattttggaacacatcttcatgctatcattcgcatagtcactgtcgtgctttcgttaggtcaaaacatgtcggcccctctgcgtactatagcgaaaagatatgtttatttctcagctctcttctttcgttttcggctcgtggcaggcgtgctgtcgagcatcgtggcctgtgtgtaagctgaatgcaacggtgttttgacttttattttcaaaatcgagctgtcgcggtttcaacgttcggtgagctatgcttcgaccgattcgtttcgcccccctggcgttttcgctgatcaagcgtttgccttggggtttttccacgagaacattattcacaaaaggggaggatgaaaaagatagaaagattttatattggttcgggcctccaaggtggataataaccctacgtccagtttttcttttttgcttttttcattttcctctttttttgtgctgaacggcttacatagtatgtacaactgtacaattggcaatcgggtgccacccgttttacacataaaattgtctaagggaagcagcgtttcaggagtggtcgaactcttcttcctccaaagttgccagccgaaaagaacctgttagagatttgtgcttgattaggtatggtccttcccacttagagtccagtttccccactgccacggggttcgccttttttcttagcacgagatggccgggccaaagttccgtcggtcgaacctttttgttgtaggttgccgaagtaccttccgcgtacttgctcatgtgttgtagagcttcgactcgtaccccttgcaagagttcgagcaacacttcgcgcccattttcgcccccggagaacatcacccttggtgagttagaccctagttctgccggcgtcatcgccacttctccgtagagaagcatgaaagggctgaactttgttggccttgtaggggtcatccgaagggcctagagaacggatagcatttcgtctggctatttacccttcgccgccccctcaagtctcttctttagaacctcgaggatttttccatttgcccattcggccgccccgttcgactgcgggtgtgcgaccgaagcgaatctgatttgcaggtttagcccctcgcacatttctcggaatttctcggaatcgaattgtttaccattgtcagtgatgaactcttttggtaccccgaatcggcaaacaatgttcttccagacaaacttttgaaccgcagctgtggttattgtgcctagtggttcggcttcaaccgagcgagagaagtactcgatggctactatggcgaacttgtagccgtttcgcgccactgggaatgggccgatgatgtctaagccccaccttgcgaatggccagattggcgcgattggctgtagttcgtattgtggtgccgtttggcttcagccatgtctctggcagctttcgcactttttgacatgttcaacgcatactttaagtatggttggccaatatatgccttggcgaaatacttttgacgcgacggtccttgctgccaggtgtgctccgcacatcccttggtatatttcctttaccatctcctcacctttggagaaagatacacagcgaagcatgggctgtagtattccagttcggtacaattgcccagagattatcttgtacttcgcggttctgatctgcagctgttttgcctttggttcgtcatctggcagccatccctctttgaggtgcttgacgaagggcgttcgccagtcatctgggtcttcgcccagttcgcnctggtcgattgccataatgtgttggctttctgttggcacacttggtgaatacaggacttcaaagaagacccctagcgaatgcggccccccacaggcggctaattttgccaatgcgtcagcctcttcgttttgacctcggggcaagtgttcgaccgttatgctggcgaaagttttttccatagatcgaacggcttcgaggtattttctcattccttcctcctttgcttcaaaggatttatcgacttggctagcgacaagttttgagtctgttcggattagaagcctccgaacgcctaacgactttgcttttctcagccccgtcaacactgcttcatattcagccgtgttgttggttgtgtcgaactgcagtctagctgcgtagcaaattaatacgtcccctggcgaagtcaggattgcggcgatccccgcccccttgtgagaccacgagccgtctaagtgcatgacccatggctgttcgacgggcatccgtgctctgggacggatgcgggtgtccattcagccatgaagtcggcgaggagttgggacttgattgcagtgcgagcgacaaagtgtaggtcgaagggtgatagctcagcagcccacttgcttcgacgccccgtgatttcttttcctcaaagcacttcgcccaaaggatactgcgaaggtaccacgattttgtcggcttggtaatagtgcttgagctttcttgaagccatcatttgggcgtaagcgagtttttccatttcgatgtatctgaccttcgcccctggagcgcttcggagacaaaataaactggcttttggccaacttcagtttcttgtaccaaagctgcgctgacagcaacgggcgaagccgctagatagagccagagttcgcttcctgccactaagctaactagagttggagggctttggagatactgcttaaactcgtcgaaagctttttggcattcgggtgtccaacagaactttcctaccccgcgaagggtcttgaaaaaaggcaagcctctttcggctgcttttgacaggaattgactaagtgccgcaattcgccccgtgagctttcgtacttgtcgtacgctcgatggtggcttcatttgctgaatggcatcgatttttttggggttcgcttcgatcccccgttcggatacaagaaatcccaacaacttaccaacacgaacgccgaatacacacttatctaggttcagtttcatgccgattgcgtggagattgtcgaaagtctcttgcaaatctgatgagtggtcgaaggccttgcggctttttacgacgatgtcatcaacataagcttcaacatttcgccccaattgggaccccaggactttgtacactagcctgacaaacgtagcccctgcatttctaagaccgaaagacattctgaagtggcagaaggtgccgaagggcgtgatgaaggctgtcttcgggatgtcagccggattcatgtgaatttggtgatatcctgagtatgcatccaagaagctcatgagttcgcacccggcggtcgaatcgactagctgatcgatccggggcaacgggaagtcatccttcggacacatcttgttgaggtccgtgaagtcgacacacattcgccacttgccatttgacttcctcaccagtactgggtttgctaaccactctgggtggtcgatctctcgtatcactcccgcttttagcagcttgttcacttctgctttcaccgcctcccggcgatcggccgacattttcctcaacttttgcttcttcggccttgcttcaggcttgactgcgagatggtgcattatgaggtctggcgagacaccccctacttcgtctggcccccaagcgaagatgtcgatgttcttcttaagcacaaccatggtgttgtcaatttcttgttcgctcaggtctccaccaagcgatatgaccttggtggggtcggaatcatctatttgtcgctagatgaccttgccgtgggggtgggcttcggaactggttttgttttctcttgtccttcaacctctacggtgtggacttccctaccgaaaggggccactgtagcggtcgaaggctgggaacccttgacaactattacgccggtcgagcgtggcatcttgagcttgaggtagttgtgatgagagactgcttcgaacttggtcatagtgcccctgccgaagatggcgttgtagttgtatgggatgtcaacaatgtcgaagagtatctcctcttctcttctattctcttgcaagccaaaggcgactttgacgagggtttgtcccagaacttgcactgtttcacctccaaatcctctgagcgaagttggtgcttgggatagcgccaatgtcggcagacccatcttggcgtatgtcccggcgaacatgacatcagccgaacttcctccgtcgatcaggatgcgccggacttcaaaaccagccatttctgcagaaacaaccagcgggtcctgatgcgggaaaagaactccttcggcatcttctggcccgaaggatattggctgtgacaagtatcttggtgccccatcttcggccgaaacgatgttgtgcactgttcgaagttgcatcttcttttgccatttagacacttgtgaggggggatcagatcttgtaatgacttgaatcactcttcgccgcacgtcttggcgttgttctacttgaggtgcttggttagggatcgcttcgcgcggcgcctcttcgacccttccttgttgctgccttggcgcttgagcgttacattgctgtcggatgtttcgacattactcggttgtgtgcgaagagtgtccatgaaaggcgtagtacaagaccttcttgactttcttgtggaagggctgctgctgtccacccgcctgctgggagtcgaactcctttcggagggcctgcacttcctcgaccgccattaccgccttgccagctcgttcggtcctaaatttcctccaggttatcggggcttggttcgaccttgggtgttgtccttgattcgccgggagggttggttgaaccaggacaggcgccgaacttgcaacttgaggcggaacctgagcttgggcgttggcttgcgaagtggctgctgcagctgcggcggccttgtcatattcggcttgtatctcttgccttcgcttggtgtcttcttcgcctcgagcgtatccgtcgattatgcgaaagaggtgtttgagagttttgggttccttgcgtgcgagctttcttgtgagttcaccctcgagcaagccggccgaagttgcgttgacgacagatgcttcggttatatcctgcacttggcaccgtgcttgcgagaatcggcgcatgtattcccttgtcgattcccccggcctttggcaaatgcccaaaaggtcttggtgagttttcggctcctcataagtacctcgaaagttaaggacgaaaacgctgcgcaattgctccaatgagtaaagctattaacaggcagattgaagtaccaagatcgggctatgccatcgagtgcgaggcgaattacctttgccttagtgttctcatcgccgtgagccgcctcaattgcggactcgtagatggacaggaactctttcagatccgtttcacccgaataccttgggactggagggaacttgaactggggtgggatggggtgacttttgattccccagctgaggggcaaacccttttcgccacctggcttggttgtagccccttgttgggaaggccagttcagttgtgggtacggaggcgtgaatagcgaagctacagcttgcacttgaggttgagccgtagattgatgtcccatgccgaacatcactgcctgattctgctggtctgtcgaagtagcttgcctcgccgtagcagggtcaaacatagcttgattccaggcttggctttgcggtggggctgttccgtacccatggggtacggccaatgcgaaagtcatgggtgcctgggccgctgtgcttgggtcgaactatggcggtgggccttgagcttgacttagcaaagcgaactggctggacagctgtcccgtcgaagcaccttgacttgggcctccctcggccgtggccggagatgaatttcttggtatattgttgtggggttgattgagttgttgcaagaaggcttgaaactgcgcttgcaaggtcgaagctgcttccatcatagcttgcggcgtcacgccgaaaagcgtggtagcaggcttcgggtattgggcttgaggtgccgccgggcgaaccggtgccgggatcatttgaggcgttggacgcgcggcaatggccggggcgggcttggcgaagtacaccgacgcctgcatagcgtatggagaaagaacttggggctgagcgtagaactgttgggtgtgagccttggcttgtcttgctgcttcgtacgcttgttgctgctcttgcatctggcgaagcgtgtcttggagttttgtcatattctgacgcatggcctccatgtcagcttcggcttgtgcttcaaggttggtgttggcttgcgaggtggtgatcgctgttgatgtcgaagctggttgtgcgaaaacggcggtcgaagggccccccgctacttgggatgaaaagattacgtcggccttcgccgctgcttccgctttcaccgcttccgcctcaatcgaagatgtgggcgccgaagacgggagagttggtgccaccggagttggtaccgttccggcttcgcccgtggaggccgaaggctctgctccctcttcggctaacatctcgtcttcgacgtcaccttcctttcgcctgacaactctctccttgacggttttcttcggtggcatcagtggtttcgctcggaggtccccacggtcggcgccagctgttgtcgaatggacaactgcgtcacgccgaaaggcgtgattctctcaacagtggttggaaataaagacaattgtattgctttgtaaaattttttggatccccccattacaaggcctaagggggctatttatagccctattacaggttccttcctttagggtttaggttttacaaggcaatttacatggctacccttatgataggaacattattgggggtacacagtgtcctttacatgtatgggcccttattgggcttagatggcttggcccattcatccggcaaatcctcctcgagagtgtaacggcccgctaggcctcctcgcggtggggttcggcgctcggcgaagcccgtgtctccgtgctaaggctttcgcctcaccatcttcgcccgcggagcccttcgacaaggtctttgcctggcgaagcccgcgttaacccgagccacagccttcgcccgtacggtttcctcttcggccttggccctttgctttcggactgagccttatcgcccgagcgggtggtttcggcaggtctggccgaaggcactttgtggtatacctccaacaatatacataaaagaatattaacacgagagtatttatattggcatataaaacataaaatatatttttttgaagttaatacgtgcaaaatgaaaaatcttgaaatatacacactgttatattaagcaaggaggctgcataaaaaatttcatatttattcaaaacttctagtaagttcgtcaactgtaacctcttgtaagtcttgaagagcattttaggtattttttaaaagtatccacccctaatggtatattgtagaaaaaattgacaaagtcagtggcatattataaggaaagacaaagttgatgacaaatcatcgaactagactaaactcagtgacatagaatggattctatgttttatcgctcatctcttgatctaactgtagttttcttgtgtgtaggtctagattatttgcataagggttgcaacctgccaataattcatggggatgtaaagacaaataacattctcttgggtcggaatttaaaagcaaaaatagcagattttgggctttgaaaaacctaccatagcgactcccagactcacatatcagccactgcagcaggatctatgggctacattgaccctgagtatgagcttctttgtacgcaattaatgctaattttgtgctgtgtttcatatatattaatgattctattcaattttatccttaatcacttggtgcaatcattgtgtttaacaatgtgggccatttttaggtactacatcaccggtaggctcactgagagtagtgacgtctttagcttcggtgttgttttactagaggtaactagtggtaaacctcccataatacctgaaaatggccacattattgaacgtgtgaggcagaagatggtcaccggtaacatcaactcagttgccgatgcacgtcttggaggttcttataacatcaactccatgtggaaggttctagatgctgccatgatgttcacagcagatagctgctcaaaggccaatgatgtcggtcgtggtcatgcaattgaaggaaagtctggaattggaggaagctcatggggacatgggcgacatggaaaatgtagcaagagataacaagtctttgatgtccatgttcggtccatcgccaagatgaagaattaaccattgataactagctttgggacatatagtgggttctctgcttcaagtctaaaataaaaaaaactggtttgcatagatgatttgttttgtgttaagacacaataatttatacagtttgtattcgtgacagagctgacagtaagctgtttgtttcaatgtgcaacagtaagctattcgtgagagtagatcagccaaatgctgagaaggtggttgtttacaaccaaagattatgtactagaatcctctgccattttataatttgatcgaaatgttccacagcctcatggataattcagcacaactgcaaagggcagcacctcatgacagagctgaggagcatgtcaggactcgaccatcaagcaagaacgaatgatctcgttattcccgtttccttttttttttttttgggggggggaggggtggtttctctaatgtgtaaaacctatgtagatgtcgttattcatactgctccaacgatgcagttatgaaacttacaaatctaaaagacatgtttcgttgattttggttaggcgtagttgcataacacattgcaaagtcaaggtaagaagatctttacttaggtggatttcttcctaattctaatcatgtgagataggatatctcataaattgatttttctggacgataccctttttaggttgtagacggaccataactgcttctgcctgcaaaaatccctcacacggggtgagttcaaagcgctgcatgcaaaataacatttgcatgcggcctcttaagagatccacatatacaaatagactaaccttttcaggtgagcctccttagtggctacatgcgaaaatcagattttcacaagcgcctccttaagaggtccacttggaaaaatcactgcaaactaaatataaaaacgaaatccactccactcctccacctctcctctcttatcttctccccaatctccctctcgtgagcgcggctggagcagcgggagggtcggcgattggtggcgggcaggagcgaccaacgtcgggctggagtggtagtgagctcggcaatgtgggatccagcgtggaggacggtgggagcggcggtggcggcacactcgtattgggcatcggtgccctcggctacggaatctgacgcggaggacggcgggctcgggcggcggtagcaacgctctcggctagggattcagcgcggacgacggtgggagcggcggcggtgccctcggattgcatggtggtgccctcggttgcaggatgtggagctcggccgcgggatttgatacaaaggacggcgggagcaacggtgatggtatcgggtgacgacggcggtgtcctcggctgtggggtctggccggagtgacaagctcgatggcgaaggatctagccacgccgtcctcgagaggggcggatccaccaccctcatccacgaaaggggtgaccacgacattgggtagcgacagtggatctgacggcgccacccttgggatgggcggatcagccacccctggccccgagagggtgtcgactgcagtgggtggagtttgagggtagcggatccatcccccctccccccagcgcgggttgatgggccttctttatggcactaaaagagatcttatgatagatgacgcttcatttacgttataaacattgaattttttgtcatgtttcataatatgtgacgctcgcgtgacgaaaattcattcgtcacctatcatgcgtctctaatggcgttctatgacgaaaccttattttttcattaatctagtgacgatccttctgtcatcgtaactttgtgatgctcatattcgtcattatctagctaaaaaacgtcataaaatatctgatggcccattaaaatcaatgtattgagcactctgtttatgggctttagcccaatggctagcccgactagattttagcctggcccatctatgatgtagcatattttcagcccaattctattatatccatttgctttaatatcaaataataaatgggccaagtccattgcaaaagcccatataggcccaaacattataccacactattttcagcccgtcatattatattcattatattagtatcaaataacaagtgggctaagcccatataggcccaacaatcaaacataataacaacccatataggcccaacaatcaaacataataacaacccatatagcacaaaggtttcagcccaattagcatccaacacaacccgacaaacatccaatacaacacaaaatttacaacacagcaaatcagcaaatcaactggttggccactcgtgggaagtgtttgaactgtggcagggataggaagtgcttgaactgcggcagggacagggacaagaagtgcttgaactgcggcagggccggcctcagcttgctcaggaacccctatatcaaatacacaaagtgcaacagattaggcaccgattgactcattacatgataaaattgtgcacagctcagaacgcgctataatgtacggctccattatccatttgcaaacaagcctaaatagaagaataggcattgaaaaatacctcaagtaatgaagtttcagcaataaatcacatatatgaatcagggaggatagatatacatagaatctggaaaaaggagagcaaggattgattagggactgcggaggattgaatcaggaggaatgtcacttgcttctacttaccatgctgctgctgctgcttgccttccgcctgctgcatcgcgcctgctgcctgctgcctcgccacttgccacgcgcatgtccctgccgcgtagccgtgctgccggacaccagcgctggatatgagaaacacataagattgttgacaaacaacatactatattcaaccatgaaactacttttgaggtgctcataatcccaggcgcccagcaaacaaacctaatattgcatcttcgatatatttacaggatttgagccttatgagcttcttattagatagagctatgggctttgagcccaaaagagcttctgagagctcatgagctagctagatcttggcttgttaagaagacaccgactcgtttaattaattttacgagtcgagttgagcccataataagaagatgagaacaagcttagcttttacagtaagtttgtaactgttaattggcatgttcttgtcaaaaaagttttttaagtggccatgtttagtaacaggactaatccagaatgcatatacctgtaaatattattcagtaagtaagttttttcaaggcaatcatcagtatgtaagcttattttttcttgggatgtatgataaaagtggttatgaagaactttggaacataaagggggtaaagaaagttgtgcagactcgtatgaaaaaaaagacagatttttcaaagaaccttttctctgaagcatactttgttggtcttcatctccatgctcagttacttgagcaacctactaacctcgtcagcatgcagagatccagagtttagatgagccaagaaatctgcacaagaaaaaggtatcacaatcttctttcatctgcatgagaaataatgccaagagaacttcccagtttgatcagtttgggagaactaatgcagttgccctccctctgaagaaaggtactcctatatctgaacaaataggatttttaatagatttatccttgcgatatgcccttgatgtgtttaaacatctgaataaattttgctccatgcatctgaaattctaaatgtctgatgctgcaatgtcgtgctaattgatgttggtactactacattacaggttacaaattacaagtctttgcacttctcattttttaaaaaagaaaaaaagataggaaaaagaacagacctagacaggctgctgcaagagaggacatggtgaagcagcagcagtaatcagccgccgccggtgccggtgacgccgaggtctggcttgccgtcgtcctcgctgcttgtatgaggccagctccaagaacccccgctgcttgctcctgtaaagcagcctgcgcagcacccacccgaacacaacacgccccagccatcaacaaccgccgccgacgacgaagtatcagggggaaagaaacaagtagagaaaaacgggatgggcgcacctgttgatgaggcgacggcggctctcgtcggaggagaggtcgatggtggtggtggaggcgctgttctgctgggtggtggtgctggtggtggtggtgaaaccgaagaggacgcggtggggggggagggagtcttgacgaatccggtggcagtgcgggaagaggaggaggagaggcgctggtcggggtcgctccaccacggcacctggtcgagcgtcacggccggctccacccggcccacgcccggcgccgccgccaccgaggaggccgaggccgacgcggccgtcagcgagcgctggatcagagccgcgagcgcgagggtttggggaaaggaggaacgagatctggactcagatttggaatcgtggctgagggaagtagcaattttgatgcgattttaccagaataaccctggtatttggaaacttattatacaagttacttggataaaatggtcatttaacctgaaaattttaaaatactaaaaattcgaatcgaattttatcatactaaatgaacttatgtgaaaaaattgtcaaaaacaaagttgtataacttattgagatctaccaattttattttggttatttctccgtatgagtttgattgaccaatataaaattcggattttaaaatataagaaattcaaatatttttttttcaggtagttaatgattttaactgaaaaagtcatcaacaacaaagttgtataacttattaagatatacaacttttgttttggtcattttgctatatgactttgtttcaataaattaaatttgaattttaaattataacaacatcaaacaacattttcaaataataaatgatttcaactgaaaaagtcatcaacaacaaaattgtatagctcatcaatatctgcaacttttgttttggtcattttgctatatgactttgtttcaatatatttgaatttgaatttcaaattatgacaacttcaaacaacattttcaaatattagatgattttaactgaaaaagtcatcagtaacaaagttatataacttttattttggtcatttcttaatccagcaaactgatagtaatattattcacaaattttacacatctcttatgtggttttataaactataagagagatgtaattttcgtgaacaatgttactatcactttatcggataaagaaatgatcaaaatataagttatagatattgatgagttatacaactttgttgttgacaacattttaagttgaaatcatctagtacttgaaaatgttgtttgaagttgtcataatttgaaattcaaattcaaattattgaaacaaagtcaaatagcaaaatgatcaaaacaaaagttgtagatattgataagttatacaactttgttgttgatgacattttcagttgaactcatttagtatttgaaaatattgtttgaagttgttataatttgaaattcaaattttatataggtcaatcaaacccaaatggagaaataaccaaaataaaattggtagatcttaataagttatacaaccttgtttttgacaactttttcacataagttcatttagtatgataaaattcgatttgaaattttaatagtttgaaattaattgagaggagagagccaaaatgaacttctggttggagggaggaggggaaggggcagcttggctgctgggccggcaagttgagtggcgctgcccatggaggagtagaggaggccttcacggctcgggccgaggtgggccgagggagaaaggagggagagggaaaaaggccgagcgggctggcggggatttgaataagactttgggacggattcggcccaaatgacaaaggagggtttgtttttagtttttatttttaataaactctattaattgtttttttcttaataaatatttcggtgctctgaaaattcaagtaaacatccaggacatattttagaccgatgagaatttatgaaaaatactttgtgccacattcaaattttttcttgcacgtattttagtgtttgccattttcttttaggattttacttaattatattattcattttagagaataatttttaatttgggtgaatttatccggatgtgacaattattttagggcgttacaaagggcagttcaagcattcatcattttaaaaagaaaaaaacttatgataaaccagcattgttaggaacttgtgacgtttgttggtaggtctcttatgacaaaataatattcgtcacaatgcaccattagactagtttatgacgatctgtatttgatcttagtgacgaccaccctatttttgtcactaaccagcaccaccccctatcaaacgtcataaaacgaaatggcatagtgacgaaaagcaccgtcgtcacgaggaattcgtcatagaagatcatatttcttgtagtgtggatgggcaataaaatttactttcaattctgacaaagctacgtagcaaggtagtacatggtcaggactatactagccaatttttgcgtgagctgcttaggtttgtgaacttcttccccttcatgcttattattctctttatatttgaggaatatctagacggtaccttgatgctctcaggcattcaaacatactttccttctcttccttgctcagggtgtagctagctggactcaagtaatggcttcctttcttcttcggttccgaatgatggccctcgcgttgttccttatgcttgagatcattatgtgcttcaaatgtatctttcgacttcctatatacacctgaagcccagcaggttgacgcaaaggttcttagtgaggtgcatcacatcgattgcgtgatgggcgtccaagagttcccaatagggtaactctcaaaaaatagacttcttccacatcgccgtgtgactatcttcgctctctataggttggctgccaagtccctttccaaatactactttcagatctttcaccatagcaaacacgacttttccattgcgatgtttaggcttagtacgatggtctgccttctattcgaagtgcctgcctttcttccgtatagagtggcttgcaaaaaggaatcgacaatggcccatgtacataactttcctacaatgttttagatatgtacttttagtttcatccatgcagtgggtgtgttaacaatggaattttgcattagattcagaaaagaaggaacaagatcaaagtggatttgatgaaggagcaagttgtatttgaggtctgactcaacatctactgggcatcgtatcggctggagacagaataaaagtttggcttagccgatatggcaagtggtcgataggatataaattgggcacggtttggggctagattggaataaccgtcattgccaattagagataggatatttatgtcaatttgttagagatttggtaagagaccaccatatggtcttgtttgtatcttatctttaggaaagtttgagtcgtgtctatcatggactaagtttgtacttggggtataaatatgaaccccaaaccattttaataagggaaacaatccaatacaacttcggcgcatcatcatccttttttgttctacttttcgtcaagttctcttgacaagaggtaactcgtctcgatggcttgcgctatcggggttactatgtcgttttagatgttttagtccttttatcataaccatctgctatcatatgtcttagttaatctagtcttagtatcttaattgaactctatcggctggtactcgttttagggttcttgctggtattggctaaatcgttttactatattagattaactaaggcattgtcacacccgaagtttttccccctttcccttagtttctaaatcattgctaaatcgtctatagaaaaaactctgttaaccaggaggaaaccttaaataacaatgtgtttaataatcaaaattgtcggggagaattttttttcgaattctctttgcttgaaatcactaacaggatgttcagtgaaatattcagagtagaggaagtactaatgttaatttaaaatgtcaggagttgaattaataattccttcccctctctcctttggtcgtgaaccgcccccggttcactctccctgttcgtggtacgctgtatccgccaatcccgttgctgccgcggtttcgttttgtataacgagccgagtcctattctttctcgggtcccgttcccttttcctttcccgaaacggcaaagcatctatttatttttcctttccctttttggtaccctattctattaggtttttccccttctccctctcccctagccgccgcacaccacctcctactccccatgtcatgcgcgccacctcctctctcccaatccgactccccttctctctcctttgccgagtaaattaaggcccacctaatccatcttaattccccctatataattattcatacccctctatttttcctatttttccctcggttgtgaaaccctagctgaccctagtcgccgctgccgccttgttgccgcgccgctgctagctgtcgccggtgagctcccattcgattccctcggcatggttgtttccgtagtttccgcttgatccgtctaacctaattaatcttgctttgatctagcgtcgccgtctctccgtgtgttgccgccggaccgtcgtcactgtctcctcctctccgatcatcttggtttggtgaggctcctaaccgtgatctcctggtttaggttttaattttcttagcgttgttattgtaaccctaatcatgtcgctcccaagccttgccaccgcctagcgtcgctgctgccgcagccgtgcgccgccagccatgccgccactgccgggtgccgtgcgtcgccgttgccgtgtgccgccctaccgcgccagccgccgctgctgccgcccgctgccgagtgctgcagccgagcgccgccgccgctgtcctgcgtcgccgtcgctgccttgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaagctctaaaaagtccttttccccccttcccctcttgggccggctcggcccagttccctccccctctctcctcctccccgcggcccacccggcctcctccccgcgcgcgcgccgctgacgggcgggcccgcccgccaccctcgctgacgggtggggcccacccgtcatccccttcctcccgccgctcccgccgctcgcccgtgccctagcgccgccgccgccgcgaatctcgccgcctcccgccgtccccgcgcgcaataaagaggggggaaatattccccacgattccctctctctttccccccgtttttccctctctctctccctcggattcgcttggattcactcccgcaaacctcgccggcgccatcaatggcggccggatcctccgcgccggtttccatctcctccggccgccttccctcactcccaaccctatttaaaccacccccgtgccctcctccaccgtttccgccactcgccgcctctcctccccatcggaatcgagcccgcgccgtcgcaccctctctccgccgtcgccgccgagctccggtcagccgccgtcgtcgctccggaccgtctcccgccccgacgccgcctccttcggcttcgccgcgtccccgccgacctcggccacccctccgcttcgctcgccgaccgccggaacgtcgtcgaccccgtcgacccgacccgcgccgttgccttcctccgctccggccgccgttttcgtcgtcgccgtcaactcggggtgagccgtggaccgccgttcgttttcccctttccctcccctccctcggccgctgctccgccgtgccggtggtcgccggcggcgaccatcggggcgagggcgccgcctcccgccggtcgcgccgcaatggccgcccctcccccgggcgcaccgagcggctgccacgtggggcccggccgtcagccgcccgcgccctcgggtgcggctgacgcctggggcccacggcgccggtcggcgtgatccgcgtgcgcccggtccaccgtggaccgtgaggctgccgcgtgggccccactcccgtggacccggtccgcgcgccctctcccctcggctgacgcaataaatccgattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgatttgtttctgcttgttatatggagtttattagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttatgaaattattttgatttaaattattgcattatcgctttatttaaattcccgcgttatcactgttttatttagccatgcctatttacctttgttatgaccttattattattgttattgttattattaccttgttcaccctagaataaacaaaacccccaactagtggacactctacttgtggtatcactagtatgattttaggtagatgcttcgctaattaattaggtaacattaggtggttttaaaactctagactgtggtaatattcatatcacttggacactggaattgttggattattgtggaattggattcaccccgccccctctattcaaaactctcaaaatggttttaggctgggctcggggtgcatggttttgatagtcgcacctcggccatataaggaccggtcttcgggcctctattgcaaagcaccaccgtacttccacatgtctaatgggtaaggcttagtttgtggctcagtctggttataaacaaaagtacacggatggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccggccgtaggtgggattgggtcggtactcttgtctatggctaggatgggttgggaactatgtcacgtcttccgtctatataccgtggtggtatgtggcacgtgggtatacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaagacaggttcgtgtgggttcacggccttgtttaataatatggtacggctctaggatcgtgtttacaacatagttttgagcaactaagtgtcttttaatgctatttactgcaactcctaacccctatattataattccattgtactcctttgcaattacgctgcacttgtgggtgtgtcttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttctccgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccattgggttatttccggtcgtgacatgcctagccactgtttgtcgctcggtagttgagttgcctagctgcagtcgtaaacccgagtctctaccggcctattgtttgccgtaccgggccattgccgcaaaccaagttaagtctactggtcatgtcgcagccattcgctagccgctaatcgttcgttcgcacgaagtatagtccaaagcctcgttcgttcggtcatcccgagtcgttctttagtaatagagtcattctaagccaccggttccgttcgttggtttggttgaccgtttgagtggtcccatgtcacggtgggttgactcgttgagttgataacccatggggcttgattactgttgttatatttccattgatctatttcgcctttgggcattaatatgtaataattaataaggtttttcggttaatagtaattacacagctcatattctaaaattcatatctaaattatccaagctccgttttaacccattcaagttgtagtgaattctttaaaaagtatagaatccattaaaattggtttcttttgctgtttcaatagacttattggatgtatattattgtatgctttgtttgtcatttagattctggcagttccgatgctccagtttatttcgaagtggttgccgaggttccgtcagctcaagagcaaggcaagtcatacatacaacattgatcatgttgaacctattttataaaatcccctgatttctattaaatcgcattgtgtttagaatgtcatgtgtgatggatacctatcgtacgcagcctgttgataccttatgccattgatagcttgggatataattgattagatgattggtttagggatgcttagaccaattagctcacaatgggattcattataatttagtccttaattatatgatgatgtaccaccatggttatggtttaattaaactaaaatatgctttaatggtgggttgtgggtgtatggttttggaaagtcgtgcccatgacaattatggaccggttctcgggaatccctggaagatataatcgtacttaccacaggccagcgtgggctccaggctaaatctagagtacaacttaacctagctgacataccatggcaagggtagaggcgatggtgcagtttggacttggctctagtctctgctgttttcggatttacctaggcacgagaggggactgccgggcttttctaaaaaggagggggtgaaacctaaggtggttatgttcggttagggagggttatatgaagggttttgtcacgatgtcccccgttgcagtatcacggtggtacttcggggcatggtaacatgtgtggaatcgtgtcttctgggtaaagttgtacacctctgatcagagttaaaactattcgaatagccgtgcccgcagttattgggcggtcaaccagctcaccatgagtagtctcatctttaaataatatgacttaatgaactggtgtagttcaggtggtttggttgggcctgttgcaacgtggtttagtgttgggtagtgatatttaatattgcttaattacaattattgttttactgtattcaaattatggtttataaatgctgcttttattgcaaatatcatataaccattcctttgtgaatatcttgcatcataccttcccgttggtgtgacttgttgagtacggtggttggtactcagtcttgctttattttttccaaccccagaggcagagagtggctgagatggtgagttctatgaggattgagcttgttccggacgttgaggatgcctgtggtttacggaagatgctacgctttttgtcgtgaagattaagtttaggttatttttttatttctgttgtgtatcaacttgtcgtttgtgtaccctggctggtcctagacagagattataataaacattctgcttgaaattcgggtag

SEQ ID NO: 68365 - DNA, 2433 bp, Oryza sativa
tcttaggtactcatcaggccaggtgctatggctgttgctcatctcttccaaatagattcatgtcatccatacttaaaccgaaccttacgtttcatgcatcctctccgaagtcttcaaatgttccgtcggtggggtgtctcagcaccctgtcttgttaacattattttgcatgccagcgcatcattctagcatgcgatttgttcctgaaccaacgcccgagccatggtattatagggaaataccacatcaccatagcaagaactcacttcttcgaaggatgtctgttaacatcacctggatcatctcgtctaatcttgtatcgtagtgctttacaaaccggacatgcttctaggttctcgtactcctcaccgcgatagaggatacaatcgttcggacatacgtgtatcttctgtacttccagtccaagagggaagactaccttcttagcttcgtacgttgtttcggacaattcgtttccctcaggaagaatgttctttacgagcttcaataactcgccaaatgcctagtcactcagaccaattttggcattccattgcaagaattccaacgtagtacaacgacgttttgtggtccgctaacatacgctctaattttatgccttgtgtggtacccaactttttgtgcccctattcgcaacctgggtacaacgatgtttggtccgctgacatgcgctctagtttctgcatctccttttcacttttgcagtcctcctttacgtcatgcaacatctgaccaagatcatccgcaccgtcgttgtcttcaacatcctcgttgttaacgaccaaatttgtaatatcagtatcggagatgaagactagattgaagcggaatcgaagatgaagattgtcgcggaaacagagtaagaatcggctggagtccggatcggctacgattggatcggctgagttggagtcagacttggttagatgatgcagccgattctgacaatacgacttggtgcacaacatcgggttgggttgaagtgcttcaagatgattgccacgcatggatggagtcctgggaaggcaattgtatctactaattaggacattttatgtaatttcattagagatatgcttgggcaaaagtctgctgtaaagacttgtcgtatcttagagtttgttagagataagagtcgtgtccggtatgggaatgttttgtaattctcgggtataaattgccccgaaccccatgtaatcaaactaacacacgttcaatacaatttcggcgcatcgccaccctttttgctttcgttttatttcggcgagttcttgctttcgggttgagctgcatcggtttcgatcttcaacaagaggtaaaacttgttatggcggcttgcgttctcgggattagtgcttccatctttatgacactctaatcttgtttatgtaattcatcgagttatcatatatcttatataatcttcgataatatcgtcatctaacctacaatcggctaacatctgttaatagaaggcgtccgattaggttaaatagcgacgttagcttggattatataagatatccaccactctatgaaacatccaacgacttgattgtctagatattgctcttcttttcatacttaatgctgcatcagttgagtttgatctattaagtcgtgcttagaatttcaatctctagcctgtcttctggttgccgattagggtagtatcggggtttcagccgatcttacctggtttaactatatttgctttatgtgctttactgacatgttaaatctgccctttatgtcaagatcttattgcatttaagtatattaggcttctgtttggtatattctacttgcgttaatatcttaatatagagtggtatcggagtattatccacaaccagagttctaaatggaaacgacaaggactactcggattgtatccatatgggtttccctagttctacttggacaaggggacacctatgggtataaatataagaccccctaggaggagaggggacacgaccacctcaatcaacaaccaccacaatctacggaataacagaagccacaacaaacaagccaacatacgccaagacaagacaccggatatcgacttcagggataagcacggctagtcccctacggtgtctccggataccgtcaggagagacaaaagctctatctctaatctcgccggacacgaactcgaggaaaaatgctaccctgttgtcgactacgagtcagaacctcagaccgccacgtcgacaacagttagataggctaccccaaatattgtactgttgtgattatggtgaataaaagcaacactggctccggccaacaggatgtaaggttattacctgacaattcaggggctcgaagctatataaaaatcttcgtctccatctcttttacttcagtctcgcatatatcctagcatcaacgatccccata

SEQ ID NO: 68366 - DNA, 34321 bp, Oryza sativa
  unsure (1)..(34321): unsure at all n locations
ctatggagagatctaacctgaccaaagtatgtctcccgacgagatcgaaaccatcatcgtcaacggtttttgatctactgagatcatccaatctccaaagatgtcgctgccgccacggagaacatcaattcaatgtttcctgccacgacgtcgtcatcaaattctctgtcgtgttacaactgcatcgaatccgattatttcgaggccaactttcaaatcgtctatttgtatagacatgacctcttctcgggaacggagagcagataactcacaagagaactacaactcgtcaccctgcctgtcttaccgtggacaagtcgggtcgacagacgacggtgccccgacatcaagcgcaggcgtgcagcagcaggacagccgaagagagcaagaacccagcggactgcactgccatctacacgtatactagcatgcatgttgtggggcccatgtaggccacccatacgtgctagttactgtgtgtccagaggacgaattcaaatcagctacctaggctaatcaagtaattggtaggtaatgtcacatcctgatttttgtttcaggatttataaattatttaataaattattaaaagaatttatattaaatgttcattaattaatttacaagtgaagttaaatgtgggaaataaaatttcttaaatataaagcatgggtggatttaatttttattaaattctccatggttaattatactctctggaattttctcggatttttcggagctcaattcttaattttaatcatacaaagagcatttcagtaattacccacatattaaattaatcattaaatggtctaattataattttgttaagtactttgattgtccaagtattttcaggattttcttgaaattatttgagcattggaagtatttttaacaattgaaagatcatttaagtgattattttaattggaaaaagtttttaaatccttccctaagtcgttgggccgatttcggcccaactctttctctctccgcgcggccgaatcggcccaatcggcccagctgccgccgcccgccccctcctctctctctgtcaaagtctgttttgcctccctccttcaatcgggccgaggaaaatgaagcccgacaaaagtctactttgcctccctgctacagtgtcgtccctaaccttcagccggctgcagccaggccgagcccgagccgccaccttgcgccgccttccgcctccaaatccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggatcgatttcttgcgggaggagtccgatctcttcaatccaaggctataaataggaccccctagtcctcctctttcgtttgccccctctcccgtcctctcccgtgacccgtagagccgtcgccaccgtgcaagccgagccgccgccgtcgcttcttcgtcgccggccgtcatccgtcgtcgttcgtcgcgttggtgagtatcatcgggttcgtctcgtcgttctcttcgcgtaggtgttctccaaaatcccggccgaccaccctagctccggcgaggtcgccacccgtgctgtggctgccatggatgatgtcagcgtgacatcatcatccttcccgtttcctttcttttaatagattaaatcttcggaaaatcataactaaataaccgtagatccgtttcaggtggttcaagttgctaaatttttctaaaataaagatctacatattaaaattgtccataaattgaattaaatttatttaattttttttaaatgggctttaattagatttgatcttgtaaaattcataataaattcatttgaagtcagaatgaagccgttcaagtctcataattcatctaaaattatgatctacgtgtttgttttttttatgtactgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgtcctattccttgataccttgggtaataaattgattagtttgaaccttatgtattggtttggttcagctaaatgttatatatataattgcttagcaatgcttagaaacattagctcactaatgggatgaatcatatgtactatattattaattatggttatatttaatggtagctcacgatgattaatcgtgtgatgttaattaattgataattaaaacctggtaaggtgggttgtgagcatatggttttgatggttgtgctcatggcaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaacggtgcactgtggtgagttgtgttgtgcaaagggtattgtcacgatttccccctttgcaatgccgtggtggtatttcggggcatggcaacatgtgtggaatcgtgtcttgtgtgtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagttagatctgtacagccgggtatggttgttcaggatggttgggcctgagcagcatgggtgtgctgttcagtgttggttaaaagttctgattaattactccactgttttacttctcttaaatgttttgctaaatgctgcttttgcaaatgagcctatattatgccatcctttggaatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagccggagcttcgctagattttatttttccgctgcagttttcttcatggtgaggactaagtgcctcttaagtaagtatttatcgttttagttaatgtgatgaatctgtatattaaattgtcagtttgtgtacctcggctgattcctggacgagggtttaatgcacaaataagttcggaaattactagtgaatttccgggcgtgacagttaattaacttaattgatctactaatttcgtagatatatccggcatgtatctacaaaggtacgcaatattttatatgcaatttatcgtacctattcaggtcatacagcattgtcagatctataatttattatgtttacctagagcatgttttttatacaatatttattgtgcgagtgcttccgatgttaggccaaccacggtctaacgctgggggctcgctctgttctcttttgtatgaatcatgcttgtttacggtttacataatccctgatatttacatctgctcgttatatcctgataatactagaagatttatgcagttttttgagtacatactcgatattctctgctatatgtcttgccttctagaaaatatttttcaggaacaatcgagcactcgagtaggttgtggtcgagtacaccccaccatcgagaacattctcgacaaatgcggagttgtcgcgcccaacctaccaacgaagaccgacgacctatctcatagcaccggccatggctggactactcaagaaaaggttgttaacggataattcctcgcgaacgtcgtcggcttgatcacccgacatgattgcgaacggacatccggatatgctataagttgggtatgtgagtcatgctggccacatgagatgcacgtgtaataaaccaactttagcgcctccaatggtgttcgagagataattctactcgctcgctggttctcgaaccagtacgtagcaatctctcgcatcgcaaacttccattggtgttcgagagataattctactcgctcgttggttctcgaaccagcacgtagcaatctctcgcatcgcaaacttccattggtgttcgagagataattctactcgctcgctggttctcgaaccagcacgtagcaatctctcgcaccgcaaacttcaattggtgttcgagagataattctactcgctcgctggtttctccaaccagcacgtagcaatctctcgcaccgcaacttacattggtgttcgagagatagttctactcgcccgctggttctccaaccagcacgtagcaatctctcgcaccgcaacttacattggtgttcgagagataattctactcgcttgctggttctcgaaccagtacgtagcgatctctcgcactgcaatttcaaatggtcgaggtacgactacatcaataacgcagcggtcctcgcaccatgacttcagatggttgaggaacagctatgactggttttcgatcggcagcgtagtggtcctcgtaccacgactccaaatgatcgagagacacctactcactggttctcaaccagttaagcgtagcgatctctcgtacatttactttaagtggtcgagttacgactactaccagaggtgtagcgatcctcccactacctctactccaacaaagttggtatcaggtagacaatattgccaagtgttttacccagagatcccttaccacgacgactcctagcgttgaaacctatcctcatgtccctttacgccgtcttgtcaaggcctgcgaggaacctaagggaacttcagctgaggatgcccagagccgataaggccttgtcggatcctgtagagacaaaagaccatgtaagatctggtcgtgtaagagttctcgccgtccgtattaaccaagccgtgtaatcggaaattgggttttccaacttcacggctgggggctaggatcagtgcttgttcaaccaaggcaggtcaagggtccaagagccttctcctccgagaatgattctctgacgacaaggctgggggctagggagagtgtataactcaacaaactgactgatcgaagtcggtaagagagaagacgctcatatacaaaacattggtctgtaaatttaactcattttcagttttccatacatattatagcatgtcaccctttgagcattcgctcgggggctatttctatctaatattcttttctgagtattgatttcaggaaaattctattcgacattgtggaagactccatgtctctatggttctacaccaagatcgactaaggcgagtacgacaaatgttgacaaggctccgtcgcagtctctgcgccttctcgatcactcgagaacggttggtggatctcgacaaggaatacagaatgaagagatggtgtacccgccgagataaaatttcttgacttcaatccaaattctcgattacagcaagacaggagacttagtcgtatgttctgtactttcttggttgacgtcggagatggactcagacaaaccctttaggttcccgcacgaggctgataaagaaagtctaacattatctctgaactcacagagaacggtcacttgagctcgataacagttcttccaaggtctgcagttgagaatatgaacctgttcattttcattgaagtcgggggctactgtcagggttatggataccacatacctaatagtagtcgacaacatctcggcaggacccaccacataccatgtcttatacggaaactgacttcggatatggagggagttccggataaggaaagataaccagagttctatatggaaacgacaaggactactcggattatatccatatgggtttccctagttctacttggacaaggggacacctatgtgtataaatacaaggccccctaggaggagaggggacacgaccacctcaatcaacaaccaccataatctacggaacaacagaagccacaacatacaagctaacatatgccaagacaagacgccgaatatcgacttcagggataagcacggctagtcccctacggtgtctctggataccgtcaggagagacgaaagcgctatctctgatctcgccgggcacgaactcgaggaggaaggctaccctgttgtcgactacgagtcagaacctcagaccgccacgtcgacaacagttagataggctaccccaaatattgtactggtgtgattatggtgaataaaagcaacgccggctccgaccaacaggatgtagggttattacctgacaattcaggggcccgaacctgtataaaaatcttcgtctccatctcttttacctcagtctcgcatatatcctagcatcaatgatccccataccatgcaaatatcggaatcgcgacatcaaacgtcaacacattgtgcccgtcactcaggataaactgacacctgagcagcaaaaggaccttgacgcaatgatgtagcaagcacggaattagttcttgagttcattcacagagacccgcaaggggacacttgtgtagaagtacaaggtaaaggtggttgctgatgtccttgggacaagttctcccaaggatggagaagtgaaacaaactccagatggtgtggctcaaccgagtgataagggtgctgcagacgacctccaagaaaatcaaggtgatggctctcaaggagtatagggcgtcggctctcaagaagttcaaggtgatggtattaatcaaggtggcactgcggcacaactacagtttaacaacttccagaatcaggtaaaatatgccgtgcatcatgctttgatcaatcaatctgggatattagtcaatactttgtcaaacatgttgaagtcgatggttgatggttcaatagctgaatatcagactacggggccggtgtatcttcaagggggtacattcccgaattatcgacccttaattactgacaatcagcaagccgttcaaacagtccctcctaacgcaccatcggctcagccgacggcacaagtatcggcccctgcacccgctgcatcatcgtcagcaccaggtcaattagttaatcctcggttgttggtgagagaacagccacaacatagtggacagaacgtgaatcggctaacacaagatcaggttgcagctatgtttttaccacctcaacctactgttgacccagtccagcaatagccgattcagcaaacaccaccgaggcagcaggttgtgcagacgattcagcaaacaccactgagacaacaggtgttgcagccgattcagcaaacgccattgaggcaacaggctattcagccgattcaccagtagggtttgatgaatgcatcggctggattcgcaacacctaacagtcagctagggcagcacgctgtgaatcgagttgtcccagagcatttagttcaccatgtgcagccagatcaaacagtgatacctcaagtcgttcctgaacatttggtgcacaatattcagccgaacttccagaattaccaggggggtagtttgaattatcggtatcagcctccttcgccacaagttcaatatcagcagggaggatcggctcaacctcagttcactcctcaatacaatcaattcgagcccatgccacagcaacctcaaggagcacctcaacaacgaccataggccgatatgattgcagatgtgatgaaggagcagtttgggctcaggccgaaggatgctggaaatttgtatcggcaaccttaccctaaatggtttgagagagttcctctccctaaccggttcaaagttccagatttttcaaaattctcagggcaagatagtacatcgacttatgaacacatcagccggtttttggcccagtgcggtgaagcaccggctgtggatgccttgagggttaggttgttccgattgtctttatctggatcttcttttacttggttttcttctttgccatatgggtcaattaacagtggggccgatttggagaagcatttccacagttatttctatagtggcgtgcatgagatgaaactgtccgatctaacagcaatcaaggaaagacacgatgagcccgtgcatgagtatattcagaggttccgagagatgaggaataagtgctacagcttgagtttgaccgatgcccagttagccgatttggcttttcagggtatgattgctccgatcagggagaagttctcatctgaagacttcgatagcttatcacatcttacacagaaggtaaccttgcatgaacagaggtttgcagaggccaggaagaactctagaaaggttaatcatgtctgtccctacatatatggatcggatggtgaagatgaggatgattccgaaatagcagcagccgaatgggtgagaagcaaaaaggttgtaccgtgccaatgggtgaagagttctggaaaagaggagaggtatgactttgatattaccaaggctaacaagatctttgatttgctacttcgggagaaacagattcaactttctgctggtcatacaattccgtcggctgaggaattgggcaaaagaaggtattgcaagtggcataactctgggtctcattctaccaatgattgcaaggtcttcaggcagcagatccaagtagccattgagggaggcaaaatcaaatttgatgattccaagaggctgatgaaggttgatggcaacccttttcctgtcaatatggtgcatacatccggccggacagccgaaagaggaagatctagaagtttttaggtgaattcggctaagattatcaataagtaccagaagaaatatgacaagcaacaggagaggcgttatgaggaagatgatggtggtttgatcctcattgcggctgcgagttctttagattctgctggaatgagggtatgaggctaccatctatcaaggactgccttgggtgcggcaatattgcataaagtccaagccgatcgcataataaaggtgatcggccaaggcaaacaagagtgcctgttcatcaaagattgggcccagtaaatcgagattataaccaagaggacaatgaagacaggaagattcaatggtgtccttctggtatttttacaaagaatcagaaaaggagggttcagagattgaggaacatggagcgttttcaggaagttgagcaagaaatcaatcatcggcagaagaagacgaagccgaagcaagaatggcgggttaagaatcaagttcctacagccgatgtagccgcagccgatgaagcaaagagattggctaaaaggaaaagtgttgtgactgcatcagttaacatggtcttcatgttgcctgccgaatttggggttaaacgagccgacgttgatgaagttgaagaggagtcggctaggttgattttatcaccagaacaagcggtctttgagaagccggaagggacagagaatcggcaccttaagccattgtatgtaaatggctatgtcaatgggaagccgatgtctaagatgatggtcgatgatggggctgcagtgaatttgatgccttacgctacgtttaggaaactgggcaggaatgctgaagatctcatcaagacaaacatggtgctcaaagattttggtggcaatccatcagaaactaaaggagttttgaatgtggaactgacagtcggcagcaaaactatccctacaacattctttgtcatcgatgggaagggttcctacagcttgttgcttggaagggattggattcatgccaattgttgtattccttcgaccatgcatcaatgcttgattcaatggcaaggcgacaagattgagatcgtgccagccgataggtcagtcaacgttgccagtgccgatttagctctttgggagatggatggtcttgattgcttacctggaaaagtctgggatggagattttctaaaagtgtccgattgtgatatacagccaattgaagatggagagcccaaattgttattttgagggcgttgtggagggctcaggagtctacgccaaggacacaatggatgatctcgatgacaagcaaggacagggtttcatgttgcccgatgatttggaagaaattgacataggaccaggcgatcggccaaggccgacatatatcagtaagaacttatctccagaatttagaaccaagttgatagagctcttaaaagaatacagagattgcttcgcttgggagtattatgagatgccagggctcagccaatcgaatgttgagcatcggctgcctatcaaactaggggttcgaccgcaccagcaacctccgagaaggtgcaaagccgatatgctagaacctgtgaaggctgagatcaaacatctatatgatgctggttttattcgtccgtgccgatatgctgagtgggtttctagtatagttccggttatcaacaagaacggtaagatcagggtatgcattgatttcagggatttgaataaagccaccccaaaagaagagtttctgatgccagtagccgatcagttagttgatgctgcctcaggacataagattttaagttttatggacggtaatacaggatacaaccaaatctttatggctgaagaagatatccataaaacatcttttaggtgtcctggtgcaatcggcttgtttgactgggttgtgatgacttttggcttgaaaagtgctggagctacatatcaaagagccatgaattatatctatcatgacctgatcggctggttagtggaagtttacatcgatgatgtggttgtcaagtccaaagagatagacgatcacatagccgatctgaggaaggtttttgagagaaccaggaagtatggcttgaagatgaacccgacaaagtgtgcttttggtgtatcggctggccaatttttgggatttcttgttcatgagagggggatcgagataacccagcggagtgttaatgcaatccagaagattcggcctccagggaacaagatagagttgcaggagatgatcggcaagataaattttgttagaaggtttatttctaatttgtccggaaggttagagtcttttacaccattattaagattgaaagccgatcaacagtttacttggggggcagaacaacaaaaagcattggatagtattaaggaatatcttagctctcctcctgttttgattcctccacagaaggggataccttttaggttgtatttgtcgggcggtgaaaagtcaatcggctcggtcttaattcaggagcttgaagggaaggaaagagttgtgttttatttaagtcgtcgactcttggatacataaactagatattcccctatagagaaattgtgtttgtgcctatatttttcatgtacaaggttgaggcattatctattgtccaatgaatgcactgtcatatgcaaggccgatgttgttaaatacatgttgtcggctccaattttaaaaggaagggtcggaaagtggatattttccttaacaaagtttgatcttccgtatgagtcgctgaaggctgtcaaggggcaagctctagccgatttcattgtcgatcatcgtgatgattcaatcggctcggttgagattgtgccgtggactttattttttgatgggtcagtatgcactcatggttgtggcatcggtttggttattatttcccctcggggggcaagttttgagttcgcttatactatcaaaccttatgcgaccaataatcaggctgagtatgaggcagttcttaaagggttgcagttactcaaggaagttgaagccgatgctattgaaattatgggggattccttgctagtaatcagtcaattagcaggagaatatgagtgcaagaatgatacattggtaatttataacgagaagtgccaagaattaatgaaggaattttggctggttactttgaagcatatatcccgagaacaaaatattgaagctaatgatttggcccaaggggcatcggggtataagccgatgatgaaagatgttaaggttgaagtcgctgcaataacagccgatgattggagatatgatgtgcatcaatatttacagaatccatctcaatcggcttctcggaaattaagatataaagcgttgaggtatactttattggatgatgaactctattatcgcacgattgatggggtgttacttaagtgtttgagtaccgatcaagctaaggttgtaatcggtgaagttcaagaaggaatttgtggcactcatcaatcggctcataagatgaagtggttgcttcggcgtgcagggtatttttggccgacgatgctggaggattgtttcaaatattacaagggatgtcaagattgtcagaaatttggagcgattcagagggcaccggcgtcggctatgaatcctatcattaagccattgccatttagaggttggggaattgatatgatcggcatgattaatccaccatcgagtaaaggacataagtttatattggtggcgaccgattattttaccaagtgggtggaagcgattcctttgaagaaagtcgattctggggatgctatacaatttgttcaagagcatataatctatcgatttgttattcctcaaaccattacaactgatcaaggatcgatcttcgtgtccgatgagtttgttcagtttgccgatagcatgggtatcaaattgttgaattgttcaccatattatgcacaagctaatgggtaaactgaggcatctaacaagagtttgatcaaattgattaagagaaagatttccgattatcctcggcagtggcatactagattggccgaagcattgtggtcctatcggatggcttgtcatggttcaatccaagttcctccttataagcttgtttttgggcacgaggctgttttgccttgggaagttagaatcggctcaaggagaacggatttgcaaaatgatttgacagccgatgagtattataaccttatggacgatgaaagggaggacttcgttcaatcaagattgcgagcccttgcaaaagttatcaaggataaggaacgtgttgctcggcattataacaagaaagtggtgcctaagtctttttctgaaggtgaacttgtttggaaattgattttgccgataggagctcgggatagcaaattcggcaactggtcgccgaattgggaaggaccgttccaaatctataaggtcgtgtctaagatagcttatatgctgctaggacttgatagagaagtttatggacgagcgttgaatggcaagtacttgaagaaatattacccaagtgtttaggttaatgcatgatcggctggtgttgccgatgcatgatagccgatgtcttctcatcgccttgagatggccgatattattatatcgcccttagttgtttttctattgtaatcggttgtgttttgccgatgtacaatggccgatattattatatcgcccttagttgtttttctattgtaatcggttgtgttttgctgatgtacaatggccgatatggttatatcgcccttagttgtttttttgtaatcggttgtgttttgccgatgttcaatggccgatatggttatgtcgcccttagtctaggttataattttatcaatgccttcgtcatttcaaaattaggggggcacatacatacaacagttgcaaaattttgaagattttcgagcagaattcagaagttgtattaattggcacaaaggattatcaagacaagttaagtaaagtatcgtagtatcttagccgattacaaaaatttccaaaagtctactatacaaaatgtcattgaaataaatagcgctggataaccgatacagccctctgcctaatttgttctagttcttcgatggcctgggcatcttgagcatcgattctagggatgactttcaaggacttggtcatatcagcgacattcttgatagctgattttaatcttgccttctgtccttcgacaacttgtgggagatcggctagcttcttgtgttccagatccagctcggtgttgcattcttgaagttgtgccaagagctcaatcttgcgagcttcgagccgatcaatattggctttgattggtccttcaggtaacagatcaagcttggccttctcttcatgaacaagctgccgattggcctggattgtgacctcgatgtcttttcgctcccgacaatcggctaatctctgcttggccttctccagcttgaatcggtgttgctcaaggtagacagctggagtgagggcatcggctagctcatctgggagtagagcttgaatatctgcaaaccttgccctgatcgaaccacagttagtcaccaagttgtctaatgatgcctctagccgatgagagatatcctcaagagtctttttcacatcatcggacaagggagctagagctttgctggtggtatcagtttctgtttcttcatcaagatagtctttgatatcaaatgagaacagatcggctaagacccgcagaagagaaaattgaagataattatagatcagattgcacggtacggccgattgaaaacattttgaaggtgacatttactgggatgttaggaacagcgggttgttcctcttcctcgacattgtgactccctgcagccgatggagttcgatcacttgacatttgctgcacaggaggtgaagaaggaggaggaggctgcaaaaagacaaagtgttgaataaatatcggccatgatcagattagtgaaagaatttatataagggaatcttactggtggggctggtttaagtgttgtcgctgccgatttctttctcacagcagtcttctttttctgcaaaaacaagttttatgagtgatcggctatgaataggataactgcaaaaggtaattaaggagagatgtttacccttgagaagttagccggtgcaacaggagttgggggagtttgcttgggcgaggctgacggtgtttttcctccaatatcactcaattcggctgccgcttgatcaatgtcctcttcaatctcttcttcgtccagagcttgttcgatggacagatccagggcaggcagatcatcggttggcttgtgcttctttaatttaaccttcttctttggggctggagccgatgtgtccacagccgatgatctggttcttctctttttaccggcatcggctggttctctgacgagcccttgaaggagagttgaagtcctgggggcattataaccaataataggaggagatggtccaccccctttggaatcagccccggggcatactcaatatttctgccactattgctctagtgaggaggagatgactctgttgtctacaaattaaaaggaaaattaatcaagattagtcggttaaacaattattcaaatgaaattaagcaagtcaagacatacctgagggacaacatctggaaagaggtctgtcatatacatagaagccgattgatggaataggtgtagtttccactcaccccaccatctgtcaaatgctttgctcctgaaggttgccagctctatgttgtcaatgctgcctagagggggtccttggagattaagcagccgatccatcattaaggttgatgaaatttcccctcggcactggatcttatcagcaaagaataagccgattgggagttggcccattcctagttgtctggttgagctcattgggtgataaaacacataagaaacttggatgtttcatccatgatgaatgccaacagggaggatacatggactgattgcagctgaaaagatttctctgggtttctgatatctttcatgattgatatcttcgaacctaaagtccaatggattctccagaagtgttgaatcttcgtagaggaaccaaactcgagtgtctttttggaaaccctcataaaaactacagaaccagtccttgagcagttcagccgatagctttgctcctgcatcggttggtgtggaggtatattctccgtaaaatgtgcatctacgatgagtgcgttcttctccatcatcatctacagtcggttccagtcttgggaattcggcttctgttacagatggccgattgacaaacttcataactactagattcagccaagactgtaatagccaccatggtccacctgctccgactactgagccgacggccaacttagccgatgtattgtttagcatttggtacaaatagccgaggaggattttgcctaaaggaaattgtctctttgtctccaaggctttggctgcgaactgccagttggttgtagggccacaacttgatccacaaaagaggattttttctagccacattagcagaaaagctacatgttctcgaggagtgacagaaccttggcccatatatgccgctacatagcctgaccagccgcctatgctcttggtcctaaagtcatattggttcttcgtgttcaagctcatagggttagccgatgaggtgacatccagacccgtaatcattatgatatctatgagagttggagtcatcggcccttgattgaacaagaaggcattgatggtgtttgttggaccaaaaataggaggcagctgccattaggggctcgtctttagctgagttggctatggtgagatcaagtgcttggccgattccaatttcatcccaatgaaatcttttgctagccgacatgcgcttgaaccatgtgatccaacttttctcgggtgaggttttctcaagggatggccaggatttgaaagtgtttttctagtgacctaaatctgggttggtcaatccgaaagtaatcctattggtttcgccaataatgaactcggtgggatcagggttgccgactgggccgagaaagtaataattttcgtgcgacaggctgggaattgcaactaggttggaaagatgctacaaatccaaaagaaccaagaaggggaaaacaagatgaagtgttggaagatcaatctgatgctgagaaaggggatctagccgacgggaacttacctcagcgtactcagctgacggtgcggtagacgggctggcggaagaagacatcgtcgcgggcggagatctaaccggagatgaagtcgcttggggatcgcctcgcgcaccgaggaaatcgccggagagagagaggacggggtttgcttcggcggtgaaaacggaagtaacggggtaaagatttttcagggtggcggttagtatttaaagcacggaggataacggtcggaaaacggcggagtgcgaaacttgctcggagtcgatatgcggcaaatccgaaacattatcgaatattccggacttggggggcatgtgttaacgaccaaatttggtaatatcagtatcggagatgaagactagattgaagcgaaatcgaagatgaagattgtcgcagaaacagagtaagaatcggctggagtccggatcggctacgattggatcggctgagttggagtcagacttggttaggtgatgcagccgattccgacaatacgacttggtgtacaacatcgggttgggttgaagtgcttcaagatgattgccacacatggatggagtcctgggaaggcaattgtatctattaattaggatattttatgtaatttctttagagatatgcttgggcaaaagtctgccgtaaatacttgtggtatcttagagtttgttagagataagagtcgtgtccggtatgggcatgttttgtaattctcgggtataaatagccccgaacctcatgtaatcaaactaacacacgttcaatacaatttcggcgcatcgccaccctttttgctttcgttttatttcggcgagttcttgctttcgggttgagctgcatcggtttcgatcttcaacaagaggtaaatcttgttatggcggcttgcgttctcgggattagtgcttccatctttatgacactctaatcttgtttatgtaattcgtcgagttatcatatatcttatataatcttcgataatatcgtcatctaacctacaatcggctaacttctgttaatagaaggcgtccgattaggttaaatagcgacgttagcttggattatataagatatccaccactctatgaaacatccaacgacttgattgtctagatattgctcttcttttcatacttaatactgcatcagttgagtttgatctattaagtcgtgcttagaatttcaatctctaccctgtcttctggttgccgattagggtagtatcggggtttcagccgatcttacctagtttaactatatttgctttatgtgctttactgacatattaaatctgccctttatgtcaagatcttattgcatttaagtatattaggcttctgtttggtatattctacttgctttaatatcttaatatagagtggtatcggagaattagccgatacatgctagatctatttgatcggctatgctatgaacatatataatcttgttgttagtacatatttcgatctaagtgatttatactgtctcggcatggcaaccgatctatcccaatcacttgatttaagtatatatcgacgtcaggattatatattggtgatatctacagccgatcgagtagatgtagttctttcttatttattaaggactgccgatcgattcatatatgacatcagcccaaagataaatgatatgtcatcggcactcagccgatcggctatcgtttatggatttaactacagtttctttgtctttgtttcttgttgattgcaggatcaaatcaactggcacgctagcatacccgaaggcgagttttggacctgcactggagttaagcagatctctcaggcctcgtatttttcgtcaacactcgtccgcctcgtttgttgtattttcatcaaatccaccgtattgagcccagtccggaatgttctcgtcttctacgtcatcttcctccatcgcaacccctaacttttcgtgcgaggtccaacaattttagctaggcattaacctcgactgaaacaagtgggcataaatagttcatgatgtagaatactacttttggtttttgcactttttgtatggacaacatgtaaaacccttatgcttgttagcattggcaacactcaaaaaataatgcaagccttcaataaactttgtcgaccgtcgttccgcggtgtacatccattgccgatccatctacctgaaatgcacaaaaatcgtaaaaataaaatccacgaaagtcaagctaattaaataatcatacaataactatatacaaataatcatacaataatcccacatattattaatattattaattatttttaaagttctaatgatatgtttaatgtattgtactttttctaactattttattaaattaactttgttttctattcttttatcttaattttctatatttttcctttgtcatctattttataacatttttatccacatgtttctaattttaaaagtaacctatttttatcctaacaaattttctctcttgtcattttccataaaccttttcagagacaataatgtatataaccataactataaatgtaatatactaagcatacattatcagaggatggagttgctaaccttttagattccttcgatttgtatattatcaccgaaacactttcacaaaaaaatttggtagcacctcccttcttcctccaaacctttgtagcaatggctcgggctggaggaggaagaagaagtataaaaatgtttttatctttagccccggctgtctttaatccggttggtaacaccaatcaggactaaaaatcataaagctccattgcccttttttatccaactaaaaatgttctttagtcccagttcctatttgaccgggactagtgtgattttcgccatcccggcaaagataacttctacagtagcgttggtattcgccataacagcattcaccggcgatcaggtgagattggattggggttttgctattgcaggaggaggagaagagacactaggagaagaggggagcttttcttttacccaaactatttattctgagacccagcagatttattaaccaataacaacctcccttctccgtgctagtgggcttaggtttagaaaatgtcatgcccagaaattcactagtaatttttgaacttatttgtgcataaaagcctcgtccaggaattagccgaggtacacaaactgacaatttaatatacaaatccatcataatgataacgttacatacttacaaaagtaaagaaaaaaactgcagcggaaaaaacggtctagcgatggcttcagctccactcccacaggcagctcaactggggtataagccaaacgtcttctctttctagatcctttttgttcaactgaggttgattgattattgcaaggtgaaaacatggaatactccgcaagccacacaacaaatatgcaagtgcacaaaaataccaaaggatcgcataatatagnnnnnnnnnnnnnnnnnnnnnnnnnnnnnnatttagaagtagtaaaacagtagagtaattaatcatcaatattaatcaaactgaacagcacagccatgctgcacaggcccaaccatcctgaacaaccatacccggctgtacagatctaactccaaaccaggagctaagcaaattattaccagttatagcatcaataattattgtgagaggtgtgagactaatcacgaaaaatattactctggccagaggtgtaccactgtactcacaagacacagccccaaaacatgttaccatgccctcagtaccaccacggtacctcgaaacgggactgtgacaatacccctcgcacaacataatccacacagcgcaccattcctagatcataatcaccccctcaaaaacaaaaaaccagaggcatggactccccagcgacccccacggacttctcgccgcttcacagtctggtgccccgcaatgaaccatactatacaaaagctaaagccgttgcccacgctggcttgtggttggcacggttaatgtctcataacagtagctcgcgaaccgatccttaattgttatgagcacgaccttcaaaaccatgtgctcacaacccaccattgtcaagttttagttggcacgtaattaattaaccaatcacgattgaccatcgtgagctaccattaaatataatcataagtggtagtgtaacattagttatcccaatcatatgctaatgtttataagcatggctaagcaattatatatatatatatatatatatatatatatatatatagcatttagctaaaccaaaccaatatataaggttcaagctaatcaatttattacccaaggtatcaagtaatagggtattcaatgcaaattggccataacaaaggaataggttcacaccacccgttgacatttgaaaataaatgcacagttgaaataaatagagaatttaaatatgagatcaacatgttcaaaggattatgtttgggatctgtgtgacttgccttgcaataatcggtcttcaattagtcttcttaaacacttccgacgcactcacgaaccttcgcaacgacggaaacgacaagctaacacacaaaacgaagaaaaagactaataaaaactaaataaacagtacataaaaagtaaacaaacatgtagatcatgattttagatgaatttagagacttgaacggcctcattccgacttcatatgaattagttatgaattttacaatattaaactgattttagccttatacggaaaaggatttacgatttatgacacaattaagatttatttttagaagggaaaaaggggctttatgacgtcggcatgacatcattgccggaacaaggcactggaccacatgaccgccggcgatggaggactcggccgggccaaccgaggacatctacgcgatgaggacgacgagaggaactcactgatggtgacggcgacgacaatcgatgacggaaaacggccggcgacgagattgaggcggcgacgggctcgggttgacggcgtcagtggcgctccggcaggcttcggcttcgaccgaggggtggacggtgtgcagctcctccttgcgaacccggtggtggcgacggcgaccgaaggcaacgatggacggcgacgagcggcacggctggagactcggcgacggcgatggcggcggcgctagggtggaggcggctagggcgctacgggcgacggcgagctcgggcgagggtggaaaacgaaagaggaggtttaggagctgctatttatagccggaagagggagagatcggctcgggaacggatggaatcgcgccgggaaaaggagagataaactcgaaaacgaatccaaattcgcgtcgaattcaaagggataaaataggatttttgggggaaaagatagaggaggataagggaaacaaatctcctcaactaattcaagaaacggctgagagaatcgagcaaatcgggcggaggaatcggcagcggcacacacggctcggcggctgcacgggctctgtccaagcttgaagacgatactgtagcaggaaggctaattagactttgtctgggcttcttttatccagcccgattgaaggagggacaagaaatggacttcggaggaggaataaaggcagctgaaaggaagggagaatgggccgagaactaaaggtgaacttttccagtttcagcccgaaaaggaaaaggggatttaatttacttttgtaattaaattaatgatcttcgaattgttaaaatatttccaatgctcaaataatttcaagaaaaatcctgaaactaattgaacactcaaagtacttaacaagattataatcaaaccatttaattactaacttaatatttaaataatttctgaaatgctctttgtattattaaaattaagaattgagctctgaaaaatccgagaaaatttcagagagtataattaatcatggagaatttaataaaaattaaatccaatcatgctttatatttagaaaattttatttcccacatctaacttcacttgtaaattaatgaacatttaatataaattataaatataatttataaatcctaaaacgaaaatcaggatgtaacagaaaaggcccatttagaacaagcttgagagcaaaactacctaatgtggcccaattcaaaacacatattgcatctaacctacatcttacaagaccgaacaaaatggtccaggtccaagtagtgataacaagcagtatcaaaagaattcaaatttggagtacttgttcattgcatatgaactaattggttatgtttttctttaaatgacaatatagaatactaataataatatatcactctacaaacatgtaatgtaagtttaaattcaactactggaatttgtaacaaaataacagatttgactataaatatacttatactagttagagtttaatttgtcatttttgttacaatttatagaagtcgattttgaacttgcaaatttgtcaagtgatatattacacattaatctatttggtcaatttttttaataactatttacttaggcctagtttaggcctagtttagatcctgaaacattttggcaaaaaatgtcacgtcaaatgattggacctatgcatggggcattaaatgtaagaaaaaagaaaccaattgcacagtttgcatgtaaattacgagacaaatcttttgagcctaattacgccatgatttgaaaatgtgatgttacagtaaaaaattgctaatgatggattaattgtgcttaataaattcgtctcacagtttacaggcggaacttgtaatttattttattattagtctacatttaatacttcgaatgtgtgtccgtatactttaagaactttacaccgaaataactaaacacacacccttagtcgattagaatcctactcgttagcctgtacagctctgaagtttgaataacactagctctttaacacattcgtaatagtagaatatgttatatcccatattggattgatttactatcataattcttatgtgtaatgtgtattagaaaatttatagcatataactactgaaatttacagtgtaagcgtaaagtaaaaacgaatagattatttttagtaaaaaaatggcgtcacaaatgtatagttgccaataaaattagaatgtgcaagtgctggcagctggctatctagtactacctccgttttttaatagataacgccattgactttttctcacatgtttgaccattcgtcttattcaaaaaatttatataattataatttattttattatgagttgttttatcactcatagtactttaagtgtgatttatatcttatacatttgcataaattttttaaataagacgaatggttaaacatgtgagaaaaagtcaacggcggcgtatattaaaaaacggaggagtacttatctagcccaggtccctacattacacgtgtgtcacctgcccgtgctagtagtagctgatgacaaccagtcgccgccgctatgcaatctgcaaaaatcgtcgggacacgaagtctgccgccgttgcaggacctgcagagtcacatcgtctgattgcagcacgttcatggctctcgtaatggacggccgttcactcgagcccgacggtgaccgtacgctggagctgccaatcgcagtcacggtctacggtgccacactctcggccaacctcctgcagctagcttcgtgtctacgatcgtactgcgattgtacacatccgtgactgcgtcccgatcgtacagatcccaaatccactgtagtagcgggataacctggtccgtctgctccatctccggccagcggccagagagactacctccaggatgacgacaccaaagctgtagacgtcaagctcgatgcttggtcaatataccctgtggtgcccataacaacctgcgtagtccgtgggtcggcgccatagtcgacgagccttgccagccgaaaatcctccagcttggtgctgcctgaaagagtcaagaagaatgttgcttggcttgatgtcgccgtgcaatatatatgcattgatcccactccgtgtggagatagcgtagcgcagagccgagacctaggatgatcctgtatctgttaatcaaccaagttgaacaaaatgagtataatactaagattatcatcgtcatttgctactccctccgtctcacaatataagggattttgagtttttattgcaacatctgaccactcgtcttatttaaattttttttgcaaatataaataacgaaaagttgtgcttaaagtactgtaaataataaagtaagtcacaaataaaataaataataagttcaaaatttttttgaataagacgagtggttaaacgttgcaagcaaaaactcaaaatcccttatattataggacagagggagtagtaattaattattttgtactacctatctggccaagaggaggtgtctgtcaaagctgcaatggtcgcgagatttgggcttagatccacgggtgaaaaatttcgtcgtgtcacatcgaatatacggacacacatttgaagtattaaacgtagtctaataacaaaacaaattacggaatccgcatgtaaattgcgagacgaatttattaagcctaattaatccgtcattagcaaatgtttactttagcaccacattgtcaaatcatggagcaattaggcttaatagattcatctcgcaaattagtcacaatctgtgcagttagttatttttttagtctacatttaatacttctgtgcaaacgttcgatgtgacagggtggaaaattttagttgagtttgtggctggttctagagtggagatgaacgaccaggacagcacctgatcatgatgcaactcgatgcaggcgtcggtgaccgcggagaagccgaccgctacttcctcgggcagacactacactggccaaggtcacctgtgacgggcccaaaccctcacctttgacggctttgagcatggtcagtgatcagtggtcactggtgagtccagtcacctttgacgggtggtcggccgtcacaggtgacacccacctctgacgggcaagttactagacagccgtcagaggtgttggtctccgctagcctagggccagttaggacccgtcacaggtgatttacctctgatggccctttaaataaaggccgtcagaggtgatggtctccgtagatagaagttgtcacaggtgatctacctgtgacggccccgaaagtaaaggcccgtcacaggtaggtcaccactgacgggcctttatttgcgagtccgtcacatgtgaggtcacctgtgacggattttggttccgacccgtcactgatgagttaatcacagaaaaaaaataaatcctaaatattggctagcctcaggatttgctagccatgccttctgaaaaacagaaacatcacagatatattccagtcacccccaatataacatcacagatccatcctaaaaattgacatcattcacatatgcagttcaaatgccacaattttgcacatcaaatttatacccattgaaagctataatttcggtcgttgctcatagaaccgcatatatacttaccaaatggattaaagtcataatgtcctcgacctccatgacctgtcaattagaaaaaaaaagcagaaaacaaatgaatagtacaacataaatcgtagttgatcaaatttgatgacaaattagcgaactaccataaatattgcacatatgaaagtaaattacattgcactccataataaaaacaatttttttatatcacaataaattatctagccaagttcatgagtctatttgacgtgaaaacgtcatttcttgttcattatttctgcaagaatgaaggcgcacacttcgcctctgatagcgggggggttgatgggtgagatcttgaagccagctctacctttctgtttaataaatcagatgttttcacatttagaatagcaatattggtattgaaatgagcttattcgccattagtaacaatctcagggtcgaaatctttcacctctcttagtagtgttgacatgttgtgcacacgtggaaaccacactggtctctgatctgttgtgcgcatgcaaacttagtgtcataatagagttcgtccttgccctccttgtgcctaccacccttttccacatatgggtcccaagccatatttaaggccttggtgatatcagtgaaatcataatctttcgtcttattggagttaaggtagtaaaccctactccacttaggtacgatgactaagagaatccaatgtcgcctgcgcagtggttatgtagcgttagtaataagaaccttaacttcaaaaacaatatacacgaagggtattatcctcttattcctggttgtgtgcgcacatgatgtactccttgtcttggtgggcccataaacatcggttgacatagtcaaccacatcagtgaagctctggcgtaaattgacctcgttcaccatggatggatcaaggaacccaacctatttaccatggcaacgactctcgatccaacacaacctaaaaacatttacgtattagaactaatttaattaggagatatagtccaatcatatcacaagtatggaaggtcagcacttacaaggagtagcattttagaagtcctgtgtccaacttccggatcctgaaaaggttggagaggtcatcaaagcctatagttacataggcaggcgacgataggaacggctggtggttgtgatgtccaactatggatgactccctcatttttcgctaggcattgcttagctccatgtattgcttatgtagctctcggcaagtaatacccatcacggctaacacattgtccttcaccaatggcatgcctagctcaaattgggcaggcgccctcacgaccttccccgctttgctctccggcatcgacgtcgcagccttgcccctttttggcaccggtgctaactccccgaccttccccttgacgcgttcacgcttctggcccttcacaagtggtggggagctatcggcctttcttgtggtctttattggagccaagctttgagttatatctcccaagtccatatcatctccatcaggagaaggaggtactgacaatgccggtccacggggagcctcaattgatagcttagatttgggaggtgtaagctccgtcggtcgatttggacgagaagtcatcttcacaactatgtcttctttgggccattgtatgaacgtcttgcgcccaacgcccaaagtcatgatttcatcattggggggcatgggcaaccgatagcctgaccaggtgtcctttactgtatcgatggacaccttggcatacccggctagcaggtctgcgccgtggaccttatctgtaaccgagggtttgaaagccatgccctcagcgacttcaggagcgaaagttggtggatcctcgccagtaggacacactgtgctacgccctgcatatgtaaaagtttgaatttaatattggaatgtgtaaatgtttttgattagatatggatcggataacatcaattacctctatgtggtccactgcagctagtggtgcgatcgggagacctggggccggcacctctgtggatgcacaactactcctacgctatgacagactcgcgtcgtgttgtgcacgaggagttggatgcacagcaggtgttgtgcctcggggtatattcatgtcggcgaggacgttgttaaccctttcttccaccctatcttccatgctagcttgtagttcttgaatgacctccaccttaagctcggccttgaaacgagcgtccctctcttcgttggagactttccgtttcctgtattgggagttgtactgcgagagtccgtgctttcagggcacatcgctgccaattccccgagtccggccagtatgttctttggttccgagcgcctttgtgaggatgtcatcttcgcgcctcttcggcacggactcaacctcgctttgtgaagcttgttcaccaaccaaccccaactataaacaacaagagtcgtttatacaaacttctacttcatacgaatggtaattagttaggttaagtagtgaactcaccaattcctgatagacgacgacatcacttttgttctgaaatgtgacagagccgtccgggttgaccttaccccttgcccgcgcccagttgcgagctctgtgttcagggatgtccgaaaacggggcagggacattcgctgctgcagtggcagcatcctcttgggcccatattggctccttgccgatgtaccctgcggtgcccagccgatgcgggtgctcattccgctgttgcagttggtgatgtttctcgcttgattccctaaactcttgggtgttcttcagagagcaaaattcttcccacacctcttcggttatttgagggtaaacatcgaacggcgtatgattgccgggcgggttgacaaactcggtgaagagcttcgacttccaattcttccaagctttgcccatcttatggaatgacttccgcttgagcctatcctttgctttagccttaaatgtgagccatttctccattgccgtccaagctcgctccttctcggcttctgtgaccttgccgatatctttatggaggatcccgaaattcacacgtgccgccagcccgtagcagttagaccatcttccaatgacagtcctcggcgccgtgggcctaccactagcgtcaacctctcttataacttgcgctgtggtcggccatatattttgtgtccggggggtttctactcgatttactcgtacttgtcccacccgatattgacgtatgttcttgctggggcgattctgcagcacacagaaggcaacatatgctaaggggtgctagctaaaatttatgtggtcatgtagtgaaaatttatcctataaattaccatgactttcgggttgttcgaccgccgttgtcgagggatgaccttcggcaacagtctctgtggctgggtttgcttcttcctgtatcctcgcaggtgtcagggaagacgggtttgcgccgggcgttgtcatggtctaatttttccgaaaaagcttataaattttctatcattatactaattagcattatataccatgaaagatatggcctcggttttgctcagaaattatgcatcaattaccactatttgcatgaagggaaaaaaagaggaaatcaactactaggatgaaaaagacccaaagtgtatatagtctcttatcaatccagaaaaaagaacaatcatagataatctgttgttatgcataaaaaaaaggacaagtgtagataatctgttcttatgcataaaaaaagaacaagtgtagataatctgttcttatgcataaaaaaaggacaagtgttgataatctgttcttatgcataagaaaagaacaagtgtagataatctgttcttatgcataaaaaaaagaacaagtctagacagaatgttattgagcattcatcactggccatttagcaataatccatcactgaacaaggggcacaggggcagcaggggcagcaattcatcaaaaaaaaaaggacaagtgtacataaaaaaatgaacaagtctagacataatgttattgagcattcatcactggccatttagcaataatccatcactgaacaaggggcacaggggcagcaattcataaaaaaaagaacaagtgtacataaaaaaatgaacaagtctagacataatgttattgagcattcatcactggccatttagcaataatccatcactgaacaaggggcacaggggcagcagcagcagcaattcatgcatcaaatcgcaataatccatcactgaacaaggggcagcaggggcagcaacagcagcaattcgatcatataacaattctataacagcagcagcaattcgaacaagtgtacataacaaaatgaacaagtgtagataatctgttcttatgcataaaaaaataacactcattctataacagcaacagcagcagcaaattcattctataacaatcatcaaaatcaggcaatcaggggcagcagggcagcaattcatcaaaaaaaaaaaagaacaagtgtatataacaatcattctataacaggagttcattctataacatagggttatataacagcagcagcagcagcaattcatccagtgcatcaaaattcattcaaaatcatataatacaaagaagctaattcatctagtcctgcattcatccgaatcatacacatggatccaaaatcatccatcactgactcaaatcaatccattcatcaggaggaggaggggtggcggcgtacctggtcagggagaactggccgaggagaagaggtctgagaggcgatggcggcgctggtcgccggtcgtcctggatcccggcgttgtggatcccggtgttgtggatcccgatcgtcctggatcccggcgttgtggatcccggcgtcgtggcggccgacgtccgatgtcgtggcggggatggcgtgcggagagggagagcggcgaagacgacgtcgaggttcggcggtgaagacgcgacgtcgaggttcggcgtcgtggagggcggggcggcgccgaggacgaacggtggagagggcgcgcggcgacggtggagaggagggcggagagagtgaggcggcgacggtggagaggagggcggtgaggacggcggtctcgatggacggagatggcggagatggcggtggagaggagggcggagagggcgagcggcggcggtggagaggagggcggcggtcgagagagtgagtgagagtgagagagagtggtggtcgatctggatctagaagaggtccaaccctaggtcaaccctaggtaaaactcttgtccgactagccattactagccttaagcttcatgagttccaacacgcatgacaacttgctgtgcttcgacttgcatccatcatacaagggcatccgacaatcttccgccaacttactaaacttctcaaaatctctgtcgttatcctctgcgtcttcaatgtcatgcaacattgtagatagacattgagtgtccaaatctatggtctctccacctaacggagaaggtacaaacatgccttctcgagctgcggcggtgttctctacatccagatccaacacttcttcagctgcgacatccggcgcctcttgctctccatgcttagtccagcaggtatatttcttcatgaatccattcgttatcaaatgagaatgcacttttgagctatcaaggatcatcttttcattcctacagtccttacatggacacaatatgtacatgctcatcctactttttctgtcattctccgcaaatgtgacaaatttagtgaccccctctctatactctgtagacgaacgatgaatatggtacatccaactgcgatccatctgaaatcaacaacataggaagaaaaatatatgatgattgatatattgagaatgaagggaagaataatgtgttttttaccttgaattttagcaaaaattcaccctcttgccctcccaaccgatttgtgaacagtgaactggtcgggatggaaagcagttggcggtttggagagtatttatagacccaacacaccttaaacgggttaggtaaaaaaagcccgtcaaaggtattggtcatacctttgacaggcttcgattgagttgcccgtcactggtatcctctcacctgtgacgggccggtccggcccgtcacaggtgaggggataccagtgacgggttggaagcaaaactcgtcactggtatacctatgacggcttttccttccggcccgtcacaggtgaggggataccaatgacgggttggaagcaaaactcgtcactggtatacctatgacggcttttccttccggcccgtcacaggtgatgggatacctatgacgggtcgcggccgaattccccaccgataacggcaaaactagcgacccgtcaaaggtgacggtcatctctgaccagttcataggcccatcagaggtatgccgtcacagatgtccaccggcgcactgacgttgtacggcttgccgtcgccgatctggagatgaacagctaggaagccgggaagccggtgaggttgttgtatatatgtagctgatgctcgcagccataatggcgtcttccgagaccagaccatcggacacgtttgtgtaggccttggagctgatggggttgacgtcgatgcccacatggttgctgctctgatccaacaggagattgaggaacgtgtcgaactccatgggcaaacctgtctaaaacaaatatttctatttccatgtccttcaaatataataaaataatatcgtgggtgtccagcagctaatattaccaaaaggtagaacggctcactctcgatttaaaataccaatctacattgacgaaaacagtatttgcaatgtaaaatgaggaaccatgctatctgtttacacccaaatttgacacctaggattgaaatagaaaagattgccaaagtttggagctatgtcggtttcctccagagagggccggtcagaccgcaggtatgtgggcggtctgaccgcaggtatgtggccggtcagaccgtcagagtctaagcccgagtatgttttcatcgggtcttgtgttttcttgcttgggaaggcatgtttcgggtttactttggtttctatcccgagttggacatggaggagggtctgtaaagggcaagaccaacccctatttaagggataagaccggttcaattgtaacccaatctacttgaatcgttcttttactatgttttctattttaccctagttttagtccatctttgtcggtttacgccgtaaaccgtccgccgccactacgagagtgcgacacttctttgtagatttgttctgaaaaccttccgtttgcccacgagacaggtagttatcctcatatcgatctaaatcggcctagaggctgattttgatctctaaatcggcttcgctagccggtttaactgttttctataaaaacccatcttaatttagccttttggctagatcgaggtggttggcgactccatatcaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68367 - DNA, 1172 bp, Oryza sativa
  unsure (1)..(1172): unsure at all n locations
tgggatgtcaaaatgcatcggtaggggagccgttccgccttagagggaagcaaccgcgaaagcgggggtcgacgaagcggaagcgagaatgtcggcttgagtaacgaaaacattggtgagaatccaatgccccgaaaacccaaggtttcctccgcaaggttcgtccacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaggggtacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgccccctcgcaaaagggggtcgcagtgaccaggcccgggcgactgtttaccaaaaacacaggtctccgcaaagtcgtaagaccatgtatgggggctgacgcctgcccatgccggaaggtcaaggaagttggtgaactgatgacagggaagccggcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccctgggattggctttgggcctttcctgcgcagcttaggtggaaggcgaagaaggcccccttccgggggggcccgagccatcagtgagataccactctggaagagctcggattctaaccttgtgtcagacccgcgggccaagggacagtctcaggtagacagtttctatggggcgtaggcctcccaaaaggtaa

SEQ ID NO: 68368 - DNA, 2838 bp, Oryza sativa
ggatttctacaacgatcgcaaacccctcagatagaatctgagaataaaactcagaataaaaaaaattgttgtaatccaataatcgatcttggttaggatgattaaccaaattaatccaaaaattctgctgatacattcgaatcattaaccgtttcacaagtagtgaactaaatttcttgttattagaaccaataatttcgacaagttcggaaccatttaatccataatcatgggcaaacacataaatgtactcctgaaagagtagtgggtagacgaaatattgtctaggaaatttaagtttttctgaataaccctcgaatttttccatttgtatttctacttgaatcagagagagagaaatatttctcggtttatcaaatggtgatacatagtacaatatggtcagaacagggtgttgcattttttaatacaaacccctggggaagaaaaggagtctaatccacggatctttttccgctccttttctatccaatttgtttatgtttgttctaattacaaaagagaacaaatcctttatttttgcaggccaattgctcttttgactttgggatacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataaactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctggttaaatttcactaaggttaaaagtggcaccaatcacgatcgtaaaattgtcatttttttagcatttttatttaaataaataaataaatcttgtatgagagtacaaacaagagggacaaccctaccatttgagcaaagtgtaggcaaaaaacctaatagggagtgaggataaagagacttatccatctacaaattctagatgttcaatggacctttgtcaatggaaatacaatggtaagaaaaaaattagatagaaaaactcaaaaaaataaaggcttatgttggattggcacgacataaatccagtcaaaaataggattaagaaagaggcaaattatttctaaatagttagacaacaagggatactagtgagcctctcctagttttttattcatttagttcttcaattaactcaaagttctttctttttctttaaagaattccgccttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagttgactaattttgattgacagacttgaaagaaaaaaatcctttgaaattttttgagtcgtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggacgaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaa

SEQ ID NO: 68369 - DNA, 5068 bp, Oryza sativa
  unsure (1)..(5068): unsure at all n locations
tatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcagaaaaatctgggacggannnnnnnnnnnnnnnnnnnnnnnnnnnnnnnnnnnnnnnnnnnnnnnnnnnnncacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggtttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctacttaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatga

SEQ ID NO: 68370 - DNA, 7651 bp, Oryza sativa
ttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaaaactacatatagttttttctaccacactttagagtctttctattatattatcttgaatctacatagaatagattactagattgaaatagtagtctaattcaatttcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgtggacttactggatctttagctattcatgcgagaattgatcattggtggggatccgtagagagtcctttttatgaaatatctgagaaagcaaagaaaaaaaaagagagacaggtggtttattgtcccaatagagatgagtattatatgatagcagcaggaaattctttgtccttgaatcggggtattcaggaagaa

SEQ ID NO: 68371 - DNA, 14187 bp, Oryza sativa
gatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattcctttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcataaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctgga

SEQ ID NO: 68372 - DNA, 13915 bp, Oryza sativa
  unsure (1)..(13915): unsure at all n locations
cggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttacccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaattctgcgtatttggaccaattcaaggtgaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgtcttggaacccggcttaattgggagcgggctttgtaataatggacccacccagcaaaaagcattaacgatgcaaaaatcaatgcaccgattgcggtacaatagaagtgtaattcactagttattcccgatgctcgccaaatctgaaaaaaccacgaggttatttggattcatcggaaacccccgcctacatcaccattcaatatttcttgccctacgattggccaaactacctgagcactgggtccaatgtgagtaggatcacttagccatgcttataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcannnnnnnnnnnnnnnnnnnnnnnnnnnnnnnnnnnnnnnnnnnnaccagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttcgtcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagatagatgactaatgtatgca

SEQ ID NO: 68373 - DNA, 13050 bp, Oryza sativa
  unsure (1)..(13050): unsure at all n locations
tgagctatagcccttgtcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttnnnnnnnnnnnnnnnnnnnnnnnnnnnnnnnnnnnnnnnnnnnnnnnnnnnnnncaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaacagcgagaagtctttcatttcagattggactgctatagaatctggacccatcgtagagacgttcaaaaggctcctgatgataagaatcatactttcgcggaactccatggggctatgggcttcaacgcggtagacgttttgttccaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcggg

SEQ ID NO: 68374 - DNA, 12749 bp, Oryza sativa
  unsure (1)..(12749): unsure at all n locations
catatacgtattccaataaggaaggaggattttcaatgcgggatataaaaacatatctctctgtagcacccgtgctaagtactctatggtttggggctttagcaggtttattgatagaaattaatcgattatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccagaaccacctaaggttccgactaaaaaagtgaaataatttaattgaagtaagaagtctccccatntgggagacttcttacttcaattagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatcgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagtt

SEQ ID NO: 68375 - DNA, 3296 bp, Oryza sativa
tgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtattattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaa

SEQ ID NO: 68376 - DNA, 5812 bp, Oryza sativa
  unsure (1)..(5812): unsure at all n locations
tggatcggggcatcctatttagtaaaccatttggaccgatttatcggattgggatattcttgatcggtttggtcggatatgtagaaatctttttcattatcacagtggatcttcacaaaagaagactttgtatcgactaaagtatatacttcgactttcatgcgctagaactttagctcgtaaacataaaagcacggtacgagcttttatgcaatggttgggttcggtatttttagaagaattttttacggaagaagagcaagttttttctttgatgttcgccaaaacaacttacttttctttccgtggatcgcacagtgagcgtatttggtatttggatattctccgtatcaatgatctggtgaatcctcttaattaatcattaaacaaaactaataaactagaaatgattgataaatgatcaaggtaaaactttcacagtttccattctgaaatgttctctgtactataataaatagtaagtgaatcaacttactactaaaaaaattagtagacttcctcttcggaatagaaatagcctatttctacatagggaaagtcgtgtgcaatgaaaaatgcaagcacgatttggggagaggttttttctctattgtaacaaggaataattatctactccatccgactagttccgggttcgagtcccgggcaacccatatggaaactagaaaggagcaatctgagttttgatttttcactcacttcatttacaaaattttttggtttggtaaattttgttgtatggatatacaactgtcggggctggcttggttgacattggtatatagtctatattatactgttaaataacaagccttctattatctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacatcggatggttcggtgttttgatgatccctaccttattgaccgcaacttctgtatttattatcgccttcatcgctgcccctccagtagatattgatggtattcgtgagcctgtttctggttctttactttacggaaacaatattatctctggtgccattattcctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaactgagtttccgtctgggtatgcgtccttggattgctgttgcatattcagctcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcggttccctattcagtgctatgcatggttcttggtaacctctagtttgatcagggaaaccactgaaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68377 - DNA, 7281 bp, Oryza sativa
  unsure (1)..(7281): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaa

SEQ ID NO: 68378 - DNA, 1401 bp, Oryza sativa
ccttttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggg

SEQ ID NO: 68379 - DNA, 1290 bp, Oryza sativa
  unsure (1)..(1290): unsure at all n locations
gaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagac

SEQ ID NO: 68380 - DNA, 12729 bp, Oryza sativa
  unsure (1)..(12729): unsure at all n locations
cggagaggataactgctgaaagcatataagtagtaagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtnnnnnnnnnnnnnnnnnnnnnnnnnnnnnnnnnnnnnnnnnnnnnnnnnnnnnnactgagctctgaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcggcaaataggaaagctacttaggcaggagataggggaattccttaagaaagaaaaaagaataagaacacagatacataacataaaaaaaagaataaataagacgaaattcgacctccccctacatatttaatttcttctcctatacaaaaactagcaagacctactccattggtaattccatcaatgacacccttgtcgaaaaactgcgttagttcggttaatcctcttatacccaaggtaaaggtcctagtatagaaaatatctatataaccgcgattatatgaccaactatatatctttttttttagttgatggaaaaaatactttttcggacccccttttacaaaggaatttattaaatccaaattctgaaaaaaagagtaagcagatccataaaacatatatgctatgaatagaccaaaaatagctagacttacagaagaaattgcattagtgataaattcatatgaatttatggaagaattagaactttcttggaaaaagttgattgagggagttagccactttgataatatggttaattcccctatttcattatcaaaatggattcctatagatccaataaacaaagtacaaagcagtaatataagaagaggaaatagcatagtatttcccggttcatgaggatagacaaaagtgtttttagtccccaatgaagtactaaaggaccctatcctatttcctgtattaacatgaattttggatagattttgtgaaaaaaaagaaactccactcttcgctgttgataaaacgaaatctctattgactcctttagatatcctttttccccataacgatattgaatacaacgaatcctctttagtactactgtaattttgaaaatgaacacgcaaatacccatcaaaagtaagtaaatatatccgaaacatataaaacgcagttaatcctgcagtaaaagaagctattattccaaaaaagggtgaatataaccaactattactaaggatttcatctttggaccagaagcaagcaagaggtggaataccacaaagagaaagggtaccccataaaaaacaagttcttgtaattggaatgtattttcttaaaccacccataagaaccatattctgacttttatctggtgaatatccaacaagaggttccattgaatgaataacagatccggatcccaagaataataaagctttcgaataagcatgagtgatcaaatggaataaagcagcttgataagaacctatcctagagctaacatcatataacccaattgagacattgtagaataggctaagcttcttttaatatctctctgagcaagagctaaagtggctcctaagaaaagtgttagtgtacctattaaagaaatgaaactcattatcaaaggtagggatatgaaaagaggaagaagtcgagctataagaaaaatccccgcagcaaccatagttgctgcgtgtataagagctgaaatgggggtgggtccttccatagcatcgggtaaccatacgtgaagagggaattgtgccgatttcgcaaccgcaccaaggaataataaaaaagcacacaaaatagtaagcaaggagttaatctcattattaggaatccagttattagctattttaaacaaatcccgaaactctaaactacctgttatccaaaaaaaacctagaattcctaataacagaccaaaatcccctacacgattagttacaaaagctttttgacaagcactcgctgcaattggccgtgtaaaccaaaagcctatcaataaataggaacacattcccacaagctcccaaaaaaaataaatttgtatcaaattggaactagtaaccaatcccaacatggaagtattgaaaaaacttatataaacaaaaaatctcaaatatccctcatcgtgagacatataatcatcactataaataagaaccaggattcctacagtagtaattagtattaacataatagaagtaagcgggtcgattaagtatccaaattctaaggaaaaatcattattgacggtccaagaccatagatattgatagatagaacttccatttatttgttgaatagacaggtgaactgagaataccatagctatacttaaaagtaaaacactaggaaaagcccatatgcgacgaagattttttgttgctgttggaacaagaaaaagtccaaaccccattgacataataactggaagtgggagaagagggattacccatgcatattgatatgtatgttccataagaaaagaaattgcaatttttacttgaaaattttacttcaatttttctataaaattgaaaaaagtttccgattcaccaaactaattcttatctatttctgaaggaataaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatatttttttgtattaaaatgaagcagctcccttgtttcgtaactcaaattgattggaattcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaaaatatataatatgttaaaaaactcttgtcttatccgcattagacaaaatgaagtaaaaaagaattcagaatttcaatatcttttagtatctaagtataaatactaagaaaaagaagaaagatggattgatttgcggcaatagatgtctttcacatacaactagaaaaaagtaatttcctttttgaatggcagttccaaaaaaacgtacttcgatgtcaaaaaagcgtattcgtaaaaatctttggaagaaaaagacttatttttccatagtacaatcttattctttagcaaaatcaagatcattttctggcgtcagcgagcatccaaaaccaaagggtttttctcggcaacaaacaaataatagggttttgggataatatgaattgacctatcccccaaaaattccaattatttaatatgaataattaggaataattaggattaattaatgagtttacttttatgtgtcgaattcctcggtacaatattcttagaacaaacctctctgatatataaaaaaagggtttttggtatactgtgacctaaatattcttttcctatcaatgaacttttcgtaatagaatccgtataataaataaaaaaaggggattctattatgaaaagtagagtattcctgcaataagacttacaacttctacctatcttatcctaaattaacaaaaaaattagttctatattgcaactgagaaaaaattgttccaactctttcaaagtttctattgggcaaagcaagaatttttttgttaaaaaattcgcaacgatactaccaaacgaagtctattttaatgaagattctaatgtcctaaattctatggaatcttccaatctcgacgattcgcgagaaaataacttaatattcttttaataaacctgttatttcaacttagccgccatggtgaaattggtagacacgctgctcttaggaagcagtgctcaagcatctcggttcgagtccgagtggcggcagtctcgaaaaagaatacaatagattataaaataaaatggattcaattcgaaatttccaattttgtaatgggaccttctccttatgctatttgcaactttagaacatatactaactcatatttctttctcaacaatttcaattgtgattacgattcatttaataaccttattagttcgtgaacttgggggattgcgtgattcgtcagaaaaaggaatgatagccacttttttctgtataacaggattcttagtttctcgttgggcttcttcgggacattttccattaagtaatttatatgagtcattgatcttcctttcatgggctctgtatattcttcatatgattcctaagatacagaactctaaaaatgatttaagcacaataactacgccgagtactattttaacgcaaggctttgccacgtcgggtcttttaactgaaatgcatcaatccacaatactagtacctgctctacaatctcagtggttaatgatgcatgtcagtatgatgttactaagctatgcgactcttttgtgcggatccttattatccgccgctcttctaatgattagatttcgaaagaatttagatttcttttcgaaaaagaagaaaaatgttttaagcaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatttgcaatttatttacatagtagaacaaatccaaattggaagggtacgaagtcagcatttgtagcttccataggatttcttataatttggatctgttattttggtatcaatctattaggaataggtttacatagttatggttcatttacattacccatctaaatgattacataacataaaaccttaatgaaatggaaaaaacttccatttttgtgtttgatttgagaaccccttgaacgccttctcaaagggttctcaaaaattcgagatagatctaattagactcttttacttttttctgaatttttgagtatttccactatggaatatagagcggactagtagaagaaaaaaaatcctatttaggataataattggataacagagcctctaccctgtcaacggatagcgagagaacaaaatctggataaataccgattcctattactggtaaaaagatacagattaaaagaaagagttctcgcgggccggaatcctcaaaattttcgtttggaacatgaaatagcttgtatccatagaacatctgtcgtaacatagataataaataaataggagttaatatcattccaattgccattacaaaagtaattagcatttttggcattaacagaaattttggactagtaattagtccaaaaaatactactaattccgcaacaaaaccactcattcctggtaaggcaagagaagccattgaaaagctactaaacatggtaaaaatttttggcattgggatagaaacccctcccagttcttcgagataaacaaggcgcattctatcacaagccgttcccgctaagaaaaaaagtgtagccccaataaatccatgggataatatttgtaaaatagctccattgagtccaatgttggttatggaaccaattcctataataatgaaacccatgtgagagacggaggagtaggctattctttttttgaaattgcgttggccaagagaagttgaagctgcatagattatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaatttgacagcataagcaataaggaagccaaaataaaatagtatttccaatgttgcagggtatgattgattaattaatctttccaaatctaatcttggttcgttggaaccgtataagcccatacctagaactccgattaagaaaaaaatggaaccacctgcagtatacaaaataaactttgtagctgaatagagacgcctcttccccccccacatggataaaagtaagtaaacaggaattaattctaactcccacatgataaaaaaaagtaaaaggtctcgcgaagaaaataatcctatttgaccgctatacattgctagcatcangaaatagaataatcgggaattccgggtaaccggccaagctgctaaagtagctaaagtagtcataaatcctgtcaataaaatagatcctaatgaaagtccatcgatnccccaatctccagtggaaattgaagacatctatccatttagaatcctcttttaattggattaagggatcctccaattggaaatgataacagaatgcataagtcattagaaggaattctaataaacaaatagacatagtataccacctaacgattttgttcccctatgaggtaaaaagaaaattaatgaacccgcaaatatcggcaaaacaacaagtattgttaaccaaggaaaagaactcatgataaagtgataaagacaagatacgttttgaccagaaaagcccgtgctcgattattttgagcacaggcttcttcggtaaagaggaatcagacgattcaagtggaattttttgtaacgtatcaataagatagagccatgctgcgggttgtctcaggtcctaaataaacgcggacacttaaaaaatctgttgggcaggcggattcgcatctcttacaacccacacaatcttcggttcttggcgcggaagcaatttgcttggctttacatccatcccaaggtatcatttctaatacatctgttggacaagctcgtacacattgagtgcatcctatacatgtatcataaatttttacggaatgtgacattgggtctataaattttccttttcaacataaaaattttcgatctggtcaaaatgaaattagtactatatcaatcaaatgtattgtagacaccagacgaagcaatggtttatccaaacttcaacaaataatgcaatatatttcttaatccgtttgtgagaaagcatgaaaagagccaagagactttaattttgggcttcaacaatcataattatacgaattgtatatacgaattcgaattagccaataaattggctatcgtcttttcaatataaattattgcaatattcaaattgcaatatcaatgaattgcaaaaattcaactaagtaaaaaagaatactatggaataacctactcaaaaaatagatattctcaaataataaatagtattcatgttactatttcatattattattatatgtgtccctttgtttagaagattctatgtctaattattcaaaaaattagattgattgatacgagttgatttcctattacgatggatggaagaaagaatggataatccaatagctgcttcagcagccgcaagggctataacaaaaattgcgaaaatgtctccttttaattggcggctatcaaatagatcagaaaatgttacgagatttagattaattgaattcagtataagttcaaggcatattagagctctaaccatgtttcggcttgtgatcaatccatagataccaatcgaaaataaatagacactcaaaaaaagtacatgctcaaacatcattaactaactccttatcaatctcgattcatttcaatatggggacaagaattgaaccgattgaattaattagaatagaacaattacacaacaaaagagaaaagaaggtatttgttggcagtagatgagttttactaaatcaaaattgtggttctttagtgatttattttagatttgaaattcttataattttgactcattctaagtatttcttattgccgagccatagtaattgcacctattaaagaaactagaagaattatggaaatgagttcaaatggaagataaaaatcggttgctaaatgaatcccaatttgttgaacgttatttatgagaccctgttctactatttggtttgatcttgtagtccaaagaattccataccatgacgtatctgggatagtagtcattagtgaaaaaggaatagttatacaaacgagtgaagtgaacccatctccaatagtccaaaaattcttatctttagaccattctgagccatttacgaacattacggcaaatatgatcaagacatttatagctcccacataaataagaagttgtgccacagctacaaagtaggaattcaataaaatatagaataaggatatacaaacaagaactaatcctagcgaaaaagcagaaaaagttgggttggtaagtaataccacccctagaccccctagtagaagaacaaatcccccaaatagcacaagaatttcatgtattggcccaggtaaatccattatggataagaagaaattaatagtataaattttttcatgaactgactaaaactaaaagattcaaggaagaaaaaagggattaggaaatttttttgtatattgtatataagttctttctatagttagaaatcacatcacgaaaatctactctggtttaaaatcaggaataatttgcaataagcagtaggtattcgtttttctttctagttagtaaagaacttttggattctaacaaaaaaattctagtaatcagtaatcgttcttgaattccaagatttttcttcgtctattttactttgagttgaattcctaattgtttgaattgtgtaatctcccattatggagattggtaaccgactcaaagcaatttgattgtaattcaattcatgacgatcataagtagaaagttcatattcttcagtcattgataaacagtttgtcggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccggaaacgctccgatgtaattgatttttcataggggtagtgaatcgttataggtaaacgatttgtgtgggataaggtaattatgaaactttgaccaatgtaccttgctgcgcgtattgtttgttgaccataactcatgaacccagttaccatagggaacatattcgaaatatctatgaaaaaggtatgtttctttctcttgtttgagaggacttttgtgttgaaaatattcttactgttattgtattatcttattttatagtgaaacaagttgggaagaagttgttaataagagattgcccagggaaataggtaaaagaaatttccatccaagatttaataactgatccattctcatcctgggtaaagtccatct

SEQ ID NO: 68381 - DNA, 2636 bp, Oryza sativa
cctgctactaattcttcctccgcttctggtaaatcaaagggtaatctttcacattccgccaaagaagaaattagaaaaaccagaaaacctataggctgacgccaaagattccatccaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactgtttcatttcgttattatcttcttgggcgtagttagaattatctaagataaaatcgatttcaacgtcctaaattagaccaaaggaattctgtctgctagaataataaaaaacgcttcggaattcatctcatcctttataatataatggtactttttctttgttcagcaataacttaatcttggaataaaacactcgttataacaattaataaacgaaaagagttgggtattagttcatgaagaattctgtatgaatatggataaacgacggaaagaataaataaagatctttttttttgtattgcattccatatcttttgtcctattcttctttccccgaggggtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcgggaatcccttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaagatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtacttctattgtgattcccagtaagagggtcaaaatgggtagaatccatatcagtccatagacttcttttataattccaagttcgaaaaagaattgatagcttctacctgtaccctgtctattatcatttcaacgatcaacttctcccataatgatatctatactacctaatatcgtcatgatatcagccaatttcatttttttgactagctgaggaagaatttgcaaattaataaaaccgggtggacgaattttccatctccaggggaaaagactatcatctcctaccagataaattcctaattcaccttttggggcttccactcttgcataaagctcttgttttgacaattcaaaattgggtgaaggttttttaccaagaaatcgatattcaaaatcattccattcggaattctttgctttcttaaagcgtcggacttctaaattctcataagggcccccaggaattttttctacagcctgttgaataattttgatggattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgatattcaataactcctcgtaaaaaataatcacagaaatctaaacatttatcgatccatccataaggcagatcggcagcaactcctccgatgcgaaagtaattatgcatcattcgcatacctgtagcagcttcaaatagatcatatattaattctctctctctaaaaatataaaaaaaaggagtctgcgcaccgagatctgccataaaaggtccaagccataacaagtgagaagctatacggctcaattctaacataattaccctaatatagctggctctttggggtatttgaatattctccaagaatt

SEQ ID NO: 68382 - DNA, 1960 bp, Oryza sativa
gggtagttttattttcacctaatggcatgtgttatgaggcattggttcatttggagtattattgtacaaataatcaagccgaatacaatgctttattgttcggcttacaagttatggagatggttggagctaagtacgtggaaacttttggtgattcggaattggtggtgcaacaagtcgccggagtctacaaatgcttggacggatcactaaataggtacctcgactcatgtttggatattattgccaatttcgataattttgctattagacatattgctaggcatgataattctagagcaaatgacttggcacaacaagcatctggttataatgtgaagaagggattatttctgatattagaagagccggtgtttgattttaaatcttcgtgcgaaattggcaaaactggacaccagtggcggtctgaccggcattgcacggcaggtctaaccggtgaccagaggcggtccgaccggccgcatgccgccggtctgaccggcgacccagagcggtctgaccggcctggtgtggccggtctgaccggttctgggcagagcgctagggggcacgtttcgatcaatttggaggccgaattaattgtgaattcggacatttgtgcccaggaagcagaaaaggattggacaattcctttgattcgatatttgaaagatcccacagttaaggttgatcgaaaaattcggcggcaagcattcaaatacacattgcttgatgaggatttatatcgccgaaatatagatggtgtcttgttgaagtgcttagatgaagatcaatctaaagtggctatgggagaggtacatgaaggaatttgtggaactcatcaatcagcccacaagatgaattggttgcttataagagcggggttctattggccgaagatgattgatgattgcttcaaatattatagaggatgcgagtcttgtcaacggttcggcaatgttcaattggcgcccgccgccgtgttacggttcggcaatgttcaattggtgcccgccgccgtgttgaaccccataattaaaccatggccgttccgatggtgggctttggatttcattggtcaaatttatccttcgtcatcaaaggggcataggttcgtgctagttgctacggattacttcaccaagtgggccgaagccgtgcctttgaagaatatgactcatacggaggtaattgactttattttgaagcatattatccatagatttggtattccacaaacattaactacggatcaaggtgcttcttttatgtctaaagaagtgaagaattttgccgaatcttatggtattaaattgttgagttcttctccttactacgctcaggctaatggcaagctgagtcgagtaataaaacattgttgaagttggtaaagaagaagattgaggaatacccaaagagatggcatgaggtgctttctgaagcattgtgggcgcataggatatctaaacatggtgccactaaagtcactccttttgagttggtttatggtcaagaagccgttttaccggtggaggtaaatcttggttctcttcgttatatcaagcaagatgatttgtcaagtgaagattacaagacgttgatgggagacaaccttgatgaagtcatcgacaagcgcttgaaggcattggaagagatagagaaagagaagaagagggtggccaaggcgtacaacaagagggtgaaagcaaagttgtttcaagttggagacttggtttggaagacaattttgcctttgggtactcgatccaaggagttcggtaagtggtctcctagttgggagggtccttatcgagtgtgcggcattgttcgagggaacgcatactttttggagacacttcaaggggagcattttcagcgagcaatcaacgggaaatacttgaagaaatacttcccgagcgtttggcaagacgcttaggaggtactatggccggtaattgga

SEQ ID NO: 68383 - DNA, 16815 bp, Oryza sativa
caaccgggactaaagatattagaggggtttgacatcacctaccgttttttaaccgggactaaagatcaaaaagtagctctaaccttttcaaccgggactaaagataatctttagtcccggtttttattgcaaccgggactattgtggaagttggtcgaccgaccaaagatggtttctccaccagtgatatgtgcgtcagagaaaaatgaacacattttttcccattgaatcatctccgatctgctggcttccaccttgtgataaacatatgtgcgtgatagattacctcggcttccaccatctacgatctgccgtcactcccttcctcatcgtcactctcttctttcttccttacccctcttacgacgaggtatgtcggcatgtatgatgaagatgaggtggggggaggaagaggaggaaggggtgtgtggcactgtaggcgacggggatggataagagcaacgccgacatgggcaaggaggaggagaacccgttatgtggtgcatcgaggcctgaggaccctctcgatctggcagcaacattactctatggcgcttgatctggcgcaacagtgctcgatccggaaggatgaaagatggtggaggatggggaggaggggaggaggaggaggcgacggggactaggaggggagcgaaggggatggtggagaaggagacgaggtagcgaggggcgacaggaaaataaggcggcggcggtagcgcacgagaggataggggtaaaatgaaaatttttaactttttctccatgtacgtggaaggactagaaacaaatagaaaattcttaaagggacaaaacgatatttttccaactataggatctaatggcttagaactcgcagagaagaaatcagacggtatatatttatttgatgatgtggagcattatccttctagaaagcttgttgctttcatctataataaggatttgcaaaacatgtaactattttgatgacgtgatgcaagtagtatttctacaaaatggatttggcattgaacgtactgttttaacctaactgttatggagtttcaagttaaaaccttgccacaaaagttggcccgccagttacaaagttagttagtacttcaactgagtaatttgcgttggatttatggagaacatggttcgtcctccaatggatcaactccaacatcttgtccttttacctcttcagctcgatcggccagctaagtggcaagtttgtttcctgttgtattccatattgctactgtatgatcatagtcgaataggaaagaaaaaagtacttttttcatcaacatcacgaataggtacgaagcaatgtctcttgccgacggcctaagaagtagcggacagctgcaagacaagccagctttgcctagaaactatattttttgccaccccagtatttgtttggctgctgcaatctcccacatatctatcatttatatatacccttcatgtgcatgaagtatgttgttaataaaacccggaactcttgatgttgctttccattttgtcgttcaaagtcagttaatttgctatatagttgtgcacggacatgtcgatcgtctgtgcacctctgcttgtgcgcgcgcctatttgctgttaggttttacatggagtgatttcacacgtgtgacgaactgacaatgtgggactatgtgacgatggttattatgttttcgttgaaaagttagcaactatcttcagttgcattaggttgagtgtgcattatgagtagaggacaatatatatgcgatgcgtgtgtagaatctatggtaataatccggtgaagtagttgaaaagaactggaacttctctactaaaaagagataggagattgcaatcatctacaacataacgaagcattgccgtcaacctcagctcccttgtttttattcttcctaattaactcagttgtacgaaaatagaatagtccagaaatatcatgccttgtccagttacatttgtaggatctgctggctaccctagcgcgtagtgaggaaggcttgaggttgagcagaaggtctctaacaagatgatggtgaactagaacatatcccctcaatgctaggcgctaacttcattcccttactgcctcctattttcattatgttctccatcactgaaataactgcccagatgtggctgttgcaagtacacacaaggaaatatactttactcatggcattggttggtaggatgctcggtctccaaaaattaatccacacaccacgaccacatatagagatctatattatgcaccgagagcatgtactagcactggtgcctgttggctatgcacaaaatcgcgcacccaattgctcgcactgtatgatgtattcctacaaggtgaactgagaaaaatagaggacataaaacaaagtgcagaagaacacaagaatttgggggcaattttgtggggatttcttttattggaataaaaagctacaactcgctacgtgccactcttataattgttaactactattacctggacggattgttgttgctactgttagtggtggctaaatatggtgattagttttgaaacgcataatgccatagactaagcattaactcattaattatgaattttctatttcgagaagtaatttttttaaaaaatgctatattggtagtccaagatggataactccatatatattttgattctaaattacggcatgttatagattgaagcaatgatctatgtccggtacaattagctaattagtaatgctagatgtatgaaccaaattatagggctgagtacgcacacgttatgagtaagtatgtttatactttatttaaaaaataaagtgctaaattaagagcccacgacacgaaataactccatattgatgaatttaatattttagaaaaaaaaatctaaactgtcgacgataccccctcggcacattgtattgaacacaaactctttataggacatacgataataaaattataatccaactaatgaagggccaactatttttggagttttctacatctctccgttgcacatgctaatattaatggtgacattataaatataggaattttgatattgttttaaaatttaaattatcttagagtgtcaattttagtatttttattaacgtacatgctagttgggcactgtaccaaacagctcattacgtagaaaaacaatcaacaaattataaaacaccgaaaaatacagaacaacacacaccagacttgcggggccacagcaggcttcccttcgtcattgtctggccagtggaggaaaacaaatcaaaactctaggaaagatcgaaataagaagctacctcaaaagacgtaccagtgttgtatctgtaaaaaatcaatctttttgattgaggaaaaaatagcaaggaggagaggtctcgatgtggtcgccacagctcgtgttggtgcagtcccacatctagatcgaaggcaggcttcatgggctttcaaaggtagattagttggccaatgacgttaaatcactatagatttatggtgcagattttgtaatccatctaaacgataggtcagatttttcttgttaacatgagggctcgtagaaagtaatcaataataaaggtatagacttgtatatagagtacatggaagttttacgatcgtgcaatcccacgacctccaacaactcatttagccgattattactttcagtgtatttacttggtgcgcatgaaatggttgtattgttaggctattgcaaacattgattggattaggaccaatgagatgaataacattaattagtgaccctactgcacaaaggtggacaatgtgccaagatggagaggggccagccaaagatggcacctgtcgtttaactgtccgaccttgttgacggacagttaaatatattatttattaattattgtggcctatattaaaagaagagtttggcatcaccaacacttctcttataatagtgtagtggtatatgatagatcatagataccactacactaggaaggtaaaatgcctgatgtattaaaacaactccctatggaatggaagaacaaagaaaaaagccttttagttggcttggccataaaagaatttgcctcgcttcgattggacctaaagcagttataaacctcaaccgagccaagaggaaacacaaatcaagccaaatgtgtcatccagatggtaacacaattatgaatgtacatgtgcaaatagtatctatacctgcacgctgtctactgtgcaaaaggaataaacctccaccagatgatcaacaacaaaagaaccacttgctgaaacacatgttccaatccacactcgttcacaatacaatattacggctacaggattcaatccaatccacacatgttccaatgaagttgtgttgttcttgctgaatccctcccatctcaaaagtaaacttctccaatctgcggattgctgcagtaaccacctactggatcgcgttacattcgaccatggtgtcatatcactcaatgcttgagtaggaattacctactggatgattatgttataaaaattgtctttcatatagacttgactagctgaattcggaagaacaccataagagaagaattctttgtactcgggattggctgacatcctcagtgtatttgggaatgtccatgattaaagattaatttggttttcaatttgctgtccaaatcatcctcattatctcgagtgcaccatattcagcctcgatgctggcttgatctgacccaaacaacttatgcggaggcttgaaaaacccaagcatgtccccagctgccatctgccacgtccacatatgaggtgaaagaatgaagttacggtctaattgtcctactaaggctccacataaaggcagtataattcaagtgaatttctactgcattacattgagatatcctaattatgggttttccttcctatatgcctcccattcttattacggtcatttctactaaaatactagtgggtacagttcacagttttattgacgatcgagcatggattgagaatttgaggtcgcgaatacttgtggccaagatatactacatggcagagtatatatatatatatatgcagaaattgctagctgcagtataattccaactgacatcaagctgtcaatgcttaccccattttgctgttgtacggtcgtgcagccgccgatcacgtgtcatgtattatagcccattatgtttggaatcactcccccactctactaacaaaatgtaaagtacaatacaacatattctctacgtacatacgaataaagtaaacctgcaaggttcgcattgctctagcccagtgcgactctgacagcccctaaagctgtctgaggtcgcccttcttcctgaggcagctaccggcaaagctggatgcctagaaggacagcggcggcgtggctccttcttctcccgacagtgaagccatggttgggttccaaggcagtctggagaatggacgtcacgccacccagatccagacctccatgacggacttcccaagtgccattagacataactgaggtcacctcacttagatactgcttccttccaatagtcagcatcaatagatgaatatgtctcttgtatggtttgtagtatcgtccacaaggtatacaatgtagtcatcatcgagtagcaacagtgtgatcctccttaggattttctatggacgtttgaacatcgtgttctatcagcacaaaagacacggggaataaaatagattcttgactagaagtgttaggtgtattcattttcaaaaaatatagtaccatatctttactaaaaaattttttacaaacatgcatgtcaggttctcttgaattcgaaattaagaatctatatactatgatgtgaatagcataaccaagaaacacacaatccacgggttttggtccaaatttatgctttttgactataggcacattgaccatagccaaacaaccccatataatctttgttcttattaggaattttattcagcacatgatacacaatcaatatagtctcaccccaccattccttaaaaagtcccgtagtgtcaaacatgacattcactaattcagttagactatgattctttcttttagcaaccccattagattggcgtgaatagggaggcatatcctatcatgaataattccagacttttcacggaatgaagtaagctcattttaaaaatacactccacctcaatcatacctcaaccgtttaattttactttcaagttggttttctaccccagctttatagattttaaagtaattcaatgtttcatcttttgtaaaatctagtgcaataatctcttaatctgacgagaggatgactacaaactcataatgctgaagtaaaaggctatgatgcatagtgtaggatttattcaattaactagctagcagccaaaaataagatttttggcacatgtttccagtgcccactcgtaggcattttgaacccaaacgactaataatacacaggttggacaaaattgatgcagtcaggaaggccctatttctccacgaaaagctaggacttggataggaattaatctgcgtatgcacaaggtactcttctttcggatggccaagacgacatgatcttgggagattacacattgaagctactgtgtctagatgaaccaatgtccctttatttgttcttccttacatttgatcggattggtaactcttggatttctttcctatgtacgtacacacacgtcccagtcttatgagagccattaatttctaaaatacaagcgggaactgattattgttgtaccgatggtatttgaggatgaattgagataatgaggtgttgaatatttgagaatctcgaagaagtgctttggcagagtatagacttcaaatttttgtactcaaacatagaagcatattgaagctgatctccttgtggtttaagtgggcttatctagtagccagtcgcacgatgactatattggaatccttgcatctatatgtcagatcctatctgtgtagattgtccatattgttactgaccttgccggagctcgtctgtgatataggcaacaacttgcaggttctgaagatgtcgctcgttgccgaacgatgaacaacagcttcagcttaatcaaggcacgccggtgacgttgtcttcaaggagattcacgccctcgccgaggtgcacgagacagacggcggctttcctccaagatacaatgatctcgtatcctcacccgtgcaatcggccaagaacgaaccaatggaatttcgtgggatgtaactctctctatgcaaaataagcagaaggatgtagagcaaaagcttcgtgtggtaatatcagcagcagtacgtgccttatatagccttgaatagcaacaagaaaatcctatctctaagccggataacaaacaatcaacagattgattttcgtcggcctgaatatctggaatgataaagactttatcttccacgtacagctcaaaacaacaatatcaaaacttgaaaccaaaatctgaacataaggcaaaagttcacatatgtccatttgaactaaactgaagaattgttggtacaaaatgaacagaaccaaagagacaaaatctgaacaaacatcaaacatcgtttgtgactttcattcagttataatcagaaggaaaatcacctgaattccaacagaccttaggcatgcgccgtgcaacaccactgttaaatcactaactgttacgtaccgtaaaatgacatagttaggcatatgctaattaatctgcctaactgtaatttaaatggctggatagaaagcagagctaaagctacaacaactataaggaagcccaaaaccttgcaccaaatctgtactccagacagtacaccgactgaagtatgcatgtcaatcctatcatgatatccaagctatcaaaacagaagcaataaacttcctatgatcgtcatgaatgaaagaatcagaatgaaatttaagaatatggtggctagctcatacacagcatgtttaaattgaagatcgtaaccgatatcctttgtgcatttggttggtccgatacataagaaggatcttacatattgtcatttgattattttggaggaacaacggattccttcttgtagactcataggtaagctgtaaaaagcgccatgatgttcaatcagatgacatcataacgtaaagaaaacaatatgataggttaaaaattatgattggatcatccacaacaacctcacaacacaaaccttatgtgctgcaaatccccctggtgttgcttgcgatagcatgttgtggcccaaggatttaagtcaacctagtcgtggtgagcacgtggtattgttttccttcaagagtcctcctattcctattgcagttcctaccttcattttagaagtgtgaattcattgtttcttgtcatgagtgcattgaaaaattgggatggtgagggctcgaacaatgtagaagttgtgtcggggtatatataaagaatggcaatgaattgaacaagatagaattcaataccatataacaataatgatactggattggcacaccggaaattcacaacggccagactcgaagtctcttttaaggcatgatgggaaatatttgtttgtattactatgatttaataacaatgtttgctagccactgaagcatgggtcatgatacagcagttaatataacagccattttatgtcaaagttttgtctttgtctatctctgataagcactcagcagacgggagggggataccgaggttggaagtagggccttggcctgaggaattggactagatggttctcttaggccttgttcggttgggctgttccaggccgggatcggggcccaatccctgtggatcaccccggcgaggaaaaaatcccggcccatgcgaaattgtgcgttcggttaagccctgccgtgaattttagcccggcccaccacggggtttccctcttctctaggcccgggaaaaaatcatctactcctggggtgtggaaaatttcctcgagaggaggcagcggcgtaacgaaaaccccacgaaggggcggcgcccggcgcgacccggaggcgacggcgacggcgacggcgacgacatggctctctcctccggccgccaccttctctccggtgagcacgctgcctttccccttcttccctcctcttgcaaagctagggttagggttttcttctcttctccctttcctgtcgtccccgccatctctcttctcgccgtgcagctttctggtgagtgagcgcttagcgattcatcgtcctcctcctcgtatcctgctcgatctggtgagttcttgatttgggcgtggagctttttttcttggttgggtggggatgcgttcttgatttgccgccgccaccgcaccgcccaactctggttcttgatttgagttcttgattcacggtggctttgaggcagcagatggtgagagcgagagctgtacggtggctatggaaacatgcttgccttgattagttttgcttagtgtaactgatgctgtgatgcttgcctgagcatgtcttgtaaaattgactatacaagtttttacagtgaagtactcagttcttggtgcttccggagtctcaacttgtggttgttggttatatttctgtttggaaattacaagggttggggtgtcctgattttgaggattgtagagctatggaggtactctgtaattagtttaacatttctgaattgtaaactaattctatcgtcattgtttcacaaacaaactagcaacaaattgcagtagtatatacagtaatgtatacttaaactgatttattttaaactaacaacagtagcttttagtctcattagactaacagatttgttttcctcaacatgatacttgtataaaacatgtttatcatagctattcaagcactaatatgtctagtgttaaatgaactgattgggtgattaattctgtacccatgttataatgtatttgatgatgagatccttctatttgattgaaaaacagcagctcctactttgatgctagctagctctagttctgggttttatgtaactctagttctagttctgaatttgagttgtcagtgatgtgtataagttgtgcttgttttgtagattgcacttgcacccatgagagttggagaagaccaacctcctccttcctgggaccttgtaccctctccttcctgggaccttgtaccctctccaagaggtactagatctatttattccctttgctttaagttgtttatctatattttgtgatgtaaatataaaaaataaaagaagtggtgtaatgtagaccaaaatttcttttcctttcaacatacggttaaatttgtataaaaaagcatagagaatatacaagttctcagatttttcagatttctgaattctgaacatgctcggtgctaactaataaaagatcatctgtaactaaatttgacaactaaatttggtaagtgctactgccatgtaatctgctttttcatacatcctgtaagtgctactgccatcaattattgttgcactgtgcactctttaagaaaaaaagatccttattgttcttttcatttttcccatcaatttttaaatatgcttcataacttggatcttcttaagattaattcccatagtttagtgattcttgtgtgattatctttctagatcttttgttgctgtgctaagtgcaaaattgtaaataatttgtgtgctatctatagtactactatggatatgagagcaagagaccacgctagaaagaggagggaagaggaggacgatgatatgatgttgtttattttccctgcactacatttgttgagttctagtggagcaagggaaaagaagcgacgccatacatcaaagataacaggcgaggagcgtgttcgggagttgcttgaagggcatgtaaaaaattgccgggtagcattcaggatggagccggaaatatttatatctttggccaattaccttagaactgaaaagttggtcgatgatactaggattaaagttaaagagaagttggcgttcttcttatacatgcttagtcacaatgcttcatttgaggatttgcaagagaaatttgggcacagtggggatagctttcatcatcacgtaaagcatttcttcaactcagttgtcccttcgctctcgaagcggtttctgaagcctccaaatcctaatgaagttcattggaaaatagaaaaagatcctagattttatccctatttcaatatccttattaatatgttgttttacatttttagaaaatcatatgtggtttttttttttgctgcagaattgccttggtgcaattgacggcacccatatacccatatctatatcatctgacaaagcagctccatttagaaataggaaaaatactcttagccaaaatgtgatgatagcttgtgattttgatctgaagatcactttcatgtctactgggtgggaggggtcggctacagtaccccctggaaagttctatttggttgatggtggatatgccaacaccaattctttccttgcaccatatcgtaaagtcaggtatcatctaaaggagtatggggcaggtcggcgtagacctcaaaactacaaagagttatttaaccatcgccatgcggtattgaggaatcatgttgaatggactttgggggttgtaaagaagcgcttccctatcctcaaagttgcaactttccacaaaatcaagaaccaagtgaagataccagtggctgctgcagtgttccataatattatttgatcactgaatggggatgagcaatggttaaataaccaaccacataatatccatccaagcaattatgttgacctgccagatggtgatgaaggcaatgatcaaagcactaatcaagggaatcttttgagggacacgatagcacatcaaatttggaatgactatcgacagcataggaattagtgggttgtaataagtagtatatttgattttcttttgatgttttgtgagctgtaataactacgacatattacaaatattatgttataaatgaactatggtggttgcatgtgacatacatttgctacaatgcttttgttatgaatattgtgttatgcatcctttctcagttaatatgcttctaagaggttctccaaggttgaccatgcttttagcgaaagctgcacaaaagaagaactctccgaaaggtcatcctacaaaaaagcatggaggttctccgataggtatgcaattatagaacatgtgaaattcatgtttgaaattattaaatgtagattatacatcaattcttatcttgcgtagaaaaaagaagagcctcttggaacacagccctagagaagattcttgttgagttattgcatgagcacaacactcctgagtataggggtcagaatggatggacttcagaagcttggaacaaaatcgtgaaggaattccatgagaaggacagatatgtctgcttaacaaagtcccaaatccaagaaaaggagaaagagctaaaaagagaatataggatgctgaaagaggctagaaaacaaagtggagcttcatggaataaccagagatgcatcattgaggctgagcctgctatatagaacaatataatcatcgtaagattatttctgaccattacttaattttgtagttaattacattatgcatctttttagtgttttccttttattgtgttgtcatttcctaaagccaagaagtttcgcaccaaatctttccctctatttgaggccttgggagaactttacgatggttagttctatcacaagctataatccttgttttcaatatcacaagttataatcatgctttcttgcttaccctttctagtactcaattttcttgtgtaggacatactgcagaaggaacctgtcacgcccggaatttctatccaaaattccaaacgcttacatgtgtgtgaaccctcgtccaggaatcagccgagggacacaataacaaattgataatagagtacaattattactctaattaataagcgaataaaatgtcattacagaggtagatagttcgtctcaatcaataaagatctaagcagcggaaaaataagataaacggcacagacgactccactccacaggcagcttgaccagggctacacctaatcctccacaccatcagcatcactgtagaactcttcctctgatgaatgattgcaaggtgagtatataacatactcagcaagccacgcaacaaatatggaagtgcacaaggataccaaagaatggcataatatagggctcatttgcaaaagcagcatttagcaaatatttgagaattataaaacagtagagtaattaatcatcaattttaatcaacactaaacagcacacccatgctgctcaggcccaaccatcctgaacaaccatacccggctgtacagatctatctccaaaccaggaatataccattccaaaccaggagctaaacaaattattaccagttatagcatcttttattatggtgagaagtgtgagactaatcacgaaagacattgttagacccgcccataaccgcgggcacggctattcgaatagttttactctggccagaggtgtaccactgtacccacaagacacagcaccacaacatgtcaccatgtgcctcaataccaccacggtacctcggaaaggagctgtgacagtaaccctcgtacaacacaatccaccacagcgcacctttcctggatcataatcacccccttataaacaaggcatggactccccagcgacccccgtgggcttatctccaccacttctcagtctggtgctccgcaatgaaccatgctatacaaaaggtaaagtcgttgcccacgctggcttgtggttggcacggttaatgtttcacaaccgaaactcgtgaaccggtccttaattgtcatgagcacggctctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaactaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaaggattgtttgggatctgtgtgacttgccttgctggccttggaactcttcaaaatcttctcctgcaaactcagactctccgaaaacgtcggaacctaaacagaaaagagcaaaatcaccaaaacagcacacaaaccagcatgaacagtacatgtagatatttttaacatgtagatctctattttagaaaaatttagagacttgaaccaactaaatccgagctaagatgaattagttatgtgttttcaaagattaaatcggattaaatcattcatttagattttaattgaattatgacgcaataatgaattatttttgaaaaagaaaagggaattattgcgtcagcggctagggttcgcggtggaccgggtgcacggcggcggctcacggaaatgaacggccgagatcgatcctatccaaaacggacggccaagatccatcggtccacgaccgggccacggggaacgacgacgatgacgtcggcggtgacgtcaccaccggcggcggctcgggcgtgcatgcttgccggcgaatgacggcatgacagcgcgaacggagggcacctatgggtagcggacgacacggcgaactcaccggtgaccaaagtagcggcggaggggcaacggacggcgccggcgatgaggaaaagggggcagagacgatcgggtcgacggcggcgacggtgctccggcggttgacaacgacggcgaagggacggacgacgacggcgatgagacggcgaccacgacgatgacctccccgagtgacggcgatgactggagcgacgatggcgcacggctagagcggcggcgacgacggcgacgcgaggctacacggtgctagggttctaccggcggcgagagacgaaggcgagggtggcgacgggtagcggaggacctgggggtgcttatatagggactagggcgcggcggcgaaggcccacggcgaccggcgacgcgatggaaagattagggttcgggagagagagacgaatccgattcgagatcgaatccgcgaatttccaaagcgatttaaacgatgtttccaaaagggaaaaggtagagtggatcacggggatcctttcccctcaattgatttcaccggaaacggaaagggacggccggatttggaaggagatggcggcggcgcgccgctagggctcgggcgatggtgcaaggaggacgacgacgacctgacaggcgggccccacctgtcagcgtccgagggcgctcgcacgcggctgctgcgggcggactgggccggcttgggccgaggagagggagagagaaggttttgggccgactttcgacccaaaggcaaaagagaacttttaaaaccttttccaatttaaattattcatgaaatgaaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaattaaacaacaatttatatatttaggatttttagggtgtgacagaacctacaatttcacctcaattgagccattgcaacattcaatcattactcaagttgagagtgatcaagatgatcttggtaacactgagattatatttccagattatgaggacaccttggcttatcaagtacaagatgatgcagatgcaactgaagatgataatgcaaatgcggaaaggcttaaagagatgccgcatagaagggttgttgttgtaccaagaaacaaagaagaaaaagaacccaagaggcaaaataagagtgttggcgtagaaggacttatggaaaggtaccttgatatgaggaccaaacaaactgaagatgaggctgcacaattagcaagagaaaaggaggctcagttagcaagagaaaaggaggctcatttagcaagagaaaaggaaagtaatgatttttcaatcaagaggtgcatatctgttctgaattcgatggatgtgacaaaggcagaaaaggtcaaagcatataccgtcttcaagaatgcagagaacagagagatttttgtgagtgcttgtgatgaggatccagaatctgccttgagttggttaagaagtgagatggcttgaaaggtaccgcttttcttctatataaatcttttttggtctgctaggcaagtaagatgggcttcactctgtcctgtgtgactctctgttgttagttacatgcatgttgtttagggctgtaaaccaagatttacattatgggctactcacctttcttttattttcttgagctgataagctcactcaagtctgaactgatactactcttagcatctgaaaaagctaaacttaagcagtatagcggtgcaattttacttactttgaagcatctgctttgctcctgataaaagaatgttttttaaggtaccgtgtggctctagttatgtacttcattattctggatttttcacattttggcccttttaaaaaacttatttcgca

SEQ ID NO: 68384 - DNA, 2539 bp, Oryza sativa
  unsure (1)..(2539): unsure at all n locations
aggctggcgccgtccagttggacaatggcgctagccactctggcgccccaaaaaggaccatttctgggataagtttttttaggggtctatttgcgaaataagtttttcaaaaggaccaaaatgtgaaaaatccagcttcattattactatgttgtcaaggctgaattgttagctttttttgttagcttcctagttcctgaacttttaggtctcttttcatctttggttctatcagactgatagcattccatgtagtgcatcagccttagtttggatattagtgtggctctttgctttacttgtttgctcttatgtaatctgtactctgcatttgttcaatttgatatttggttgacaggaaagaacatatatggtgtatttctttttggaattgatccaatgttgctccattttttttcagagatgggaacactgcagctgggtgactgaagctcatggtggcattagtgctaagcttaaacacttgcattcaatttgtagtttagctcttagatggctacttctatttattctaaaaaaaacaactgaactgtaaccatttttattactttgtgacactttcatgtatgcatttgtgaacgtacagcatgcatgtgtgttttccctatgctaaaacaatgttttttttactgcatcctatggatttgatctgggagaatgcatattgtttcattgcttgcttgggaacatacagctgctgctttatatttccctgtgctaaacgaaggcagtgtttatatgccagggattagaaacgggcagggattcgaaccccacagggtttgagtgagataggagggattcactcaatccctccctggataggatcccttggggattaattcccaagcagccgaacaaggcctgagtggtgttagcggctccaacaaccaatgaaaaaaatatggagccgcacttagagccaccggttcttcatgcttaacataagatttaaccggtcttgttatatgtcaacaatagctagcaaaagtaagtagacaataaaaattaaacatcattccttattttgtaaaatattaattgataattagtgcaagtcaaggatgaggacttacgtttccctgtcaaaaaaaatgtttgctgaagctagctagttcaaatggttaaacaaaaaaattcaaaaggtttagcaaaaaaaaaaagaggtcgatatattaacataaaaaactaatggcatcataaagcaccaagcattcatccatggtgctggaaccagatcctctcatgttgggatattgtgtggctgagtcatccgatccgcatcgcagcaaccgagtgaactcagcgactgaacgggctgggctgtagcttggcccacggcaacgaaattaaaatggcccatttgcacacaaataggtgtcgccactataggtgtcggtagtactaaaaccggcacctataggccttttcccacctccgcgggttcaaatcgcaaaaaaccggaacctttaagcaataataggtgtcggttccaaataaaaaccgacacttatttcattttgtgccggtttttttttaaaaaaacattataggtgccagtagtactaaaaccgacacctataagatattataggtgccggtttttaaaaaaaccgacacccaaatcaagccgaaccggcgggccccacaagacgagataaggataaggacgagctagtggcttctcgatctctctctcgtcctcagtttctctctctctctcgcctctctcttctctttctcagtttcccctcctcctctccccatacggcgtcgtcggcggtggcttctcccgcggcggatgcggcggtgggcgaggtggcctcggcggcggccggggtggcgactgctggcggagcagcatccggcgtcggcgtcggcaggcaaagcggtggcggcggtgagtcccgcaatggatccggctcccgcaatggtgattgtttctatgaaattgttgagggatatgtgatttttgattctttcatcagtgatttatgtggaacttctgtgatttgctttgacggatatgtgttggatgaattgatttgtgattctttcatctgtgatttgtgtgaaacttctatgatttgctttgagggatttgtgtgaaatgcaggttgaagggagataactccgctgcccatttgctgagccggccagtaatttccttgccccggagcacttcgcccaaaggatactgcgatggcatagtgactttgtgggcctgaaagtagtgtttaagtttgcacgaagccatcactagggcataagcaagcttttccatttcaatgtatcttatcttcgcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68385 - DNA, 850 bp, Oryza sativa
catcatgcatattgaaacgatgaagaactttttcaatataacctttctgactaagatataacttgccagaatgtctttctctagtaatttccataccgagaattttcttcgctgcacccaaatccttcatctcaaattcactactcaattgtgccttcaactttgctatttctgatttgtcttttgcagctatcaacatatcatcaatataaagaagcaaatatatagctgaaccatcaacaactttgagataaacacagctatcataattggatcttctgaacttctgagaaagcattatatatgaaataataataataataataataataataataacatccagttaagggataagtgtatgatttttacgtaaataaaatattatacatggaaaaaccaaggtgcaaattagttagcgcgccaactggcgcgcggattttctagttcatcctatagctcggcaatataatttgtcatcaaataataaagtatatctcaaaacttgtcgtcgagcttctctatttcacatttaaccagggttttcaaataattaactaaattaagacttcctccaataacacggtatataactcgctactgattcggttgttcttaataactaggaaggtggcccacgcgtatgtgtgggcatccatattatttaaataaaagattatattttgttcataagatatgttttataaattaagggcaactcaaggtcacacgtatctaaaaaaatcattcatcgaaatttgaatagaggatggattaaggtcacatgacttttgaatagactgaataataaaatgctgctaggtaattatcatttctatcatttatacac

SEQ ID NO: 68386 - DNA, 7359 bp, Oryza sativa
acatgtaaagagtgtaacgacaatcaatgctgacacctattaacaattgttatctacccaattagaatatgtcttaattatattcatctcatgactctgactatctttgatcaccttgagtagtagaaaaaattaattgtactacgggtttaggatgggcgaaactaatggattatttgatttttatgatatctatttgagggtataaatgaatgaattaacttctacaaatttgaaatgttgttctggaaaaagcgctttaagaaaaaaaaatagaattgttttcctgaaacacatcatttaggaacatgggaaacatgcaaatgaaaatacaaaatctagatcgaaaggaaaaacagggagtaagactcaacccttagttttagcttacatagagttgcatgttgcaaaaacttaacccactggacttcattattttccttctgcaatagtcgttcaatttgttttcactttattaacaaaacaatcattatccattgatgatttgatgtgtcctcaccttggcaaactggtacggtgtggtgatcatgatcaccttagttgcctcaatctggtgctccgcattgtcgtggcgcacgcatgcatgtgttgtgcagaggaacggagtgatgtttttagaggctttattgtgtttagaaaaatagttctgatggtttattatctatcagtttaaatgaaaatcgatagccaaatattttagcaacaatatagtctcaaatattgggtccagttgttggtttaggtataaattagtcgatatagattataaattgttaatttaataggtataaaatataatggtgtaaaattcaaacaattttttatttgaaaaaaattagtccaccagtttaagtaaaaaaatttatcttatattattaatttaatgggttaaaagtatattttttaaaactttacatttaaacattgtagagctaatttttagttatatttatttgtaaagagttaatttatgatgatatatatagtctatgtttgtaaaattataattatttcaaatttattatcactaatataactgttttctcacatgtacatggagaaaggtggaaaggagagagaagcagatgtatttttttaattgatgtatataatttttgtttttatgttttttgtctttaatcttcttttattgatagtgcgttacttacgtactttgtattttgggttttttttttacgatcagtactttcgtgaacaggagattataagatggtagttttttaaatagatctaatctaacggtaaataacggatcaccgatttaagtgaaaaatcgaggattaggtgttttgcctttctcttagaatttgtaggaatttctttaatttattaagtgccacatgacggtttaaagcatttgtataaaatttaataaacttttagtatgtaatagacaatagatagataaatagataattgaaatatagaatgttaaagagtgttgattggatatcttatatacgatctagtttaaccgcatatatttatagagcgatatattttattttaaaatagtaggaaatcctactttaaagcccatcagattttttaatgacactacgtacgtattttttttctttattttatcgcttttatacttagttttttcttctcatccggtgaagagtagataattaagcttcatcgtttttatttccgatgtacgtacgtactgaatactttcctttttcttttccgtcccacatgcggaaactattactttttaaaataatacatctaatcgaatggtctataatattgggtccaccaattttaatgaaaattaacggtgagattaaatagtgccacgtggcgatataggagtgtttgtaggagcgccacatggcggcttaagagtgtttgtaggaaatctaatagacttttagtatataatagatagatagatagatagattgatagatctctgtaccgaatctcctaaacctattgacaactcctggaccacaaatacgccgccatcactatatattggatcggcctcatcagcaaagcaatcctctgcctcttttgtacctaccatggccgaaccatcacgttgctccaactttgtgcacagttttattcatgagacaacctatgagaccaccctctcgctatacgccattgctaccggagacatgcatatatactagtggtcagccctgtcacgtgtggatccaaacaatgatgtttacacagtactaccaaaacacacgcatgcaccatgtcaatacattactactaccatgcagttcggcacaaacacaaacgatagacggcgccgaattgatcccctacagactagaagtactccaaatcaccatttgacagcatcggcttctgtattatcataacctttcacctattaacctaataaccagatgtctgttgttccaaataattaacatgccttaaagtttctagcaatttaactaaacctaaacattggtccaaatgactgtttaacaatccatcaaaacactaaaacttcccattaatttattggactattaaaaataaatcaccaaaggctacatccctcacacccatatagaccaaactctacaaaccgaatataaaggcttatacttggcctaaaagtgcaaggatactttaaacagactgaaagggaccgatgtgtcataagcaatattaagcacctagcccaggaggaagatcgaccatgaggggcagcaggatgagcctggtcggggcagcgatgctggcgcagctctacgtggtcgcctcctttcaaggcgcctctggggctaccagcgatggccctccctccagcagtggggcgaggactcccacctccggtgggagccctggtggtagtggtacaaggagctcagcagcatctacaagctctgcaagagccggaagcacccctgcaggagtgcgggggagccccgcgggagctggtggtagccccggcggtggaagcggaagcacccctgtaggaggagggaggagctttgcgggaggtgggagtgccgacgacggcgacgatggaactgggatctcaagcagtgggggaaggatgttaagtagatcgtatgatgttgagcactttttcatttacttcatgcttgttgttttagctgcattttagcaaaaaaaaaattcttattctcaacatgcatatgtatccagtgcgcggaaacagtgaggggccatcaacggtcactcgcattcccaagttcctgtaaaaataaaccatcactacttaaaaaaccctcatagcgactggctcagaggtgtcagtttatttacaactggcacctattaaccttttcctatctattgtgggataaaaaatagagaaccgaatcctttgaacaacgataggtgtcggttctaaagaaaaaccgacatatagactattggtgcccttttactacacattgtctacatcaagatgaactctggtgtcccccgtgctctccttcgcacacttgcccattcttgttggcagtgtcaaatatcgaacccagatagtttacaccacagaagtgagaatttatcctcggctatacctctacatgggttagctgctgctccttccgatggacaataggacaataacattggagatcacaagttgtagatagtactttctgcttgaactgctcatccagcctccattagtggatttgtgttggatttgatacagagtacctagctaggtgtttcgtttacttcctatacgcctcccattcttatcacaatcacatctgatatacgagttggagctgatcatagttgtagcgagatcgatgatcgagaatgatttagaactttgaggtgccgaatgttgggtcctaatgaagtgccattcatagagtatataataaatgtagtattgttacactcacacgtacaagctagtgtgtctaagagctttgctgcacaggttcggtttccccttccctcctcatcttcccttctcatcttctttctctccctcactctctctctccccttcatcttccttctctccctcctcactctctccctcacagatcgggccgtggccccctcccgagcgccggccgctgatgcctccccgcctcccgaccgttggcagccgccgcctccccgcccaccaccggatctggcctacgacgcacagattcggccaccgcggcctctcccccgaccgtcagccgcttccttctccagcaccacatcaccaaccgccggatccggccaccgcagcctctcccccgaccgtcggccacttcctcctccgccaccccaccgccaaccacggatccggccaccgtgacttctccctcgaccgtcggccgcttcttcctgcgctacagcaccgccaaccgccggatccggccaccacgacctctcctcccaccgtcggccgcttcctcctctgccactgcactgccaaccgccagatcctgccttgacaagtttcctacaccaccgcaccgccgccagatggagttatcctttctgatttgtgcccagatgaatatgattgtgatgatttttctgattctgttttgtgcccaaatgattgtgaatgtggagtgattttgttctttggctagatcaatgtgattgcgatgatttttgtgattctgtcttgtatcgaaatgactgtgaatgtgattatttttgtgatttgtgatgcctaatggtctgcgactagctaggcttataatattatatttttttgccccattttcctaccagaggaggcgccgctccagcttcgccctcggaggccgaaggctctgctccctcttcgtctatcatctccccctcgctgctgcgttcctttcgcttggcaactctctccttgacaattttctttgatggcatcaatggtttcgctcactctcagtggtttcgctcggaggtccccacgatcagtgctagttgttgtcgaatgcacaactgcgttacgtcgaaaggcgtggttctctcgacagtagttggaagtaaagacaattgtattgcttagtaacaattttttggatccccctatttcatggccttagggggctatttatagccctattactggtccccctttagggtttaggttttacaggggaatttacatggctacccttatgatagggacattatcgggggcacacagtatcctttacttgtatgggcccttattgggctaaatggctcggctcatttacttggcgaagtccttcgaaagcgcaacggcccgctaggcctccttacggcggagatcggtacttggcgaagcccatgccttcgtgccaaggctttcacctcaccatcttcgcccgtgcggccttctgacgaggccttttgcctgcccaagtctgtgtgttccgagccactgctttctccatgtggctttcgcccatatggttccctttttgtccttcgccgcttgcttccggtctgagcgtgtcacctatgttcttggtttcggtaggtccaaccgaagacccttcgtagtgtacctccaacaataagactgcaattttatatttaaaaaaaagaaatatatatttacttataccaaaattacagtgcacttacatgtcatatcaactaaaattacaaatgtaatttttgttatataggactataattttatatttttaaagaaaataacaaatacatatttacttacacattatttttattgcatttacatatcatatcaactaaatttacaaatgtaatttttagttatataggattgtaatattatatttcatgacaacgagagggatggtgttgctagccgaacagcgttggccgtagtgccggcggccagctcgctggtcggaggccaccttcatcatggtgcacgcgtgggctagctgacacaggccgtcagctgctgctcacatcgcaagtggtgcatagcggccaaaaaaaaaagtcaaatgccacagaaaaaatcacacgggagatggatagcaaaatctgttgacaaaaatgtgtctacatttggtttattgccaaactttaataaatacattagaaatcctgccaaaattaataatgtcaaaatttaataaggcttattttggctacaatttgaaccgttcccgttctgctcgatcggcagccacagtccgactttgccgtcgacgaaccatccagccgcacattcacgcacaaccctcccgttgctgaccctgccgcgcaccatccggcgctgcttccttcctgctgtgcaaccctttctgccggtacggtaccaccgtctgccgtgatgccatctcgctgctgggctcgtctcccgcgcgggccgccggttgtgacagtttccagcttgagcacgtcagtctccggcaccatcgtcgcacgacacggccgggcagacgttccactagctcaagctaacataggttggtaaaatggcataggtgttttgctcatgttgacgatgcgaatttctgaagatccatgagttgatttctagtatgtcttctatcaaaagcgctcagtctggatctttgttgaaccctttttcactcgtgtaaaaaaaagtacagttaactttgcatagctcaagctagtcttttttttcctgctctgttaaaatcaatcaaagagcaattgatggcaattgacgctgtagcagatgcaccggatcctgatcacctggcgggcggagtcagtcgcaaatctggacatggtagccgtcgcttgccctgatctgccgctagctgtgaccccagcctgggccctgtcccgtccgtgactgcgctgccgcctccaccgcagcgcgccgtctccgatgactgccgagcccgcggctccaacctacttaaaaaaacgattttttttaagcaatgttggccttttattttttcaagacggtactcctgggtagagtggtgggttttttttgctgagatgattttcgtaggacccgcccacaaaaatcatccattttcgtaggagacagagtagcggcggtccttccctccgtctaaaaaactgatttgggccgcctgatcactacttgattcacaaaccacaccggacaccgccctatagcctcaacactccacgactcatgtccaaattacaacattacccctccactccattactttaatagacgattatacctttctatttttctattgctgtaattaaggtggtactgttaatatatctgacccctttagatttgaaaaaatcaacgattaagaagaattctactactaccagcagagagtaccgtagcgagactctttacattataagtaggaactgtaatgtgtataggaatgggatgattcagcaattagaatagcagtgcagtctgggacaaacatg

SEQ ID NO: 68387 - DNA, 17670 bp, Oryza sativa
ctttatttcggctttatatctactaggactgaggcagattgaatctatgcattgacgatcgttttattattgactagtggtagttttgtacatttctatcctgctggtgtgacaataagaaaatatggttgctcaaaattaactgccaataaaaaaattgaaaatggtaaacataaaaatataatagaaaaagtagtgtggcacattatgctttcatcttgattttctataatcaccaactaatttaattgaatggttgagggttttgtttgtcaaagaattgcaacactttttacgtatgacatcgttcaattttttttccgatatgtatactatgaatttctcaagtattatatagagattatagagattatatagagattatagacaaatagaagctggcctaaaaacccatgaattgcgggagctgaagatggtggttgcggcgcgggtgccgaagccaatgatgccacaccagcttcgacgacgggggccaaaggcactaccccctcttcggcggccatctcccctcctgcttcactctcctttcgcttagcaaccttctccttcgcgaccctcttcggtgacattcgctctccgtggtttcgctcagaggtccccacagtcggcgccagctgttgtcgaagcgacaactgcgcacgtcaaaggacgtggttactcaacagtgttggaaacagtgaatatactaattgattaaaatttttcttggaatccccctttacatggcctaggaggctatttattatcctattacaggttccctcattagggtttaggttttacagaggaatttacatggtggcccttatgaaagggacgtttatgtgggtacacagtgtaatttggatacatgggccttctatgggccggctggcgaacgttagcttattggcgggtaggcctaagaggccgggatggcccattgagcttccttggtgtcaaacttgtcaaggcgaagtctccttccttcggcccatatccttcgccatgcaccggatggcctattggacctcctcggtattgagcttgtcaaggcgaagtctacacccttcgcctcatatgactggtcctacgaggtacccacgcggctttctggccttcgtcgtctttgttccacagccttcgccatggaggcttcgctcaggtacactagacgtctttggcttgaatccttacaggtagcatggtttcagcaaatatggttaccggcagcgcgaccttgagtaaatgtccaacagaaatatggtaagcattgacagcttgaggtcaattattgagtacacgaattctacatatatatatgctctgccatgtaatttctattgccctcaaatttttttcaccacctcaaattcccaattcatccaccaccagcactacaacatgtgacaggtgcccacttgcattttagaaatgatcgtaataagcatgggatgctataggaaggaaaaatcaacgactaggttattttcaatctaaagactgataagtagatcgagcagatagatgtagtattagcttccacgtgtcacctcctctactcttgaactatatatgagatcgttggcggtaactagatagagcttgcttacgactttgcctgacttgttggactaaaagtcggcctgtttttgttcatcaaaaacatttcagccctgtacaagttgtatcggtccaattatccaaactgccaacacgaaaagggctggaaatttcgtctgtgcgaaaaatactgagttagataaaggtaaaggaatcaaatttgaaaatatactttgctttttcatattttacatttatatacgtgtctaagattaatttgcaaaaatatagctaatccgcggaacggttgtgtgggagagcgggcaaaccacagactggggatgcgggagcggaacccgagccggtcgcgcagaaccgggatgcgcgaccgagtcggtaccacattaccgatgcgcgggagcgatagcgccctcagccccgcggcggtaccgccgaacggcatcgcgggaccgcgccatccctgtggtcgctgtattattcccccaatttttccaactcatctcctctttccgcgcacgcttttcaaagtgctaaacagtgtattttttgcaaaaagtttctatatgaaagttgcttaaaaaatcatattgatctatttttgaaaaaaattatctaaaaattaattaatcacgtgctaatggactgctccgttttccgtgcggagatgtgttcgctgtttggggaatgatgcatgcgggagagccagtcccgcgcatccggcgtgcgggagagaggtcggtcccgcgcatccattatgcgggagcgcgccagctccaggcatcgcccaaaaaacccaaaaaaaaaccacgttgccgctaacccgtcctgcgggactggcgcggtagcacatcccggccagcgggaccggcttggtcccacatcccagtttcgcggggccggcttggatttcgttccttatccccattatgcgggtcgtcctcgctaccgcgcattcgttctgcggattgggtatatttttacaaattaatctcatgcatgtatataatcacaaaatataaaaaaggtaagtatattttcaaatttttttcttaaagttcaaatctaatgaatgtttatcaccctgctaaacgaattggatagctaaaaagatggaccagtcaaaaaaattctccttcttgacaaactggaggagtacagagacctatctattgaagagttgagtatttatattattgccacgaaaccaaaaggaaggtaatatataattttgaacaaaactaggcatgtaccccacgtaattacacgggcacctctatttttaaaatgttaaattcttttctgatgattaataattattagtaactacacattttataaacaaaacaaagttctcggaggatattcatatatctgtcctacatcacctagtcagttattaaaggcttagctagcaagggaagaaatagaggtcttatttgcatgtatcaagttcgagatataattctaatttctaaacctgagttgttttaaaaatacaaaacaaattactctttaaaagtttattttttctattcttcttaatgacttcaactttttgtcattgttaatagtggtaccggattggttgttcataacatttatagcaatttcgataattttaattaactaaatatgatggttaccagttaatatgaagtttagagttccatgacatatatcattggctggattttcctccgatctgtgacccctcaatccgtttcaatcaaacgtgacaaaaataataataaatagataagtgagttgagagaagattcagtcatcacaaatcatttggcaagggttccccttgttaccttgagctcttttagtggtgtggttagttagcaagcaacctagtgcgacttgacgttagtcatcatctctatgaatttattcacgttgtgacggctcaataaaacctcccacgacacatgtacactaaaacaagttaggacgatttttttctttctcataatggccttgatatgggtacacatacaagttgaggaattgaaatcatccaacgtttaaattgaattgaggattaagcgtttgttgttttaccttttatgaagaacttccaaagcagttgtattaaatttgttagaggttaggagggttctatagcaggtgtatggtgcttagaaattcatgtaggatcgaatcacaagaactaaaccaaccagaggggggtgaatggttggtatacccaaaaaccaaatcttttagaggaaataaaaattaccctcaaattcgacggatcgcggtctgaccgaagatgttgcgtcggtctgaccgcctgatgaacgtcggtctgaccgggatcgaactctggtcgaaccgccaaaatcacctgcctgcgcctgtcgccaccgccggtctgtccgccggtgcaccgccggtctaaccgccgaaacccggtgaaacacaaatcaaagaactcttaaagtggatgacgactttattgattctctttgtgtttacaaagtgcaccaacagcactccttgcaaaaatctcgactattcgaaaccctaactcaactgtcaacttaattgctctcaaaagcgataccgggaaatctcacgctccctctctacttatacctgaggtaggcagcctaaagccacgaaccaaacttatactagaagtcctaatcaccctaggaaaccctctagcacaggaaacaaactttacataaccaaacataccaaatttggactccttccaaattcgactctgcatctcatacgcacacaatacctccatcgtatgccatatggaatcttcacctaccacgtgcattgaactctagccttcgtatcccgcatgatctctgaccaccacggacgtcatcttatccctaagccgactcccggtccatcaccgcaaatactctcccggcatctcgagtcatcaacaaatagaacaaacaaagaaactatattctgagaccaagctattcccaacttgactcattagtagcaaacaacaatatttacatatgcattgtatccatctagaagccataataatgaaacaatcacggatatccaaataaacaacccgaaaccgaaatcgacaaagtgtcggctggtcagactgcgggctgtgccggtctaaccgtgtaatacacgccggtctgaccggtagcacatgcccagtctaaccggacccaaatcacagcagttcctgtagatcacctgtgaaatcccaatcatctccaaaaccacttcgcaaataaattctaaatatcaaaaccaataatctccaattccaattgttcatcacagaataataatcaaaaacacctttcattttacaattcatagcttataattatatattctagagattagccattgataaacttataatccataattaagaccatagatgatctcagatgaaacttttgtcaactacaaaattataggtctcatctatacctacaactttcatacagattttgtgtccatccgagattgtctatatcttataacacattttgggacatccagacaatttaaataaaaagtcatcacctatacaaagttgtagatctcgtcgagctttacaaatttgatataatgtttatcttcatccgactttatatgaaaaggttagataaaaagcacatatttatgagttgcatcatcatagagcaaatatttctgcatggtcaagtttggatggtagatgtaggccattgaagaaaatctatagctccctctatctgctaatgatttgttgcatctggaaaatactatgtcttattctgtcacaatgttgcaacaactgagaattctcaattagaatgtttgtgggctcaataacccggcacgcagagaggcagtccttgaaaccgcaaagctggtgaaagcagaggtattctgtgcatgcaataaacaaaactaagtgccattgaccagtggattggtaaggaaattgggggaagcagattgacaaaattcaatttccttcctgccaatggaacacgtggtggcattgccatcttctgggatgactctattgtgaacatgataaacttctcgcacagaacacactacctctcggcaacggcaacgaccataattgaaaacctcagctttgtcatcagtcgtctatggtccctcggaagacagcgataaggagagttttcttgttgagctaatagcagccaagccaccaacagacacgccctggctaatcgtgggagattttaacatgatatgtgaggccagagacaagaacaatcataatctgaatagacggctaatgggacggttcagagcagccttaaacactctggagctaaaagatatcagattgcaaaacatgcggttcacatggagcagtgagcaaggaaatctgattctaagcatattaggtagaatgctatgtaatagcgagggagacatcttcatctctggacactccttgttagcactgttcacatcctgcttagaccactacccactgttgttagacccgatcatagtagaaaaaaccggagcggccacagaaccacttgagcttttggttcaccgggtcaccggttggaccgccggacttaccgtttcgattgctgaaccggaaagagtatatatcataaataatttctcctaaataaggtgagcaagttgccttggtggtgaggttgatgtgctttcataccatcggccagggatcgatccctatgcactcttttaggcaataaaatgcaattgggctacaacaatccaagtgggccttacaagcgtcaaaatagcccgggtcaccggttttcgagaaaaactattcggttcatccggtttgtaccgttcaattgcatgtgcggtctttgaatcaatccaaaccggtgagggtgctggttcctgcccgaaaaactatccggttcatccggtttgtaccgttcagatttagatttgagaatttatgggttagagtggaaggcttcttttttccggttcaaccgctggtccggtccagttttttgtactatggccccaatgcaagatccaaagaggagcccgagattcagatttgagaatttatgggttagagtggaaggcttcctaggagtggtgactcaggcttggagcaagcctatccaggatggtcacccctgtcttacggctcagtcaaaagctaaggaacaccgaaacgactttgagacaatggagcaaatagaagtttgggcaactgaaactacaattcatcatggtccacgaactaatatattggctgtacatagccctggaaacaagaacacttttagttgaggagcatcaatttagtaaatatctcaagataagaattctggggctagcagctgtggagaaggcaaggaaaaagcaagcatcaagagttaaatggttcaaagagggcgatgctaacacaaggtttttccacatcaagatgaatgcccgaagaaggaaaaatttcatccattgcttacagcaggatggaaacactatacatacacatgaggaaaaggctgcccaccttcacgcgcatttcaactcaatcctggggacaaggagaccatgaggctgcactaaattgggaagccctagaattaaaaaaatacaagatgatagcatggatgagcctttcacggatgatgaaatctgggcagcaataaaaaactctctataggaaaaagcgccggatccggacagtttcactggtgcttttttacaaaagtttttgtcaaataatcaacaaggaaataatggaagtcctgcaaagtttttatagcctatttggggggaattttggaagtatcaatagacccatgatagcattgctaccatgactcgccatgttcggcaaatgatttcaagctgcccatgatagcattgctaccatgactcgccatgttcggtaaatgatttcaggcccatcagcctgattcactccatggcgaagctcatctccaaaaacttggcaatgagactggtagcacggctcggtgaattggtctcacatgcccaaagtgctttcattaagaaaagatgaattcaagataattttctatacgtgcgtaacatggttcggtgtcgcgcccagagatttgacaaaccgaatcactggctatttgtgcatttaacctctgtccaggcattaaccagagtacacagacgacaattcgatacagtaccacgtcttacaaaaatataaaataaactcagaaaagtagcggaaaaattaaagaccatttaaacttaatcttctcacgaaagcgaagcttcctccataatccacacgcgaaacctcgacgtctggcacaagcctaatcttcatagaactcaccatccgacaaactctctgccactgggggattgggaaaaataaggcaagactgagtacaaccaccgtactcaacaaatcataccaaggttaatatttgtagtaaaaagcagcattcataaatcataagttgaaagcagtaaaatagtagataattaagcaatattaacctcatcactgtccaacgctaaaaccacgttgcgacaagcccagcccaaaccacctgaactacactagttcattaagtcaaattattaaggtgagactaatcatgataagctagttgaccgcccaataaccgtgggcaaggctattcgaatagttttactttaattagaggtgtacaactttatcgacaagacacgattccacacatattaccatgtcccgaagtacctccacgatactacaaagggggaaatagtgacaaaaccatccatataaccacccctaaccaacacacccaccaccaatttcacccccatccatatacaggcaatgggcagtccccgctcgtgcctaggtaaatccagaagcagcatagacgaaaatctaggtccatccatactccatcaccccacccttgccaacggtgtgttcgctagaaaagattatacttaagattcaaccttgagcctatctggcctgtggttagtacgagtatatcttcgagggattcccaagaaccggtcgttaattggcatgggcacgaccaccaatcaaatcatgcatgtacccacaacccaccaatagagcatatttcagttaattaaccatataccaggatggtataacatcatcataaaaaattaaggactaaattataatgaatcccaatgtgaggtaattgatctaagcattcctaaaccaatcatagagtcaaattattatcacaggctatcaaataaatcagggtaatcaaaaggctaagtacgggtaaattccatcccacatgacattataaaataatgcatgttttaagagaaaagcagggattttgaagataggctcaatatgatcaatgatatccgtatgacttgccttgctcttgagctgatgggaccactacgatggatcaggtcatctctgacgggctcatacccttatctgtgatgggttaagcactggtcacagatcagtgatcactgatgactcggagtcacctgtgacgggtaaagacccgtcagaggtaagagttacctttgacggattgcaaattaaaatatgtcataggtaacgttcacctgtgacggaggggtccgaattgggaccgccatctcttcctcctatagcgcccgcgtcttcgacagatgcggaaaaggcgaaagcagcggcagcggcgaaggccctccaggtcagagatgcgatcctgtcatcccaagcaccgggggcaccttcgaccgccgccttcgcccaaccggccatgacatcgacagccttcaccgccccgcaagccaacaccagtctcaaagctcaagccgaatctgacatgggggccatgaatcagaatatggctaaacttcaagacacgcttcgccagatgcaagagcagcagcaagcgtacgaagcagcaaggcaagcaaaggcccacacccagcagttctacgctcagccccaagtcgttcctccatacgctgcacaagcaccggtgtacttcgccaagcctgcccaagttgtcgccgtgcgtctgactccacaagtgacctcggagccggttcgcccgacggcaccctaagcccagtacccgaagcctgttcacacgccacaagtaatgatggaagcagcttcgaccttacaagcacaatttcaagccttcttgcaataactcaatcaaccccaaaacaatttaccaagaacttcgcctttggccctggccgagggaagcccaagtcagggtgcaccagtgggacagctgttgggccagttcgccgaaccaagtcaagctcaaggggcttcgcctcaaggccaaccgccacagttcgacccaagcacaccggcccaagcacccatgactttcgcacaagccgtacccccacggtatggtgcagccccaccactaaatcaagcctagaatcaagccatgttcgacccaacagtggtaatgcaagctacttcgacagatcagcaaaaccaagcaatgaagttcggcacggggcatcaatcgacacccacagcccaacctcatgtacaagctgtggcttcaccgttcgcgcccccatacccatagttgaattggccctctcagcaaggggccatggtcaagccgggtggcgaaaagggtctgccccttagttgggggatcaagaatcaccccatccccccccagttcaagttccctcctgttccaaggtattcgggagaaacggacccaaaggtgttcctctccatctacgaatccgcaatcgaagctacccatggtgacgagaatagaaaggcgaaggtaattcacctcgtgcttgatgtcattgccaggtcttggtactttaatttgcctactagcagcatttactcatgggagcaattgcgcgatgtctttgtccttaacttttgaggcacctacgaggagccgaaaacacagcaagaccttctcggcattcgccaaaggccgggagaatcgacaagggaatacatacgtcgcttttcgcaagcacggtgccaagtgcaagacataactgaagcttctgtcatcaacgttgcttcggccggcttgctcgtgggagaactcacgggaaaacttgcacgcaaggagccaaggacgatcgaacacctctttcgcacaattgatggatacgctcgaggtgaagaagacaccaagcgaagacaagagatacaagctgaatatgacaaggcgacttcagccgcagccgccaccgcacaggacaacgctcaagctcaggtccaagcccaagttgtaagatcggcgcccgtcctggttcaccctaccactccggcgaaccaaggacaacatccaagtccgaaccaagcctcgatgacatggaagaaattcaggaccgatcgagctggcaaggcaatgatggcggtcgaagaagtgtaagccctctgcaaggagttcgccatccagcaagtgggcggacagcaacaaccttttcgcaagaaaataaaaaaggacttgtactgcgctttttatggacgctcttcgcacacaaccaagcaatgtcgaaacattcggtaggaaggtaacgctcaagcgccgaggcagcaataagggccaaagaggcaccgcgtgaagcggtcctcaaccaagcacctcaagcagaacaatgccaagacgcgcagcgaagagtgattcaagtcatcaccagatcttatccctcctcacaagtgtcgaaacggcagaagaaaatacaacttcagacagtgcatagcattgtttcggcaggtgatggggtcccaagatacttgtcgcagccaatatccatcgggctggaggatgccaaaggagttcttttcccacaccaagacccgttggttgtttcggcagagatggcaggtttcgaagtccggcgcatcttgattgatggggaaagttcggccgatgtcatgttcaccgggacttacgccaagatgggattgccgacattggcgttatcccaaggaccgacttcgctcagaggatccggaggcgaagcagtgcaagtcttgagacaggacctaaagtcgctttcggcacacaagagaacaaaagagaagaggagatactcttcgacattgttgacatcccatacaactacaacgccatctttggcaagggcactttgaccaagttcgaagcagtctctcatcacaactacctcgagctcaagatacctggcctagctggcgtgatagttgtcaaaggttcctagccttcggccgccacagtggccactttcgatagggaagtccgtaccctacaagtcgaaggacaagaaaaaacaaagccaataccgaaacccgcccctcacggcaaagttgtccaactacagatagatgattccgaccccacgaaagttatatcactcggtggagaccaaagcgaacaagaagtgaatagcatcctggtcgcgctcaagaagaacatggatatcttcgcttggggaccaaatgaagtggggggcatttcgccagatctcatcatgcaccatatcgcagtcaagcctgacggaaagccgaagaagcagaagttgaggaaaatatcggcagatcgccaagaggcgacgaaagcgaaggtgaacaaactgcgaaaggcaggggtgatacaagagatcgaccacccaaagtggttagcaaacccagtgttggtgaagaagtcgaacgacaagtggcgaatgtgcgtcggatctcaacaagatgtgcccgaaggacgatttccccctgccacggatcgactagcaagtcgattcgaccgccgagtgtgagctcatgagcttcttggatgcatactcaggatatcaccaaattcacatgaactcgacagatattccaaaaacaaccttcatcacacccttcggcaccttctgccatctcagaatgcctttcggtctgagaaatgcaggggctacgttcgccaggctggtatacaaggtctttggatcccaattggggcgaaacgtcgaggcctatgttgatgacattgttgtgaaaagtcacaaggtcttcgaccatgcatcagacttgcaagaaacttttgacaacctccgtgcagctggcatgaagctgaatccagagaagtgcgtgttcggcgttcgcgctggttagttgttaggattccttgtatccgagtgggggatcaaagcgaacaccaaaaagatcgatgccattcagcaaatgaagccaccatcgagtatacgacaattacaaaagctcgcggggcgaattgcggcactcagtcgattcttgtcaaagatggctgaaaggggcttgccattcttcaagacccttcgaggggcaggaaagttcagttggacacctgagtgccaagtagccttcgatgaacttaagcagtatctccaaagtcctccagctttggtcagcccagcggcaggaaacgaactgtggctctatctagcagcttcgctcgtcgctgtcagcgcagctttagtgcaagaaaccgaagcaggccaaaaaccagtatacttcatctccgaagccctccagggggcaaaaatcagatacattgaaatggaaaaacttgcttatgccctagtgatggcttcaagaaagctcaaacactacttacaagcccacagaatcgtgtaaccttcgcagtatctgaaaataaataaatttacattttaaaatataaaattacagtcctatgtaactaaaattatatttgtaaattaagttgatatggcatgtaagtgcactgtaattttgataaaaataatgtgtaagtaaatatgtattttttattttcttttgtagtacgttagatttaaatctaaaggtagaaaaaatatgggtgatttttttttgttagaaatcacacgacaaatagatagacagttccaggagatcgattcagttgtgtggcgcgtgagactctctttggcaaaagacaaaaatgcctaaagaacaatgatagaaaagaactatcataccctaatgaattaacggtcgagatcatttctactggtagtatatactcgtagtagacagcaccggagtttcactctaatggaaaagtgcgaatacgttgtgcgttttgaatttgagagtgtaacgagcgcctgaatgtacatgtagtggtgtggaaatggtgcttgcagtgtgtagatagaacattgctgacgaattagatgaagaaaataggaaacctattttgagatgacgacattcgatcgctctcttgctggaaggctaaattttcaatggatcataattaacaatacaacaatgcagtgtgctacttggaagcgtgcaccgtggtccgtggtggctcatctaagtcataacatgtggcctttatgatacggtgctatttttattgctgaatcatccaaaacccctatacacgttgagttcgttccagctaaaaaaaaagacattatctaaaatataaaacattgagttcgatccaggtatttacaattcgaaacattgagttgttcaaccactgccacacaacaagcaatatgtgcccaagcaatatgtgccggttgggaacctcacaaaggtgccgaattttccaaccggcaccacgaaggcagcacagattagaaacactcaaaaccagcacctttgagatatacgaattgaaaaaaataataataaaaataagaataataaaattcagctcggctcaaattgaaccgagccgatgcatcaaagcaaccaaaaaaaaatccaaaaatctcaaaaaacaaatccgctgctggcaccactgccgctgcacactgttgcatgccgccgccactcatgctccgcccgctgccaggactctgcgccaccgtcgtcgctgccgagaccaccgcgccaccgccatcgccactggatctgtggagaggaggaaaggaatcatcagtttctgaagattacgaaaggaatcatcagctgagaaggacccagagagagagcctccgccgggccgccgtctctcctcccgccacctacccctccccccgtcggatttggtggagaaatttggaagagaggagagaggggatgagtaggaagaccttgacgacgtgaagagaggccagcgataacgcccaacgatgatgaagggtggtgcattgacaacgccatgatcaatgaggcactgacatggccgacgcagtccgtcgacacccttcattgaccttccatgcccgacgacgtggaaaagggcggcgtggcgcggcgagatctggatgggaggtgggaggctaggagaggaggtctgggagggaggaaaggcttcacaagagagagagagagaaacgcgcgagagaaaggtgggagaccgggcgaaatggataaggatgtgtgggcgagtggaggagacaatgatttgcaggcgaagtggataaggatgtgcgggcgagtgggctcgccggctcggctcaattcgtatgtgtcggtttttttaaaaaattagcacctataatatgttgtaggtgtaaccgacaccaataatatattaaaggttccggtttctttttagaaaaccggcacctataattacttaaaggtatcgttttttttacgttttcaacctgtgaaagtgggaaaagatctataggtgccggttttagcaatttcggaacctatagtaccgacaccgttttgtagtagtgtccggtgggtgcattgggaatatgagatgctgaccaacgcttgaatgtatgctaatgaacggttgcagagtatgtatagaaaagttctggagagtacttcgaagaaactagaaaattcacattaggataaggacaattgatcggcaaaatagccattcacaatagtgaaagaactatgatcatatcgaaacaagttctgatggaaaatttcgtgttggatgagttattaatgctttcttgccattgaaccattggtgttaatttatcctgctgttgattacgttcattttttaaatgctgggttttctttcttcatcttagactcaaccagtagctgcgtgccagctgacacgagaccaaggtcacaagtaggccagacaatttctggtgacatccaactttatttccttgggcggggatcagaagaaatgctcttccaaggtgtatacttgtactggttgtacgtgtacaaagcaacctatgaaaaattgaaagcaatgctcaatgcattgctctccattaaagagtaaaatataagtggtatcttcaacaaaaaacttctgtgatgcgttcattataatattgaagacaaatattttttggttctcgcaaagaaatagagcgtggcttcaaaattcaatgtcatcttccaaaaagccaattgtacaatttatatgtggaaaatttagtcactgcagcaagttcaaatgtgctgaaattcttttttattttttaaaatttttaatttttaaattttaaaataaaccatttcaaaacatatttttaaaataaaaaatggttcagatactagcaataacttttggaatggtttatttttaaaatttaaaattaaaaagttcaataaaatttaaaaaatccccgtgctggtaggaatatgtacgcattgaagtattgaagtatgtactaacaagaaattttctactctcaaactcatgatgccaaagtaaatatagatatcttggatactgaaagatttgttcagctagcggcagaaaattagaagatttttggcacatgttaccggtgccctctcttatgcagtttgaacacaaacaacttttacatgggtgaaaaaagaattgatgcacccaagaatgtcctatttctccgcaaaaaactctgacaaagataggaaactaattaattaactagttatcatcagcgatctcagatgcacaagctacgcctcttccggatggtcaagaggccattaacacacttaacagacgagatgacacattgaagctactgtgtcttctcttaatctctttaccatacagacatctcattcttattatgaccactagccgcccacccgtgcgttgcacgggctatcattttgatattataagtattaaattaaccacatttgcctctgattagtggcttgacaaccaccggatgttcaatgttggttattttccaaattaaaattgtttagattgaagagtctaaaagagctcatcctccagtcagaaaattaaatttccatattattttccatctgtatgttttatttaacacgaactccagtaaaatctattgtcaagataaactgacctatttgacaaacattcaaatacttccagtaaatatgtgagctttcttacagtgcccaattgtttggatttaatatgttttgttattttcatgaaaagaattatagcggtttagattaaaataagagtccatgcaacttcctaattatgtattttaaatttaggactaaactaataaaataatatattgatagtctaagatggatacaacttcatattcactaattatgaattttggaattatcagtctttatgcaactaaaacaaatgaatccatatatacatatagtttatttcaaatgtagaacttattgttaactgccatttcagcatatagagaagaacaattagatgatattgatgtggtcttcatctcgtaggggtaactgaaaatcttatatgtggtggttattgttcttaacgctaattatgtcaagggatcgaattaattcctcatcgaattaacaaagatttaacacatttcaatgatataaaattccgttggagtgacttactatatgaagatttcagaggaaattttacatgagatccacctcttcgaattttccttcgagtgtttcgctctaattcaattattgtatttctctcatagcttatgcgaacatttattcatgcattttattgtgtttgtaattccctcctttacatatgcattcttgtcaaaacttatgtctctcacgttcttagttttgctaatcctatgttgcaaatgatggtgttgactaaagagaagtccatattagttacaactcactaactattatttttcaattttacaactgaattaataaaatactctctctgtttcaggttataagatgttttgactttggtcaaagtcaatcggctttaagtttgacaaagtttatagaaaaatataataacattt

SEQ ID NO: 68388 - DNA, 6890 bp, Oryza sativa
ctaaaacgggggagtactaaattggaactccaagatgagtatctatatttattaagtggattagattgaaaaaagtacattgtttttgcaattacccaaaagttgtacacacaccacacgcccgtgggtttgctttaacacacgatcaaagaaacagaggtcaatgacaaatcgctaactcagtaaattcttttgaaaacatgttcgcaataatttgctaattattaatttcaaacttcataattatattaacaaagtgctaaattgggagtccatgacagataaacaataattacttttcaattcaaatgaagaaatttttaagtttgttaaaccctaagaaataaattaaaacctattttacggtagccaaaataaataaacccttggtgcactgtacaaaatttggtatagctaactcgattgatatgctttgatttggatttgcatagatcgatctattgctttctgacctcattatttaatatttaatttggttggatcaagtcttcgtcaggttgatgcggtacctatgtatgcactgtttctgtagatttcgtcagggcaattagcatggctgatggatacgaattattgaaagaagtgacatgaaactaactgttggatcaagtattagtcaggttgatattgcacatatgtataccttgtttctgtagattcatcaaggcaattaatatggctgatagatagaaactgtagaaaagaactgacaggaaacttactatatatggttagaccaccaaatcgaagttattacagaggcttctattggatctgattgagattcatcctcttaattgacgcagtagcaacatcgtcatgcacaacgaaaatttttatcatggatcttgccggccggccgtgacgttgttgatgatttcagatcgatgtgagagcgcttgattctatcttctgttgcgatggccggatggcgttaggaagtagatcgatctaaatagtatttcctcctcgtccctctcagtattagtttctgagatgtggtttaactaagggtggcccacgaagttaactaattaaacataaatcagatttttattatttacggtcaggataaaataatctaactaatcaacggttagatctttctggttaacgtgggagctaaaaaaaagtgcccaattagtataggtatagatagatagatagatagatttctaaatacaagcagtggatgattgagaataaattgaaaatatgaggtgctaaatatctgagctcctggttccgaagaagttccttggcagagtatatatttatattcaaattgtctgttgtactcgattattagattacccaaactttagaagcttattgaagctgtcgattcctaccattttcccatcaagtttacacaatattgtcagtactctgatctcctcgtggtttaagtgggctggtcctgtacccatttgcatgactatattggagttgttgggtctacagaggaacctatatgtgtagattttttctatttttctgtccttaagcacatgccttgcaacaccatggttactgatcacggttattatattatattagcgcgctaccctcaaacgcatgacatataattgtaagagttagccaaccaagatatggagggcatatggtactgtttttcatccagagttctcccatttctactgcaattcctaccttaaatttacaagtgtgaattcattgtttgtcgtcatgggtgccttcagaaattgagacagtgagtgcttgaggggtgtagaagtggtgctaggatatactccctcggtcccactcactagggcacggtcaaacttggcaacacaagactcactgatcacggttattacatcgtattagcgcctaccctcaaacgcgttgcctatacatgtaagcgttagccagccaaggcatggagggcatacggtgctgtttttcttccagagtcctcccattcctgctgcaattcctaccttaatttacaagtgtgaattcatcgtgttttgtcatgtactcatgtgtgccttcagaatttgagatggtgagcgcttgaggggtgtagaagtggtgctaggatatatatataatgttataagtattgttaccagatgatgatgtgacatatttacatgtgatttaaaatactctagataataattgctagtgggtaatgatgtggcacatttgcatgttgagtttagtagtttgtggccatcaacttttatagtaagataagataaaattggtcatttaaaaaaaaagattggatttgttgttagaggaggaaacacacttacggtagtggtaagatgggctttaaaacaggcccatgaggttaattaaactttatagtgtatgaccacggtaatacgatctaattaatcaatggtcatatctttctaattaacatgagagcttatacaaaatacccaattaatattgttagatagatagacaaatcgatcaatcacactagccacttagtcgtgtgttgcacgattttgggtgcatatataaaagcctagtatatacaatagtgagattgtgcattaatttttttttacaaaatcaaagaacttgataaaaaatagttagaaaaataaaacatagaaaattatgtttcaactaaaggttcaaatatcatgtccgagatatactgtatgcgatcaagagatgagaacatgtttactcagcaatctgattcataagtctcagaatggtcaaatagaatgcaataaacatcatgtccttatcatttgaaaccaacacgaggtcatttgacctctgagtatcacaagatgataacataataaacattccgaaatgattcttccccctgaaatgcaaaaatatgcaagtgcacttgaagttactgttttggaacagaaaaaatgaatgattaattcttatgagatatgaaagattccatttaatgttcttattatctgaaaatgtatgtagttcaaataaattgtagtctcacatcaagtatgctcattgagttatcatgacaatagaatcacagttgcaagcctacaatcctttatgacatatcccttctttctataaagttaagtcccaaagctgaaaccacagcattccacgtcatcactaattctcagccattcgatcggtggatcagatcgcatatgaaccgttggatgagaaggtcccaggtgagatgttgagtcattggacagctcgcctcctcaacgtgcgcaccagcgcaacatcaggaaactgctggcggcatctcaaacgctcggcatgaatggcatgaatagctttaaacatcttcctccatcatggatactatttatctttttcactacacaatgttaacagtgttaacaatgttagaacaaattgtttacacccaaatttggcacctcggattaaaataggaaagattgccaaaatttggaagtctaccgatttcctccgagtgggccggtctgaccgccgtgtgttggcggtcagaccgccggttgagggccggtcagaccggcggtgtgtggccggtctgactagcaggtccgagtccgactgtgtttcgttgggttttgaggtttccttgctcgagaaggcatgttttgggtttcctttagtttctaccccgagttggatgtggaggagggcctgtagagggcaagaccaacccctatataagggacatggccggttcattgtaaaaaaccaatctacaatcaatcaatcgaatcgtttttcatattgcttttagttttctcttagtttgtccatctttgtcggtttgcgccgtaaaccgtccgccgccgctgcgagagtgcgacacctctttgtaggtttgtcttgaaaaccttccgttttgcccacgagacgggtagttatctagaaatctgctccgctagccggtttagttatcaaaacccatctaggtttagctcattgctaaatcgaggtggttggtgactctaggatcactacaaggcttaagatgctgcgatcgtgcttgtcaacttgtcaaataaattgccaacacgactccgccggtcagaccggatattaccccggcggtaagaccgggtctcaagccgatccaaccgcacatcttgatgccggtcagaccaggccctgggctggtcagaccggcgcaattgttccaatacaggaaatagatctgatgactaatgctagttatttgtatcactttaaaacatttgatcctcctgtatctactgctacaagtagtccctaagttcccccacatgttcctaatgcttataatgatgtttctagggggtatcctcccgatactagacaaggccaatataatcatattgcgccacaaacacaacctattaggccaccgaatccaccgccaaatcaataagggcctaataacatggaggatataattagtgatattattaggaatagattcgggattgaaactaggaatcgtgctagaacttacaaaaagccatatcctgattattatgataatgtgccgtttcctcgaaattatagagttcccgaatttgccaagtttagtggtgaggatggtaagaccacatgggagcatgtaggtcaatttttggcacaatgtggtgaggctaatagtgatacttttaaattgcgcttgttttctctatctttatccggtaatgctttcacatggtttacttctttaccggcaaattctattcatacttgggctcaattagaagaacaatttcatgattatttctatactggagaaactgagcttaggttatgtgatttgacatcggttaagcaaaagtataatgaatctgtcattgattatattgagagatttagagatgttagaaaccgatgttatactttgaatataactgatagagatttgactggtcttgcttttaatggttagttgctcctcttagagaaagactagatggccaacaattttttgatgttagtcaactcatgcaaagggctttggctcaagaaagtcgggttaaggataatagaaaacttgctagaccatttgacaaaaagcctaatgttaatgtggttgattaccctgaggctagtgatagtgaggaagagggtgatcatgatatttatgttgctgaatggtcatggactaacaaaaataagccttttgtttgctctaacctaatgccgattcctcgcaaagatcggcaaattgaggttaagtatagttttatgtggccaagtgtgatatgatttttgattatcttttgcaagagaaacaaattagattacctaaaggccatgtcaaaccttctcaagaagagttgaaacgacgagcatattgtaaatggcatgattctcattctcactatactaatgattgcaatgtgtttcgatgacaggttcaatcggccatagatgaaggacaattgaagttcaccgatggctccaagatgaagcttgatcatgatccttttccggtgaatacaattaatttcaatgataagaaggtgttgattcggtcggagcaagccagatctactaagggaaaggaagtggtcattggtgaaccaaggtccaagatgatagtaccaaagaagccagaagttgccgtttggaaggagaataggagtggagcttcaacatcaaaagcccctaggaagaccaaggtgacttttgatatgcttttggagaaatatgagaagcaaggtggtgagaaaattcgcaacaaagggaaaagaccaagatcacctcctagggagcgatttggtcattcaccaagtcggtcgcattcaccttcatatcattatccacaagacatgtcatggggttcctatccaatgccgccgccggattatccttatccttgcttcatgccatggggggcgacgacgccaatgttcaatcgtatgcctccaatgcaattcaaccaagggtggggaggaccacggaggccaattcatgagcgtttgtctttactaaacaatagccgattttatggtaagaatagggctaatgaagaaaagagggaaggaaagcgcgtcaaagtggaggagaggacttcggaagtgataactattaaagtggggtctcatgatgtgccaatacctactggagatggagttgaagtgtccccgaacagaaaatctgaagctggtaccagctcctcgtagtcggccggtctgaccgtggtcatgcggccggtctgaccgggccatcaggcctgtctgaccgccgacccgatagcggtccgaccaacacctcaggccggtctgaccgtgcgccaaatgttggtctgaccggcgcatctggccggtttgaccggtggtctacgaccggtctgaccggactctagcgccggtttgacaggagggttgcgaaaggagatgagagggcttcatcgtctttaaacaaggttaatagaggacattatctacctcccggaacagagccgaatcctaggtggatgcctaaggatttgatggctactcaaaagaggaggttgcaacgtcttcgggcccaagagttaagagagaaaaaggccgaagagcaaagggataaaaggttcaatgagttgcgacccccaccggtatggaggcctaaatccatagagaaggcaaaactgattggtgtagaggaaaaggaagaacaatcagttgataaaagtgaatcatctccaaaagaagacatgaatattaacatggtatgtatgttgcctatggagttttgtgctatggatgaagccgaggttgctcagttcttattaagtcctaaagacgcagtttttgagaaacccgatgagtcaaaccgtcacattaagcctctctatctcaaaggctatgttgatgggaagtcggtctctaggatgctagtggatgcaggaaccgccgttaacttgatgccgtattcgttat

SEQ ID NO: 68389 - DNA, 1068 bp, Oryza sativa
gtcattgttggattcatgccaattgttgtgtgcctctaccttgcatcaatgtttaatccaatgggacggcgatgatgatgaaattgttcaagcggatacatcggccgaggttgcaatggccgatgctacttttgagtggcgtcatgggaatatccaatgcttatcggggagggatctttctagctatgattttattagtatatccgatggcaaatttgtacctatttctataaagccggctagtgtagcatggctaagccatatatatttgtataatgagtaaagaggctaatttagagtggttacaaaaagggtgcaagagtatcggtctacaaagaacgatattggtgaaaccgttgaagattttgatgaagtggacaagcttggacaagggtttacatcggccgatccattggaagaagttgacataggtgatggaactaaaccaaggccgacttttgtaaataaaaacatgagagccgattataaggttaagataatcgagctacttaaagagtatgttgattgctttgcatgggagtaccatgagatgccgggacttagccatgagctcgttgagcatcggcttccaattaaaccgggttttaggccttataagcaaccacctcgtcattttaatcctttgctatatgaccgagtcaaggaggagattgatcggttgttgaaagcggggtttattaggccatgtcgttatgcggagtgggtttctagcatagtcccggtggagaagaaggggagtggtaagattagagtttgcatagattttagagatttaaataaagccactcccaaagatgagtatcctatgcctatagccgacatgatgattaatgatgcctcgggtcataaggtgattagctttctagatggtaatgccggctacaatcaaatctttatggcggaagaggatatgtacaagacggcttttaggtgcccagggtttgttggtttatttgagtgggttgtcatgacctttgggttgaagaatgccggtgcaacatatcaaagggcaatgaatttgatcttccatgatttgctaggtattat

SEQ ID NO: 68390 - DNA, 1039 bp, Oryza sativa
tccccctcccccaccacccatcgcctccattcctatttctctatattgcaacctttttatttttgttttattttttttggatgttttttcgcacttaggatacgatacaaccagctaaaaaaaattaatcttgaacggaatataccacttagctagatatccgaaaatagcataccacttagcctattttgcaccttcatcagaattagaccataacttctttagtaaatacctttgatcagcatgttaaatataatgcactctaccactatatgaaattacttaatctctaattcaaaatataaccacatgaaatgatagccataagttaaatagtacaaagagatgcagttttttttatttttattttatttttttgatatttttttcacacttaggagaatacaagaaccaaccatagaaaaaataaactcaaaacggacaaaatatgtgacttatagaattttccaaatctctaccgaaacggacaaaatatgttatttattaaaataggcgtaactttctcatacggactcggaattaggcaaataatatatccacggatatctacagaaaaagttatatccgattcttcccgctctggcgggttcggcgatattagaacctccaaattccgcttgcaagattgtgttttcgaggagatgtttttcggtagagctttggaaaatttcacaggccacatatttcgtccgtttgagtttattttttatatggttagttcttgtgagttcctaagtgtgaaaaaaatatcaaaaaaaaaaaaaaagttgcacatttctctcctctgcactagttcggagagagaggagaggagaggaaaaattctacaggtcacatattacgtccatttgagttcattttttctatggttggttcttgtgtgtctctaagcgtgaaaaaaatatcaaacaaataaaaaaaaataaaaaatttccggggggaagggcgccagccactctggcgcgctccccctagccacctcagcatcgccccgccacgtcggcagggggacggcgcc

SEQ ID NO: 68391 - DNA, 8360 bp, Oryza sativa
acaaagccagttcccactactaagtttgagctttgctcaagcttggtgggtattacagtatagtatagtcctataaactatttggcgcatggtgattttacctatatgaggtatttttggtgattgatgtttttatgctacaagaggaaattcgtctcaaggtggagattgttaaatatgtgatccgaattttgggcccacaatatattcagatagttttctagtaggagttcctattaggtgtctttctattatcccctatatatactctcgtaagccatacgggaaggggtgatgttcccattgttatttccctacgtttgtaatcatctcctctatagtgaccattgccggtcggcgtccatgttttttttcccgcaagggttttccacgtaaaaattcgtgtctccgttgtgcatctattttcataacattttgcaaaaaggattagggatggatcgatgtacagtacttcgtagtaatatactccctctatttcatattcgtttttacttttttcctaataaaacttttttttaggtttgatcaagtttataataaaatttagcaatatttacaacatctaattagtttcattaaatataacattgaatatatttcgatagtagttgcaatactttttattaacttgattaaacttatgaaagtttgattaagaaaaaagtcaaaacagtatataacatgaaacatgtggagtattattatattatttcattcaacataattaatagtcacattgttttgccgataactgattttaagcaatgacgcttattagcttaaaaataatttatagataatacttttatgtatgtgctcttcggaaaaaagggtaattttttttatgattgttctttgtgacttaaaagccaacattggaaaataaattacaaagaaaaaaaataaattcaactataaaattaggttttgaaattaaaattttgtttgtgaccaataagttgaagagtaaacgacagattcattatatactataaaatgtcttatttagtattaggctaatatattataggacagatggagtaatcgattaagcaacattttattttaagtattaagtaaaataaatagtggatgatactttagttatactagtacagtatgcacctgagattagccattcgagctgcagatatacctaatcgatctctagaccctaattgaccacacacttctaacatagcagtagtacatctctagaccctaagggcctatttagatcccctgataaaattttttaccccgtcatatcggatgtttggacacatatataaagtattaaatataactaaaaaataactaattacacagattacatgtaaatcgcgagacgaatttttaaaacctaattgctatatgattagacaatatggtgctacagtaaatatttactaatgatggattaattaggcataataaattcgtctcgcagtttacatgtggaatatgtaatttgttttgtcattagtccacgtttaatacttcaaatgtgtgttcgtatatccgatgtgacacgtccaaattttacacatatagatctaaatacccccttaaatgaaaaaccagtaaccagtctacaaattaatgatggatatctggttactccttcagttggatcattctgaaggatttaaatacaaaaaattggacaggggcttctggcaacaaatatacaaaaatctactccttcggttgtccccatgatcttctttttccaccgagccaaaccgctttttttatctcagcgtggcgctcgatgcaaggcagcaagccgatctctctctctctctctttctccgcttgctctccttttgtttttctctcggttccttcgctcgccatcagaaatcgccatggcccatggctgctgctccctctcccctgtggcttgcttagccagtgctaacagctgaaaccagaaatggcggtggtggaggatcaagcagcggtgctcggtggtccggcgttgtatcccctcccttcctttctttctcctcaacggctcagcccttttttttctccaatcaagttggtggaatgcgaggatggcgggggtggtggtcgcccaatccagcggccaagaatcccaccgtgctttctcatctccttctcggcttctccacactcggcgacggcatggtgacagtgttgtggaaaacggtgttaacggccgttaatacgtccgataatacggatacggagatcagtccgtcacgtcacgccgatgcggtcatcattagtcggtaacgaacgcataaatccgatcattaccgattaaatcgtccatctccgtctaatcagccgtataatcggcgtgatgacaaaggtcgattccacaatccagctcattagctgtgccctttactactattgactagaagtttgctcttccgaaattctcacaaggcagcaagatgtaaaatgataaggaactgacttcctctaaagtttgaacatgagttccttgattttgatgatgatcaggttattggagtttgtatttgatgaagccgatacatatgttatttgggaccttgattacggtcatttatgctatgtactacattctcttgataattcatttcatgcattatgaacaaaacccatcactacgtcagaattgagatatacagtaacagctatccattatgaacttatttaaatatcatatatggttattctatttaaggatatatagaaggaatatattaagttatatgcatttgtttatcaaaaagggaaaactattatcaactatgtacatatattttcaaaacattatatttccgccaaattccgattaatcgtccgcattccgattaatcgtttagcggtaccctctccgtctgatatccgtataccgtcttccacaacactgcatggtgattaggagggggaatctactgttcttgccggatttttttttcttggatttttttcttctgagattttttcctctactcactgttctattcttgatgaaatcacacattttgttaagaaaaaaaccctctcaaaacatccaatttacattgagatccgctggacctttgtcaccgtcgatatatcatcggatggctgtgggaagggtacgaatacgtggctcacttctccagccgagaacccggatggagctaggggcgcggtgccacgtggcccaatgggaggcctggaatcggccctgcaatcggtttataagattgcttttaaaatgtgtcgaagtttagatgggttgtttttaaattattttggacccaagaattacagctaattcggttaggtggacattagggacaaccgaattaatactaaagtttagtactaaatgggaaatattttaaaatgtattatcattttgcatggtagaaagcttgattatcttacaacgaatacttattttagtatcgctttgagtggacgactgtggatggtcttaaaacgaatacttatttgagtatcgttttgagaggataactgtggatgggctcaggaccgatatcgtgtgtggagtatcgttctgagagtatgattgtggtttgagttggttaatttaatagtgttctcggtaaaataaaagttacatgtacagggggcatgtgtttatgccataatttggctagtagataattcatttggtgggccagattatttagtttagctttcatgattcatagaatggtttgctaaagaaccggttaaattagtgtgtgaaattgatgggtggttgcagcaattgatcatgccggtttggtgatatgtatattgatcatgtacgtgcagctgtttaggcttgtcaggactcaggactggcactagaggatgcagatggaggatagcaacgatggcatgcgtgcacatgatacggatgaaactacaacgatgaatcagacggaccgatacctggcaaagattatggaaatataatcaagctgattgcttgaatgcagtaccgacttaggatggaaagaaaggaaggatgggcccacgaaatataaaggagactttggatgcagtgtgcagcgtctataaatctacagccctgacgtcggcgaggagcccccgaacaatttcaatctactatcatctctttttacttttcacttttcagttcttttctattttatttttatggctgagttttagcaaccctagaatttagttaatctttgccattttgcgctgaaaaacggtcgtgcttctccacgaaagcaaggaggttatcctttgctagtttgctcggaaactagtcgttcatcgtcacgtaagtacgcatttatcttctttgctaatttgcttgtaaattagtcgcttgattccgcgaaagtgaatcaatctcgaaatcggttccgctagccggttttgatcaatcgatttcggcgactctattatttacaccgtaaaccgttaggtgatattgtgttgactaaaaaaaggtcaacatactgcatggtatttcaattacctgacatagcatccccaaatcttcctatttaaaccttgattactcattgatctcgggcacatacgctctttcgaggtacgtacttcgattagcaatgcaatacaagattttgcgtctgccatcaccttcgctctcatctctgatgtcatcgccactccgtgccaccgccctttcgtcaggacttgtctgtagcgctcactcggatgcagtaggacacaatgaacattatggattttcagacaaaactgaaagctatacatcgtaaacagaaaatcaggaagaaacaaacagagagggagcgacgaggctttgctctgcgaactgctgcagcagttttgtcatctttcttctccatttattaagcccctaaaactgcatataacaagtgaccgacaaaactgcagaatgcgattttaatttaattaccagggaacttgccctgtcataaactttagtcagtgatcttttatttgatggagggaatcaaataatacaaatcttttaaaatttcataaaagctaccgtaacataaatgtagtgtagttttactgggactgggggaggtgacagaccccttgtgactcctcactgtttcccctcattggatatatacataggcatgttgaaaataaggaaaagaattagctaaaatgcagctaagacaagcatgaagaaaatggcaatgtgctcaatattatatggtctacataacatccttcccccgccatccgagcttctacttccatagtcaccgctccatgacccgctgccttgattccctgcccctgcagggatcgttccacctcctacagggctccttccgccgccggggctccctgctcctgcaagggtggttccggttccacccccggggctcccagctcttgcggttgcagggctccttacacccccggggctcccagttgttgctgggttccttccactacttgggctcgcagatcctacagggcttcttgtgctgctaccgccagagctcgagccactggaactacttccgccggagctcctccccccaccgctggagggagagccgccggcggcggccccagaggcaccttgaaaggacgcgaccatgtagagcagcgccagcatcgccgccccgaccagcctcatcctgccgcccctcatggtcgatcttcctcctaggctaggtgcttaattagctagctttccgatgaagtgggttgtagtgatgaagagcaaggaggatcagagtatataaataccatatccacgtgttaagtttgctttggaagcaagttcagttcccaaccactgatatgatcgacctgattggatgcatggattgggtgattggctctccaaagtcaacgtcttcaccaccggcaaaacgagaccatgaacattcttacatgccgcgtccgattgacaaaacggcgaactttccgattgtcaaagcttgccacaccagaacctcaaccgactgacttcaacgcaaagaattgatttctttagtgcgagatgctcttccatttgcttgatctttggggatatgtagatctcgtaatgtccctgtgtgggtgctggcgtgctgcaatggcatccgctacctcagctttctcggctgcaatgtcttatttagtcttcataaaacaagttctattcttttcgacagatatacagtattggaagttaaactggagtttcaaatgatgaaatcatgtccataccacaagaaacataatatttaatcgtggaatagacctcttcctcgtggaagcagatcctgggccataagagcagtggagaacaaactagtgtggtaccaacacgttgccgtggggcacaatgattatggataccttctttatctatgcttagatttattgtcttagacttagcttattggcttatatgatttataagccgctgaatttaatatcctaagtttaatgggtggagtcatacatctacctcatataagccaaaaaagattctctaacctagtttttggcttatataatagtgttagagtggcttatatatggtttcaaaaaagcaaaacgaaaatgccgcttgttcgtttaggctttgacttttcggtttataagttgtcctataattaagcctaaacaaaaaggacctaggaagtctctagctaagcatgaaaagaaaaggtgttcatgaaaatgatgaaatataaatccaacatcaaagctgatatgattagaaaatgcagtgtcactaataagaaagtgaacacatatatttatacgcctattcaaagatgtggtcaagtatgcaaatgccaccatgtgttcacatccgacacttgctaggctttagcccctcgcaccgcattaagcattaatgtgtgatgcataaacttgaacgaaatgcatcgatgtcattaattttaatagcggtgcttgatgatggtttacgcaaaccattctaacaacacccctcactagtttatacaaatacagcgggaatatatggtgaccgtgaagctgccgtcgccagacaagatataccatgtctttggcagtcaacatattttccggcttgtgttgtgtacactataaaaaatgcacatacaagtcggtactaatagttcttttcccaccttcaaaggatagaaaaaactgacacctttaaacgaagatgggtgtcgttttacagaaaaaccgacaccaataatataagtgtcggctttttttaaaaaccggtatctattacatcgagccgagccggaggagatatttgtgactgggcgaggcatcatctctctccacttctctagatctggatccatctctttctccatcctacttctcctctctctctctctcactatgtgtggcggcggtccagctggcgggaggggtgtcggcgccctcccatcagccagatccagtaggatgggagctgcggtagtggtggacggtgtggaggcggcaggctggacctcccctccaccagatctggcagcgaggacggtgtggagatggtggcccagatggtgtggaggcagcggaggttttacgggcgacatcggtcgggacgacgctggaagaggcaccaatgatcaagtcatgttcttatgttcacgtgtgttcctcatgttcatgtctcatcacttatggaatcagttgtcggcttgaagcatcggctcgatgcattcaagccgaccatttttttcagtccaaaaacatcattgattctccagatcagtgcccctccagtgtgtccggtcgggaaatccggcaccaatagccctttttgtcgtagtggtaaagtagcagctttaactgatgacgctctctctcatggcccgatattctggtgaggggataattctcgctttaatcgagtgcgacgtttgcgatgtggctaccaaccaaaacaagtccaggtgattaagcacaaaagaatagttgcgattaaagtggtagatttaattgacccggcaaatcaacacaccaactgttgggggctctaaatctatagtcgctgactaatcaagcgagaactagagacaaggtgaatgacacttgaaaaaattcaactaaacaaaacccaaacattctagagggtgtacatagatatctataaaggaaaatagatctagggtttggtggtaattcgtggagatggagggagacacttccgagatgggtctagcctattacaaggcccaaggcccactactacacacatcgtttttccatgcggtcgatttggattttctcgtgcggagatttggcccgtctgcagcacttcgtctgcgaaaatcgctatttttgcatgtgggtggcgcaaccacacgcgaaaatccgattttcacgtgtgggtgcatatgtcgctcgcacgc

SEQ ID NO: 68392 - DNA, 27048 bp, Oryza sativa
  unsure (1)..(27048): unsure at all n locations
ccgcccacacgctcctgtcgtcgccggggaggggaggggagaggaagtgcaggagccgcggccgcccgtcgtcacccgcccgcccgccggatctgccgccacgcgctcctgtcgctgccggggaggggagagggaggggaggagctgcggccgcccgtcgtcgcccgccctcccgccggatctgccgccgcgcgctcttgtcgctgtcggggaggtgaggggaggggagagggacgggagaagccgcgggccacccgtcccgcctgcgcccgctgccgcctccccatgtctgccggccgccgccgagctcaccgccgtcccgcctgtgtagaaggaggcaaaagaaggtgagagagagagaggaaaatgagtggaggagaaggaaggtgagaagataagggagagagaggagagaaggggccggggggagagagagaaggaagttcaaattttttgaatgggatgggattaggaggcccacctgcgaaaatagggttattttcgcgtgcgggcctgttaagtgacttgcacacgaaaattgattttcgtgtgcgggcgacgacccggcttcgcttcccccatttttctgtgcggtctcacttacggaccgcttggaaacaaaatggggtggcgtccacgaaaatcaatcctgtagtagtggcccaagctcggtttctgcaaaaacactatcttgttttgacgattcccgttgactcggaatgaatttggatatgagactggatgcgtttgaaaggtagttagataagctttcatcaagtccaagatcacccaaatcggatggcatgaaggcgctatgttcttttgaagtcagtgctatctccggaggccgaactaaattccaaaactcattgggcattaatatcttgtagatcctctattcatcggatgtattttttggcaatgatttatatttctcatgcttggttgtatgcatatacttgatggtcatatcatcctccccttcttgtctggaaaccgtcctcggtttcttgttgcaattgtcgtcataggagagatcacatgaagaaatagcaaacgagcaaacattgagtagcatcatttgttcctcataaatcctatttacatcaataggaaaccaactcacttcatttaataaacatgtcttaaaatgatagagaaacttgaccatagaatctaatggtgcataacactctccttcttgaatattgtcattgatcttcaagataagttaggtaaatttatcccaatagcataaaatttgtacgacccatttagtttctcacatttttccatatttggaggagtatgtatatcgaaacatatataaacgccatacaccttataatctcctctagtattatatttactaatgacatgataattattccaagaaaaacatggaaaatcaaaaattttcttctctaagatatttagatcacaaagaacaacaaattcgatagcccaaagtacataaagaacataataatttcagctcttcttggtaatcagcagtaacaaagacacgtttattttgagtggaaaccaaatattcagaaatagaagtaatgtgttctttcactagttgtggcatgtatataagtgaagcattgcacaactcttcatcattacaagcattatcaatatcaacacaatctgaatttttagcttgtgataagacaaattagaaatctgttccactagaggttgctctaacatagcataattagaggacaattgtagcatatcacaatctttcttaccatggttcagttgaccatctgttaaattacctgaaacgctctgaaacgctctgttcagctagtttaggtggttcattcttgttttcttcaaaattgtgttttctttcctgcacgatgttatatacagtagaaggtacaagaatattctcatgtatcatagacatttttgtttctttctcaatctgactttcaatatcgcaagattaccaaaatcagagttgacatgaaggcgctaggtccgtttgaagtcaatgctgtctccggaggccgaactggattctaaaactcattggactttaatatcttgtagatcttccattcatcggatgtattatttgacaatggtttttatttctcatacttggttgtatgtatatacttgatggttatatcaataactgaccatgcatcaccgaaattacagctgctactttagctctctcggtcgcgatactttagctctctcggaatgggaagtaaatcagagacccttgtaaatgtcttttgtgtagtagtgtacccgttatttggagatgagatccttaattaagtccaactgattctatctcgcctgatcatctacgggttccatatatataaacaatgcttgagacaggtttctcccttcacgaccccagtgtctagcattcgcgaaatgtttgggaatttcaattctagttatggacaatatatacagcaggaatgcgatgcaacaggaaaccacttaactggattaagggttaaataagacaatttagaagtctttagtacccaagacttgatgaaggaggcgttgttccttaagtccagcaaccaatatatccgtgtcagccgccaaagtccaactgatccggtgctttcagtgaatactttgtcactaagggtttcttcaaatcgaagtttttattgagatttcgcaacaagtgagaaagaaaatgtgggggcactctggaggtgattttgggtgacaaatttttttttaaaaaaaataaactggagagaattttcgttgcaaaacctaaaactccaagctacataattgctgcggggtgttgctttcatgaataattgttggggggaaatttcgtcccttgccaattgttacagttgcttcttaggaatcatattgatatgttcgaacaacaagagggtagaactgcttgtatagttcactaaaaagcctactgattgattaaatcaatcaatggcttgaaactgtaaattcgaaatcagtgcatctaagggtgagtttgagaggaggggaaaagacaagattgggaagatacgcaaaacgaggtgagtcattagtatatgattaattgagtataaactattttaaacttcaaaaatggattaatataattttttaaagcaactttcatatagaaaatttttacaaaaaacacaccgtttaatagttcgggaagcgtgcacgcgaaaaatgaaacaaactaactcacaaactcctcgtgccgaacgctccctaagttctaacttatagccatctcgacagtggtgtttcctatcttagagaaatcttgtcatccttttgcacataatagtgagattttattcgtccagactatatgaaatgaattatcaggtagaatggatgtgcaactgtgcatgaacgtccatcgtccaaaaaataatacaaaagtaattatattgtttcttcaactagaaagaaaacctgcgcagatgcgcggacatcttatttattgttttatgaaataatgttaaaagtagtcatatctcacgatttgtacgttgtgaggtagaccgtagtctttaatatgcttaagaatgtatgtcagattaagaaaacattttatctcagttacatataaattcttctattatcacataaacttattatcactattttatctattaatagatgaaactgtatatgtcttacttatttccaaatccatatataaatattctaaaaataccacttctaccgattaataggatataccattaaaattaaaccattaaagttaaacatgaatggccatttagcacgtgaaaccaatcataatcgtaaagactttcttactctactgtcttgaatgataggtctctcatcaagatagttgtgctccctcgagaacttggagcacaatttaatgtctaatttactatcacacccttatgtagtattgcattggtatactgggaccgccttaactcagcctatatatgcctctgttatacttacaatagcgtagcaaaatctcttgtttatgcttggtgcccctcggagaaggacaaagaaaagataaaggtgttcaaggtagttgtttttttttaatttttgagtagatttgtgttatagagtagacacaatatgtttaagattttgatcattactactcatatttttatagtacagctagaatactctcattcgaaaagaagcgaggtctatcaccttatggtacctaaaagaaaatagccaaagagagacataccaccacgataatctccaaagcgctatattattgttcaaattttgataaatacctatagtttagcacctggtttagtttgaacacctactattaacaacaacacatgttatacctttactaattaaaataatgtatttattcttccaaacatatttatcaattacgtcgtatatttgtcaagtaatatttgatatcctaaaatatgatataaaattatttaaaaattatcagaacattaattattatatattagctcaagatgtgatgtatttagaaccacactataaattttataagacacaaatattttatttaattaaaggaatataacgggatcacgaatttgatatataattcaaaaataatttaaaagataactgtctatatttgatttgatatttgatatttataatatagacctagtttatatttgcgcatatttatggagtaatatatattttatatggtaatgttttatattttaaagaccatcaattttgttccatgcacgtatgttttttattacatatattttttattggctttaccattttctacggtaggtacgtgcatatttttttctttctaataatagttatacgtaagcttttgttctcaatccgtactttttttttctttgaccgttaaggtgcatatatgcagatctactaagcagtacgttatgttttatttttgttttcatctttatttatcgtatgttttcttccttcctccggcaaacagtacatatagaaaggtattatatatagatctgatttattggtacaaaataatgggtccactaattaaaatgaaaatcaactgtataaatttaatcgaacggtataaaataatgggtccaccaatttaaatgaaaatcgacggtgagattagattgtgccatgtggcggcctagaagcaattgtaggagtgtcatatggcggcttgagagcgtttgtagaaagtttaatggacttttagtatataatagaagatagatagatagctcgattcctccattcttatctagttccatgtactgttgtacggtccgtcttaacttttcagaaatttggccgttagataataaaaaacattacaaatcctcaatgctaaattacaatgaaatataataaggttctaaatgaactttacattatttagaagagcaattttacggtccttgaggaggtaccatgaggtatcactttttttattgtaaatttggtacctcttggtacctaggtactatgagataccatgagataccaaattttacactatatttttggtacctcatggtacctcctcaaggaccgtagaattgctctatttagaaccattttcctcaagttcagtttatatgccattttcatcagttgcttttaatggttctcttttttgagatatttatttttatcagagatttggctaataaaaagatttcacctagttcagcattactaaactaacattcggtgctgcttgttgacagccaaccgctacagtaaaataaaatgaagatatatatctactggagagggagtctctccctggtgtcaaaaacacaccggaacgcatggaaaacacccagtaaagtatgttacggagtgccccacccggcaatcatcacccgggagtgattcaactttcccgtgcatgcatgccgagtgtgcttccgacagacactccgtaacaaccagaaattgccgggcgtcatcgaaaactcggcaacaggctgaccacaccgtccaacggagcaaactcgtaacggaagactaggactaacggttaacggcgataattgcatagtgtagcagaacacccgggaaagcgttagagcttaccgtgtgtctactagtagacacggtaaagtattgcttgttaccgggtgccaacgctaattaacacacccgtgcatcaaggggaaacgcccggtaagagcactcgtgcacacacagttacgttactgtgtctcatcattttgacccaggaaatttgttttggtggggtaaattaatacgcttgatcattaatattagatgcaccatgatactagcatcaaaataacacacatcaatggcaatcacacataaaagacaaaataatgcatttagaatcattgacatccattttcaattaataagtttgatgacaatctggtaaaaaacaatagcaatatcaatctttcgaacaagaaatctatcttctcgcgagtacatgctaggacaaccaagaggtctagcaaagaatgagtccacaaagtaataagaaagagtagggctatgttgattgatacaaaggcaatttgacagcagctcgaacgatttagaaaatacgctggctgacttggatacctgagactgcataaaagaagtaacaattgagtaggtagaatatcataattaaagaaactgatctatttcaaaacaactctttcatgcgttgaataaaagcatactactaaacaaaacaattgaaaatctcttttattcgtactatcgacatagtaaagaaaataattaggtaatctggacccatgcatgctttatcccaagcctcaagtgactagtcattgaagttctctaccgatattccggtgttgtttttgttcaagcagggttgtcgttgtaagagttccctatttggagctagacatcttaaggctaattgcattaattgctatggaaggaaaataaaagacagaatcctccctacagttgaatgaatattattaattaaccagggaccactaaagcttgggctaagggcacccgcgatggttatatataggctctctacaaaagatctatgtcagcatatttttctacttggaagagattaaatgaatagagagagagagtaaagctatctactaacctatagatagtctatagagaaaaacgagacaatgtattagagagctatagatacttatgtagacatagtattgaggtggttactactaatctagtctattgctgaggtgtacatgttttatagagagcaccttactttaccattgtaagtgctctaagcagaataggttagccaacttatacaccatagtaaatggttagtatgaaattaagactgctacagctagggtagaatagatattgcatttcaaaaggtcaatatccaagaatgggattgttgtgtcttgctagacatatatgttaatgtctaatcataacaattaacaaggcacatgcaggcatagttgctactcaaccagatcaaatgttgcaatatcatgacaaaaatagtgttccacatggagagttttttacatcatgtgattcaattttcttacaagttgaaaccgttatgaaaaataatcacatatttggtatagcgaaaataagataatgttagcttacatattacaggacctggatgttcataccactgatttgttcaacaagcagggctacaatgttgttcgtgtgacctgccaagaaaaaaattactgtgaaatggcatgacaagcataaagccatgtaaattttggtaaagttaacatggataggtgccatacaaataccgaactaaattgtaaattctctaacaatagaaatcataacgagttaaatgaaagagtaatttgtatattagacccccttttattaccactgttgcagtctgcaccaggggtaaaaggaatatattcacattggaccagttatatttaccaaatgattcaccttggtcctagttcttctacccctggctccctcttttctctctctgtttcctctcttctctgaccagttaacaggtcaagtagctagctatctaaagtcggtgctaatgccaaacttctcccaggattagaatcgaagccgcatccgtgtgatcaatctcaatctccacatttaggttcgcacttaattaagctcaggaaggaacgagaaaaaagaaagaaaaattgcccccattgctgtcgagctatctgctacagggaatggcttggctttggcttgattggtgaagttttaccgatcgccgccggcggcgaggatcgtagaggggggcctagtagtattccccaagggcatgaactgtaccatggatgtcaccaagccggcaagcccatggtcagttggtcacgctccaagctctacatggtcgaggacatttaaattggccaagcggattgcagccgtatgatgattattgtttttgtgcttctaccatcttgtggctagcaagatcgcaaggtgaggcttcatggcgtctgttaacctcgagctcaagtagggcatcgcagcggggggctcaaggtcgaacgcggcgttcgaaggacgaggtcaagcaaggcgatgggtgggatggatcagctggactgctggaggaagaacgggtccgagtagaaacaattggtgaagatagatggtccaaagtgaaaatatgtgcttatctccggtgcaacttgcaaccaaggtaaaaatatgagacccaacatgcaatttactccaaaaataataaatgctataaccggttacttttttctgggccggcgagatctgatataagaaatttcagtattgtttactttcatagagacccaaaaatatacaattacaacttacaacatttgtccagaatggccattgatttcccatactgcaaagtacgtccagtactcttcctaattccattatgtttctttctgttgcacacagccatattcggctcgttctatttaacgccaactcgatccatttctacacagccctcacatcccacatgttctatcagtgagtaattattgaattgacagtgtgatatataggaacattctaatatgggcataggaggttaacggagaaatgatagcattatatttttctttggtggccaacgatgtgttgatttcccttgcacccagtatttctttttctggtagcaatatcagatgggctcttgagctgctcagcatatgtacagtatacatttggtccattattttttctgatccacaaccagtatatgttcctcagcatgtacaatatacctttgctcgagacatggaactagatgtccagtttcagaaagagttgtgactgaaggtataaagaaatacaagtaccccggtatacataatacattatatatgttacacgctctatatagaactttgcattcatcatccagcctgacgaagagctttggaatcctgttaggattactaattatatttgcattattcagagttctattcatatattagcgtttcttgaattattttgaggggcatgctaaatcataatacaatatcaaagttatctgctaggtgtttatgtattcaattaaaaacaaattaaagaactaaattttttattatacttctagccagtatctgctaactatatggtgctaatggatttctagatctatgctggtatgcccatctgcacttgtacgtgaatgacccccctgtagagtaaacaaattaaaccagctactatcattatagtggccaaattgttgtcatcatcctcctcttctactcctctgtggaccttgaacttaactgtggtaggaaaggaaattaacatcaccattatatatggaaacgagaaaacgaacgaccttaacaaagatttgttttacatttaaacattctgttaagtgaaaaatcaattgctctcattatcttcgtattagagcttctcgcagaggttttggtgttcagggaatgattcgaaggaaccttactaatattcaataattattgttcaaattagttaaaacaagcaattaattaatgtgtgctctcaaatgttctttcttggacactttgttttttaaaatattggtagtaggcaagccgagtttgggaaattaataaatactttcacctttttgacagcaattaaaatttatgtcttcacctacaacgaccgaagataattgctaaagagtaatagctttgctcttccaacgctatcaagccaacatatagtgacaaaacacacatctttccccttacatgttcttgcaaatttgagactacgaatttgtcctagctggttcccagttatacatattggatacaaaccctcgctgcaggaccacaactatcgattggtatatgggaatgagaggacaaaggaagaacactataaatagaggcgtcaagcgtccaacattctgtcatactcctgcagcgaaacatctctgtctgacctgcacctgtccacaagcttgtctaggtagatcgatggctgtgcatgtagagagcgtgtgtgtgagatgcagccactgttgcctccctctaccatctgctgggttcaatgtgtcggatgaatccttcaaggggaagtcgttgccatctctctgcatatcttgcattaattagtggcatcttctttttcataaagtatttgttacatacagaggtgaaaattaatgcagcaaaatagggacaccataattaacgcccatatgatataattatattgtggcactttttagtgtccaatatgaaaataaacatgaataactacatatgaaaacattatttgtgtctgtcgaaacaagatttcggcaatactaaaagggggtggctattaagctaaaaaagtggatgtgtttgaagacaagaaattttatataggttcaggccttcttagttaagaagtaataccctactcctgtccggggatgattccgccgagtgtattattgatcgtatgatctaggagaaagtcgtgtccatagagggacccggacccctccttatataggggaaggagtccgtattacaaaatactgtttatatccctaacggaatatgtgattatagataaattacaatcgtaaccgactagaatctcgggtatctccttgacatacaagtttagaaactaacccgagtcctcataaagatattctatctatatctagtaccccgtacctaaccagactatacatgccgtgtagatatgggggtatccataatctccacagtagcccccgagacctttacagtcgacgaaatggccttctctcagaacataaagcaatgatccgagtgcttcaattccttctgctctggtatgccgagtactaaaatcaaaaactgtgaagggcgaaaaaagaaataaaactgggtgcatcgagtagatgcacctaattaggtgtagcccccgactatgtggttagttaaaaaactaaacatgtagtcaagaaccgagtggttttacaaccaaacatcatataacaaagcatacgtggtattcaaaaaaacacctagtcgactgctttttagctttaatgtatcgagaatgaaaatatgaaaggctgagtgataaacactcaaaaaagtccacaaataggcatatttgacaagaattcgagtaagaaactcttaagatgatccgccaaatatgataaaaatcatggtaattaacgagtctaatagtctaggctatgaccctcaccacaaccaaaataagcatataacatgccaagagaatgactcttaataaactagtcatctcgaatcaacccaaacagattttgcagcttaataaagcttataaaaatagtataacacctttctgtcgggcacctttttatttgcatcgtagtaattccaaagaattatctaaccgcgttaaaaaaggattttaacagcatcgggtcacatcattgtgagcacaatttgccaaagaaaaaaagcacctaagtccctagggatcacaacgggccatgctggtaataatattgggctgaagtactgtataggtccaggctcattagcactcccgataccctaacaaaacaccgtagtccaagcgacgcttcgacttccccgctgagactctcgccatttccccattcctcgctagagtacaaaaccgcgccgacgaagctagggttcatcaatccgctccaatccatcctcaaaaaactccacgaaatttctccgcgcgtccaccgcaccaattccccatccctctccagccacatctcggaccaaattagaccatttagctcacattcatggcggaagagagagaaagcttcgagagtcagtgggcgccctccaatgtgacggaggagaatctgaaagaaatggtggcgcacggcgttcttctggcgaaggaaatcattgggtggcgaccagcgttcggcgaagctttcccgacccctgatacacacgaggtcgtggtattttctcacttcttctatggcggattttctcttccaacctcaagattcttccggggaattctgaatttctatgggattagcctgcatcatttgaatccaaactccatagttcacatcgccaattttattcatgcctgcgaagcttttctggcattaggcctcattttgctttgttccgccgcatcttcttcctcaagccccaaccgaacaagagcaagccatgcgttgttgggggcgctggtttccaactcagaggaacattgagccaaaagtatttctccatgcccttcaagacctcaaacaaaggctggcatgcaaactggttttatgttcaaaaccctgaacccgcagtccctgagtactcttgtctccctctagtctatcaggacacttggaactcgctgcctatgggaaatgaagccgctcaggcagtagaactgatggaccgcatgataaagctgaaagaacaaggtcttcaaggagaacagatcacccggcatttcattaagagccggttagctccaattaaggagagatctcgcacagcttttgaatttgacggcaagcatgatccaaattgtgaagatccagattcccttgattttaaggttatgaaagaaagaatgtacaagattttctccaacgctatcgtagtcagctattcacacttgctgccagtggtgccatacaacgcattcaatcctcctccaccggtacgtatccaaacacttcaaccttcctcaaaatatggtcttgtctcttgttaaatcagttgacaatggaagatactatgctcaggagtttgctttgatgaagtcggatcccccaatcgctcagcgtcgatcacctcgccgtcaaactggtcaggggagcggtgaaccaaagatccggtctgaagcccagccgaacacctctaatccagccggccagtcggattcccgcaagaggaagttagttctgagtgacgacgaaggcgatgatgctggaaagcttggagataaagaaacaatcggaaaattgccgaagcatgccaatccaaagaagaaaacatccagtcgtcctatgccgaagatcaggaagttttccaggtacgaatcatataacgatcttccttgtattgacgctcacttatcatgaaaacaatgctgataatataactcaaacttgtaggaaaccatctgatatagacccttttgggaaagactctgatccgactaacatggagacgagttcctccaaagaaactgggccgactgcaaaggatcatccgagtgacaatcagccggcaaccgacaatgtagaatctagctatcaacctccgactggaaaccagtcggccgaagctgaagtcagagttaaccaggagcccccgactggaaaccagtcggacatagggccaagccaagagattcctgaagttgaaactcaagcaaacagccctcgcggacaggatgccagcaatgacccaagatctggatctcctgcaaaggcacaagaatccactcgtcctcgtccggaaatcatcacgggtaaatactttgtctgaaatcatgttgatccaactgacttcatttgattgttcaacctttatccatggacacattaggaccaatgattggtgatgaagaagaaattctccgaatacgagtggctgaagattcgcaccctcccattctggtcaagtggtgggatgacgacatacaaccttaaggaatcgtaataaataggcaaaaagaggatgaagaggtatgcctattgaaaaaggcactcggccaggcaactcgcattgtaaacgtaagttccttgacgcctgacgtcaaccatcttgtttgccatttagctcgagcgctaataaaactattttgcagaggattcaccttaggaatgaagcaaaaacagcaaccttagagaaattagttcctcatctcggaacccttgaagctaccagagaccaactgcacgaggcaaaagaacttgccaagaaaactgagcatgatctaagggatcggatcactgagctccaggagtctaattttgaattgagtggctcatcaaaaggtacacacaaactctgtccaactaacttgtgctgtcatctttgtaatttcggttaaccagagtcaatgtagtgcaagccgccaagatatctcaactggagagaagcagattcagactctggaaaatgacaaggcagaactggcaagacagagggactcggctttgaaggatgttgaaggtaccatcaatcgataccccaaaagccattatcttctatatgctaactcattaatgtgaatttgttgatgtagaccgtaagatcaagtcgcaggctcaattcgacgtcctagtcggcaaaatcaagaggctcgaaggggccagggatgaagttgctaacgatgctaccccactggtccaagcaatgttcttcaataacaacggtccgagtacattcgatgcttccgaaatcttcgacaagctgagagttgctccggatacatatttcaagaacatcaaagaggccgggagtatgggagcgagtctggcgttggcaatgaccaagttcctttacccaaaaatcgacattgatgccattgatggatttgcagacgggacgagcgaagaagctgctcttgaccttatcaatgatgcgtagaaagccatcgacaagatagcagtttatgtagtcgagagattccaagacaccgagcttcgaccgactggtcctgataactccgatgatgaaaaaactgatactgattgatgtaatgtgataacaatgattctgatgatgatgatggaggcacaatttgtacaatactgatgaatatatgttgtgcttagtgtttcaaacttagcttctgatttcttaaaagcttttgtcaagccttattgagcctaaaacccgcaaaagctattaaaaagctttcagtcctcatggactaagtcgaaaaatcaggcaaggcaatgataaatcaagtaagcaaattgaattgataaagatcacactccattattattataatagcccctgactaataacttcaaggagaagcttgatgttgtcagtcaaaataggggaatacagaagcaaaacttaagcataaaaacgacgtagatgttcgatattccaagagttgttgataggtgtaccgtcttcatgtttgagtcagatatgaacctggccgagtgacttctgagattacaaatggcccttcccataaaggggataacttgtgccgatcccgtgtagtttgaatttttcttagaaccaggtcgccgactaagaaggctcgtgatcggatgttacgattatgataacgacgcaacccttgcaagtatcgggccgactgaattaaggctgcttcgcgggcctcttccagtcggtgtagatcatccactcggtcttctccgtagcgctcctcgcgaaaattgcgaaaacgcaaagattcaaattctacttcactaggcaacattgcttctgctccataaactaggaagaatggcgactggcccgtagaacgactaggggtggtgcgaaaggaccaaagtacggatggcaactgttccacccatttgccggcataaggattcagtcggtcaaaaactcgtgcctttattccttggagtaccatgccgttggctcgttcgacttgcccattgctcataggatgcgctacggaggcataacaaattttaatgccgaagttttcagaaaaatctttaaatactccgcctgtgaattgatccgattgggtaccccaaaccgatgcacaatgttgatgaaaaaatctctagctttatctgccgtgattgtgatgaccagtttagcttcaatccacttggagaatttgtcgatagccacaaagagatgtgtgtaaccgccaactgcctttataaacgggccgaccatgtcaagcccccaaaccgcaaacggccaagacagcgggatggtttgcaactcttgggctagcagatgagtttgttgggcgaaaaattgacaaccttcacatatccgcacaatcttgtcagcatcggacacaacagtaggccagaaaaaaccttgccagtaagccttgccgacaatggtgcgtgcagcagcgtaattgccacagataccagaatgtatatccttcagcaaattgtctcctttcctccaaagacacacagcgttgcacgattcctgatggacttttcttgtacagctcagtctcatgaataatataaagcctgctgcgcctggaaatccgctcggcttcatctttatcttgggggagttcttggttggtcagaaattgtatgaggggctctctccagtcggcttcaaccatggctatgtcttgagtgtccgtggcctcagctgtttctctccttggtacggttggttcgtaaagatgttcgacgaacacgtcagaaggagccgcttcgcgtttggatccaaaatttgctagtctgtcggctgcttcattattgtgccgaagaacgtgggtgagtttgagtccatcgaacttatcctccaacttgcgtacctcttgtcgataagcgatcatattgtcgtcaaggcaggaccactctttcataacttgattaacaactaactgtgaatctccgcgaactatcaaacgcctgattcccaaagagattgcgatccatagtccgtgaaggagcgcctcgtattctgccacgttgtgagatgtagagaaatgtatccatagcacgtagctcagtctttctccagtcggggaaattaaaacaaccccggccccagtgcccgaaagtctctttgacccgtcaaagtgcatagtccaatactccatcttctcctcgagcgtgtcctcttggcactcggtccactcggcgacgaagtcagctaaagcttgggacttgatcgaagttcacggcttgaacgatatatccaaggacatcagttctaaggcctattttgtgatccgcccgtttgcttcacgattatgaagtatatcgctgagtggaaacgatgtgaccaccatgaccgagtgaccttggaagtagtgagataatttcctgacggtaattagaacaccatataacagcttctgaacttgaggatatctcgtcttggagtcggccaaaacctcgctgacaaagtagattggtcgctggactttctgaacatggccttcttcttcacgctcgataaccagaactgtgctcacgacttgagaagttgccgatacgtacagtaatagcggctcttgtgggtgtggtgaggccagaactggtggagtagtgagaagtttcttgaagtcttcaaaggctttctgtgcttcgggtccccactggaaattgtctgttttctttaacagcttgaagaagggcatcccccgctcgccgagtcgtgaaacaaaccggctgagcgccgccatgcatccagtcagcttttgaacatctttctgggaactcggcggtttcatgttgaggatggcgttgactttctccaggttggcctgtatgcctctatgagacaccataaatccaagcagcttccctgacggtactctgaaggtgcattttttagggtttagtttcatcctgaaagcgcggatgctcgcaaaggtttcttccaggtccgtgatcaaatcatccttctgcttagtcttgacgactacatcatccacataggcttcaacattgcgaccgatttgagttgagaaacgtctctggatcatgcgttgataagttgctcctgcgttctttaatccgaaaggcatggtgatgtagcagtaggccccaaagggcgtgatgaacgaagtcttcaagcagtcggattccttcaatcggatctgatgatatcccgagtagcaatccaaaaaactgagcagctcgcagccggcggtcgagtcgactacctggtccatgcgaggcaacccgaaaggatatttggggcaagacttgttgaggtcggtgtaatcgacacacatgcgccattgcccagtcttcttccgaactaggactgggttagccagccaatcgggatgaaggacatctttgatgaagcccgctgctaatagcttggtcaattcctccttgatcgtgtccttcctgtcttgtgcaaagcggcgaagtcgttgtttgatgggtttagcgtcttccttaacatgcaaagagtgctcaatcacctctctaggattaccaggcatatcggatggtttccacgcaaagatatctttattattttgaagaaaggtgatgagcgcgctttcctatttacaatctaactcggcgcctattacagcagttttagtaggatcagaaggatctaggggaattttcttggtcttggcttcgctttctccagtcttggagatcttggtcgtagccacttctccttcgcttgccgtggttgcggccagtcggatgtcttctcgggcgaccgcgatctcgcgggtttgggccatctcgccgctttccttatcgcatgtgacggcttgtttgatgtcgctccgcagggatatgactcctcgaggaccaggcatctgcatcatcatgtaggtgtagtgcgggacagccataaatttagctaacgccgggcgtccgagtatggcgtgatacgctgtctcgaaatcagcaacttcgaagcagacgttctctgtgcggaagttctcccgagtaccaaaggtaaccggaagagtaatccggccgagtggtgtggcagataaccctaggatgactccgtggaagggcgcattactcggcttcaactcggtgcgagggatctgcatgtcgtccaaggtcttggcgaagaggatattgagtgcgctgccgccatcgatgagggatctgcgaagcttgatgttgcgaaccactgggtctagtaccagggtgtaccgtcccgggtggaccactcagtctggatgatccgagcggtcaaacttgattgttgtctccgaccatcgaagatattggggcgtatcgggctgaacagcgttgatctcccgttcagtcagcttttgctttcttttagactcgtaagccagagggccgccaaagatgtggttgagttccttgcgatgatcttgaaaacctgtcggggcatcatcatcatcatccttctttttcgatgtgctttgttctccatcagaggtctttcgtgcattcttggcatattgctctgcaaactgcttgtagacgaannnnnnnnnnnnnnnnnnnntggagttgggatgatgcggacattgggagttcatgatcttgtcaaaagtgttgacgcgcgaacgttgtcggaggagtgtgtggtagtcgcaacaagttcctcaggcttacgcttgcggtccttgtgattgttacttccaacccctcccgtagtcggcacatctttctttggcttccaagtaggacccgactgcttggatgcgataatggagtcttcggctttggcatactcgttggctttttcaaacatctgtttgaccgtcttgggaggcttgcgtccgaacttgccgactagatcttcgtgacgaatccccttggtgaaagcggcgatgatgacgtcgtcggtaatgtcagagatcttgttacgttgttcagagaagtgtcggatgtaatctcgaagggattctccagacttctgaatgacgttgtagagatcaaactgtgtgccggggcgaaggtgccctggaagttggcgatgaagtggtcgcgaagttccgcccatgatccgatcgtgccacgtggtaacccatgaagccaggaccgggcagaatccgctagggccacaggtaagtaggttgccacggccttgctgtctcctcctgctgcgcggattgcaagaccgtagatgataagccaagactccggattagtggtgccgtcatacttctcgattccagtcggcttgaagttggctggccaatccactcgacgcatgtcgttagtaaaggcagctactccatccacgtcgtcgtcgtagcgttctggtgaatggcggtgggcatggcctcgtgctgcacggcgctggttgatcgtatcacgaagatcgacggggcaccgacgaggtggggagaaaagccattcaactcggcgctacttgtgtcgctcaggaggcgagtgaacagatcgctcgtcgtggcccctgctcctgcgattggatcctgcgccggcgatgctgaggcttggctggtgataatcatgagatcggagatggggaacccggctgccagtcgacatgcggacgcttccggagttaaccgggaccgaagtggcaatcatggtcttggtctggttcaagatgttgacgacttgatcagcttgattgagtgcgtcttccttgaggagggtgtcgaggagggtgattttctgcgacaacgttctgttgaggggtacggaagaccgctgtcccctcaacgtcttgctgcccgatgagatctcgcgctcatcgccctgcgtccaaggctcgttgtcgtcggtcctcggcctcctttgcagcccattcgcgttcttgttgctcacgctgcagccgttcttgctcttgtgcttggcgctcctcttccagtcggcgtcgctcagcctcctgttgtacgcgtcgtgcttccgtttctcgggcttggcgttgttcttccgtctcgttgtcggccatgaaaacgctgaaatagagaggggtgtaattatcttcaaagctttcgtcaaagtcgtcgaggtcgcggttgtcgtatcgatagctgaattcgtcgtactccacgatctctgttggtcgtgagtcgacgcaaggggaactgaagtagccttccaattgatccgtcgaaaccgtgccgagtggctggagtatgacgccgacttccctggagctaggcaggatcggtgttgaagctgagttccgcctaggcctacggggaggagacgcccttgtagtgaagacggcagccaaatcgtcggggagtttcatcaggattggcgggtaggccccatcatctcgatctggtgttgttggagtagatgggatctcgtccgagtggtttgaagccgactcgatcaagataagcttggggtagatcttggccgagttcggaataccgaacggggctgagacctggtctctccctgactggttcgaatctgagtcaaggagagagatcttgccgaagacgttggtgatgaagtcgaggttgccgaaccgaaacgcctgcccgggagggaagacgaagtcgtcgatgccggagacggaacccattgcactgatcggcgaaaaacttgacgcaacccctacctggcgcgccaactgtcgaaacaagatttcggcaatactaaaagggtgtggctatcaagctaaaaaagtggatgggtttgaagacaaggaattttatacaggttcaagccttcttagttaagaagtaatactctactcctgtctggggatgattccgccgagtgtattattgatcgtatgatctgggagaaagtcgtgtccctagagggacccggacccctccttatataggggaaggagtccgtattataaaatactgttcatatccctaacggaatatgtgattatagataaattacaatcgtaaccgactagaatctcaggtatctccttgacatacaagtttagaaactaacccgagtcctcataaagatattctatctatatctggtaccccgtacccaaccagactatacatgccgtgtagatatggggtatccataatctccacagtgtcaattctgtcatcttggtaggaatcatatatataatgggtgtaacatgaacatcaccggctgcaacaatatacgctctccatatttataatgggactttcggaagaatgggagtggtcgatctggacaaatttgcgagagcactgagagtgtgatggctatggttcagttgggtgtgcccaaacaagccttgggcagtgacacacccccaccttgtgatgagctcaatagaaaactatttggatcagcaactaaggtggagactgatgcaaagcaattatttgggaatcgaactggattggggaacaaccactcaaggaatctgctccgactttatacaagcatgccaaaatcaaagtaaggtcagtccaggaaagataagctaatgaccaatgggtagacgatatctggcgcaacctcacaaatcagctagtcaaggcgtactttgaggtattcaaccaagtatggagcaacggcatcaccctcacggaaggtgtcgacgataccataactcggagatggacgagcaatggaaaatacagtgcgaggtccgcctatatagcgcagttcaatggaaggataataccggctgcagcaaaactaatctggaaacaatgggaaccctccaaatgcaaacacttcctggctcttgctacaaaataggatttggacagaggatcggctacagatcagacaatggccaaataattgtttttatcaactatgttataggaacctagaaacaactcaacatctctttaaagattgcccttttgtgcgacagatttgggagagggttctaagtaggctgaactgtagtgaaattgacctgacagatgatgaaaatgaactattgctagactggtggatcaggaaaacatctcaaggtgggaaagacaaagccaaagcaataaaatcagtccacatgctagtagcattggaaatatgatgtgagcagaacagacgagtgttttggaatcaagaaaaaaccatgccgcaactgcgggccaagatacaggatgaaatcaagctatggagcatatgtggagcaaaacacatcgcgagattatcaacctaatactcattgattgattagtggtattttctacttgtcttttcatccctcttccctttttcccttttcttctttcatcgctggtgatcatgtaaataattttttccctgcttaatataacaccaggttagcctggagtgttgggtggctgctgcattactaggtgtgtgaatagggtggtggtttaggattaggagtacattgacaattcttctatcaatctatattatatactaatatcccactgcacatcctacaaatacacttaagtcatcacgtgccacttctataaatgctagaaaatctgaggaataagaaaaataatatagctattgaacgtttttaaattggggcatttgcaaatttgccaccggttttttcaattttgcaaggatgccactcgagtgacagttctagtggcatttttgcaattttctagtggcagtcttgcaataacgattcaaagtagtggtaaatttgcaattgtcccttttaaattagtggacccattattttaaaccattttgatttatctgaatgcaggcacacctcctagccctttttaatcttatggttgttcagttttaatccatactttgttatagattaagatatcgactggtcaaattaattccttgacttctctcacgggaggtgaaatcggctgtagagattctcctcgatggcaagagcttcggttggggtatggaatagatgagagatgataaagatagatgtgctagtagtaaactcacaaatacattggaggaagctgggaaaggatcatagtaagcatgattttgcatgcttaccatcgacgttatgttcttctgcgtaccaacgaactaagttagtttggttggaattggcaaacattatcttgatgtgttcggtgatcgggaggttcaccacaacctctacgggccactccttttgacttcttactttcatcagcactagcatctattgtatctagaactcgtgcatacaggacaagcatctaagtcgacgtactcttattaagacaagagctatgctgcaccgatatatagcacaacacagttctcatactctgcttatgagctcaacatgtctaggtacgtattagcaataaatcgaggatcaaaattatatcgatttatctgcgaatggaatgcatcaagaaagaagtgctccgtagacctgcatgtacattctaggattgcaatgctgctatgacatgtcaccctagatcaaccgcgtggttggggttagtatcggtctccttagatcatgtcctctactatttgtcaccaattctaaagcgctgattggggttagcatcggcctcctaagatcatgtcctctactatttgtcaccaattctatgtcctaatatcatctactcgagttttgttgtgctttactgttcaagaccgggaaggtttacaagtgagcgcatacaagtttgagatctctacaaactaaacagggcacacaacatagcagaatagaggaaacacgtagaaaacgagagcgtgaactgctcatgtttcctgagttttctcttttctatttttgtagaaatcaactagtatactcgaaaacgtacatgggcagtgcaacatgggcacgaactgagaaaattctggacaggcacagccaatcaacggagtcatgcaccgccacaaaggagacgactgattttggagaacaaatcagaattctaagtcgagaattccaactgttttaatcaacaccttaattactctatacattatcatgaaaaaaccaacttgctgcatgcaaacgaagataaatgattctccctccgtttcacattataagtcatttgacattcttcctagtcaaatgtctttaaggttgaataagttcatagaaaaatatagtagtattttcaacacaaaacaaacatattattagaatatattcaatgataaatttaataatactagtttggtattttagatgttgctaaatttttctataaacttgatcaaacttaatagagtttgactagaaaaaaaatccaaataacttaaaatatgaaacggaggaagtagatatctcagagccattgcaacatccaaaccacctatgcaggggtggcaatatcattccaaagcagatgttttgtgtggcaatatccaggcagtagaggaaggcactgggcaaggctggggtggaggttgagttcccaacaggggaaaccaccggctacaactataatctccacttgcccgagctcatcgccatcgttcagccatcactagggtggagctcacaccggtgtccctgcctattttgccttctccgcgtccatctccggccggtgagcaggagtgagaggagatgccctcggcgaggctggccttgagaggctcattgctctcctgcctcgctgacccagccttaagtgccggccttccatttcaccccactgtggagtcgctaaagccatgaccatcaacgaagaggcatttctggaggccacgatcctcgtgctagggcatatgggctctcactcatcttacatcacatgtatgaccgcaggcaacgatgtcttttcgccaatggttcacagtagatccaggggttatttttttttaaaaaagtcacatgtaggagaaaaagtggggaaaatggcacacgaaagagaattagtgaggacctgatgacaaacatgaacgaaatagtaaaacccggagctaattcttattatttcttcctaccacaccacacagtacactctttttatatacttatcagaacaacaataagattctgagcattatatagtctgatttcttgattacaccgcatatctttaatcccgaaatcagggccagagatctggcttttcattgggccatgtggctccctacaaatttggttacacccttcaaagatttgccacgtgtcaaagtgatggtattcacgggtgtggatcccctggagttgtctccaaatccacacggtggatttacttaatccaagccgtccctttaatttgatggattagattaaatccaatcccttttcccctggttacaactagcccgttttatttaaaagaaatactacaatgtagagtctataaaaaaatattatctagtatagtagagaacatgttaccttcaaactttctggcaacaattagataagaacaaacaaaacaaaaatattgcaccgatagaagtttcttgttctgtcgattattaggatgaatgagttcgatacaggtctcaataccgttaatttcataacaactcagttaaaaaagtttaaagataattattttttactccatgatctataatgctcttccgagagtattgatctgaatggacggacaacacaaaaaaataaaagtaaataggattatatctgttgtaaatgtgtaattagaaagaggtgacatggctacatctagcccatagaaacaaagtaaggggtcagattggtccaaattcaccggttggagttggaagccaactccaggggatctgcaccctggtattcacttcgcgagatagccgaaaaacattcgcctggatgcacttgctgggtgggcctggccctggcatcttgcaaggccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68393 - DNA, 1119 bp, Oryza sativa
aagagtagaaagagtagtcacttatacgtgtatttggatttaaccccaagagtaaatgtcccgttcccgttctcggtaggtttccgaatatatgttatcgaggacgtcactcctctcaagtctcaaccttctaaaccatagtatgtttttaagtgttaaacgggatgcaacatcctaacgagttaacatggatccatatagtcgtacaaaaatgaaaactaaaattaaaaaaaaaaagatccaaacaattattctaccacatggaaacaaaggttgttcaggtcaaaggaatagctacagtcaagttcatcccactgagaaggacaaatatattcatacttcacttgccctcaggcatttatctcttatccagcatatccattttgtttacagtaacacggtaaaatcatatcaaacaagcttggagcaagcaaaatggatagagtaggaaaggactagcagctttatgcactgtggttgtaagcaagccgccgccagagaaatgcacttgccgtgcatacacaaatgaggccaacttgatgtacagctctaccacttcatctacaatgtacaatctaccaatctgctaacacaagggcgcgtggcgtgtgcttgccttgcgcatgagcaatctgtacaaatcagcctaccattcggggctactgcaagacttcagggagtaactggagttaatcaggcttgtagctgcttggatcttcgaaaaactctgctggaattgatggtggagagtacttctttgctacgaatttgtactgagaacaaatagataggtgatagaaacaatttattaccaaatagaagtaaatgcgttccagcaacaatggccttattttgacttcactcaccttgtgttgactgtatttttctctaactgctcgaaggttgcctccagggccaaccaagaaaagccggtgtagtccttttgcacaattgcataggtcggatggtttgtattgtgtgtagaatgaaagtgttgaattctgtttccaatttaagagagaaagaaatcaatacatttagtctagtttgcagaatagcaataaaatctgcaaagtttaaagcattatacccaaggattctctgttggcttaaggataa

SEQ ID NO: 68394 - DNA, 888 bp, Oryza sativa
tccttatctagccaaagttatcatctgtaaaagaaaaatgaattcaaaaaagattgttgtagcttcctaacatagatattcctgacttattgtcaaatgttaatcacaatttttaccatcaaatgtagagaaaaaggcaagaatcagcaaagttctagtatgcttagttataataaaagtatcagtgcctcttaatggtacaaaggttgtctctctgcattgtgcatacatttgtatctgaatccataatcctaatcgatcatcatcacttttgctggaatgaccgaaggaggtcattcaatgtaattaagataggaagaaaaatgttacaagaaaagttttacatcgacagctggctgtcgaggaaggatgtgcaccagagcacacgccccgaaccatatgccaaccgcccaaacacacgctacagagagggaagccaagcaccgaaccggccatcgctatgcgagaccgatcgccaccgggccaacaacaccaccacgacacgaatactctaaaacgacgccttcacgagggttgcgacgccgaaagacgccgtcgtcatccgtccaaggaattggacaaggttttcacccagagctccttgccgagggaggatgggtacctcaacagtgccctcaggagggttaccacgcctgaaggcgaagtcactgttggcccaaagaaattgggctaagctttcgctcagaaccccctaccgccgtggtccgtcgcccaatccgaaaccaccatctaaacatcggcggcacatggcttccgccacacttgaccgacgcccctccgctggccagcttccagtcctgccaacaacaggactgccaccacacagcaccgacgccccaccatcgactgacttcaacgaacctccat

SEQ ID NO: 68395 - DNA, 2249 bp, Oryza sativa
agcaataaacaggattaaccgaattcggtcttgccttttcctaataacaattcattccttgagttttgactaaccaaattttgattgaatgcgcacccgtagacaggaatcaattatatagccaatttatttactatggcactgtaataaacactttctctgaaagtttcctgcatgcttggaaccaagaatatatatatatatatatatatatatatatatatagctgttagagaaacattgatcccaattgttgtaagtagaagtacatcactgaaacacatgttcaacagaacaatttccaagacaagctcatccctgaatcaaaacttacaatgacactcatggtaaaacgagcctgatacaatcacataaaacaaaatcaattgcgcaggataaacattgaaacaggtatgaacatgaactacgagaatcaatcaaaacattgaagataaaatattttcttccttcataacataatttgtgcaattgtcaagaatcaagcaatcgtatcacaagataattcagatattcctcaaatatgattcttaatgagcttacaaagttacaacttacaaatcaacaataatgaatggagtaaccatcacctcggttttgtcgataggcaatataattggccaggtgtagaagtcatgctgccttctcttgatcaaatcctgaaaaaagttgttcccttgcatcagaaagcaacttttctgcaaacccccgtgatttctccagcccaagtaatttcgggtatgtcgtcttgtcactcgccaagtcctcccctgctgtcttgccaacctcctcagaagacttggtcacatcaattatatcatcaacaatcctatcaacctcgcatacatgcgcaaccgttcaatctgctcataagagcaacctcccaagattgccccaatatccattgatgcctcaagaatttgatgcctattcttttttctaattaaaatgttactaatccaaccaagacaatgtaatctcttcagtaaaattgtgcttaagcagctgtgagatttgagcctaaatgatatctcgagttaaatcttgttacttattttcaagtattataccacaagagggagaagcaaaagcctcacctcatggagagaggagcggcgtggctacattcactatgaaaggctttgagcaatagacaggattaaccgaattcggtcttgccttttcctaataacaattcattccttgagttttgactagccaaattttgactgaatgcgcacccgtagacaggaatcaattatattaccaatttatttactatggcaatgtaactaaacactttctctgaaagtttcctgcatgcttggaaccaagaatatatatatatatatatatatatagctgttagagaaacattgatcccaattgctgtaagtagaagtacatcactgaaacacatgttcaacagaacaatttccaagacaagctcatccctgaatcaaaacttacactgacactcatggtaaaacgagcctgatatagtcacataaaacaaattaattgcacgggataaacactgaaacaggtatgaacatgaactacgagaatcaatcaaaacattgaagataaaatatgttcttccttcataacataatgtgtgcaattgtcaagaatcaagcaatcgtatcacaagataatttagattttcttcaaatctgaatcttaatgaacctacaaagttacaacttacaaatcaacaataatcaatggagtaaccatcacctcagttctgtcgatataggtaatataattggccaggtgtagaagtggtgctgccttctcttgatcaaatcctgaaaaaagttgttcccttgcatcagaaagcaacttttctgcaaacccccgtgatttctctagcccaagtaattttgggtatatcgtcttgtcactcgccaagtccttccccgctgtcttgccaagctcgtcagaagacatggtcacatcaagtatatcatcaacaatcctatcgacatcgcatacatgcgcaaacgttcaatctgctcataagagcgacctcccaagattgccccaataaccattgatgcctcaagaatttgatgcctattcttttttctaattaaaatgtttctaatccaaccaacacactgtcatttcttcagtaaaattgtgcttaagcagctgtgagctttgagtctaaatgatatctcgagttaaatcttgttacttattttcaagtattataccacaag

SEQ ID NO: 68396 - DNA, 8567 bp, Oryza sativa
  unsure (1)..(8567): unsure at all n locations
cactccacgcactgccggagacaccggaactcaccctccaccgcagaaggcttgatccggtggggggagggcgaacgaagcggaggcaggatccgcgacgaggagggcagccaccggtggtgtgacgatacggtggccgggcgggaggaggtggggaatgggaagcgattgggggtaggtgtggttgtttttcaataaaaccccttgtgtttattatgtttacaaaacggaattttctcttcttcttcgcatagtatttctctaaaggataaggggtttttggggaaaaccataacaggctgtcaggcaattcgagggttatatatggacaagcagttttttttttgcaaaataaccagatcccacgtggcatacatgcacagtgaaaacgggcaccagcggtggaagaaacagtcacgcggtatagtcaaaggcaagattaacagtgagattaccagcaaaccgcattttcccggtcgcagacacgctcgtgaggagccgtaatcacaagacgacgacgtgtaaaaaaatgaggtagccagaaaaaaattcaaaaaaaggagaaaaacagtacggttaggggagttattgattgattgatgatccatccacctacccctccgaagcacatcttaattcttgacaaggaattttgttggcacatctttaattcttgacaagaatatttttttgtcatcttggtgcacgggtggcatgagtgtcacaacctcatttttttctcatacttatacttatacttataagccaaaatttaaaatttaaaaagttattttagagtttattttataacatttgtttttaaattactaagaacacatatataaaagtcttagttacaaattattttttgttgctaataaatcagacggataaacatacgtataaacaaaatgatgggctctatctcctgaaagtttgtagaaaggtccttttcaacaaaacggcggggaattgaggaatgatttatacatgaaaaattcatgtagtgtattttaaaacggatggttgattaattcattaccattctcacgcaacatacctcatgtttgaaatataataccaaaaaatgtgacaacatgatgatttggagaatttgaaatcttatgggcgaagtgacacgccatgtggataataacataacaaaagtcatgtttataagtagaaaggctattataatttttaaatatattttttcaatataaatttgtgcattttaagcgtatatattttccgcggcaaagcgcggaggtgtcgtctacactagcacgggttcggtgatctgtaacgggctgcaagcctcatctctattgggtagggccccgtcgcagagcaaaggtcgctgatgtggtaaaatatctcaatcgggcatccggccatcacggatgacacacatcttaatcgtgccaacacaaaaacccgtcacggatgactctcatctctaacgggcctaaacgatagcccgtcacagatgactcacatctctaacgggtctaaactatagcttgtcaaggatgagtataatccaaaaaaaataaattttgtttttttctagcctcatgtgcctctcataggccgggctagtcttttctacacactttatcctcactctgtgcacccgggacagtcatccgtggcgggcgccaacttaagacccgattgagatatgaaatgttatctcaatcaggtctaaactacggcccgacactgatatgtgtcatctgtgatgggcctgagttttatgcccatctaacatgtctatacgaccatatctcaatcgggcattttttcgacccgattgagatgactttcttgtgatggcccgctaattctagaaatgttacaggcctcagatatggaaggttctgtagctataactagttagttcgactacgcgagcagccaacactaatgtgtgtggatccgccaggaccaagctgcctctgagacgaaattctacaattgctccgtcttgcagcaactgcctcttgagtcattaacatgacggcggcctcacaggttgttttgctcctccgctcgagagcgttgtggttaatcagttgatactagggatgcctgcttcggttcagtattgtggagcaacatataacttcctggtctaggtattactcccttctttcctaaatgtttgacgcccgtgacttttttaaacatgtttgaccattcgtattatttcaaaaacttttatgaaatatgtaaaactatatgtatacataaaagtatatttagcaataaatcaaataatagaaacaaattaataattacttaaattttttgaataagacgaacggtcaaacatgtttaaaaaagtcaatggcgtcaaacatttagggaatgagggagtatcatttttctaggacaacattcaattcacatggtagatataaattgagtgcaaactgtagagggtggaaacaaagccttcaatatccctgtccctagttaacactttggttctcctccatgtaaatattttaggcatagtagagagttcctcagacaacacatatggtgcctccctgagctatgtattcagaaatgtcgctcacaaattttcatttaggctggttttcatggctttgctttttagggatacttccatccaccatagaatcaaaagtgataattattgactgcgtgttaagtagtgagttaattagcatgagaatggaaggcattgggatgccatactatccagaaatataacatgaagctagttcaacccaattctttctgcacagccttatgcggtgtgagatacgcaatcaaagacatggattgctattgcgacaccaaagtatgttcgtcaacaacatgcaaccctatagcatccaactaagggtgtatttacttcacgctaaaattgaaagtttaattaaaattggaacgatgtgatggaaaagttggaagttttgtgtgtgtaggaaagttttgatgtgatggaaaaattggaagtttaaagaaaaagttgggaactaaacctctaaaattgctataaagcctggtttagttccaattttaaagaaaaattggaaaattgcaggtcaactaaaagcagggccatcttagaggcctaggctggttgttctctaaaatatagagccagccttgaccgaatgtaatacgtcatagaattgtcgtaaatagcaatccattctaggcacaaagagaggaaaatgatatgtaagggcctaagaattcatgctatttttcctataaaactcatgggtaattagtccttgacaactttgtagaaaaataacaactcctttgtttttccttataactgtccataatgcagccctaccttcgatagatgaatattcacaccaaggtcaagaaaaaccaaagaataattacatttttgaattttcttttcttatgaaacattgcaatattgattgtcgacctagtcaggtagtattttcgacccagtcaagtagtattttctttaggtggataatgaggttgtaaattttgattaaaggtagaaacttcaatatctccagagggggaatatcatgtttttccctaagaaagaaacaaggcttgtgatgtaatttttatttgaaatttatttgttttgaggaaatgttaatgtaatttcaaaaccgacaatgggtagaaggctagaacgaacaaggcacggtagcccatttgcataagaccgcttagagcatctccaacagcctccttagtctactctccaagttaaattttagcaattttgacaaaaattcgtgctccaacggactggccaaccgtatggccaagccatccggctggccaaagtgctcctcgcactggccaaatttggccagcaaaaaaggcctagccatttgtaggccccacgcttttccccctctcactctctctccctcccgtgtactagtactactcccaccgctcgccagatccagcgcgccggcgacgccactccgccagcaccgcccctctgcgcctctcttccgcggtgccgcccctgtctcgtctcctcgtctgcttgtccactcctctctcgcctcgtccagtcctctcttgcattggccggccacgaccgccgccctccgcgccgtcgccgaccgccgccctccttgccgttcccggccgtgaccgctgccgccgtccgcgacccaggtcgtcgttgaggtcgtgttgccgaggtagtcatcgtcgcgagcctccgccgccgccgctggccgtgaccgccaacctatgcgcattcgccgtcaccgcatctctctctacttcgcctgcgacgccagccaccggccgccgaccgctgcccctagccgtcgtcgacctccatgcccgcatcggagagaatgtgaaggaggaggaggaatgagagactgacatgtgggacccgatgttaaattggagaatgtgaatagagaggctattggagtaaaaggcaaatttagctctccaattattttatggctggccaaatgagtatttggagagatcaaaatagccaatctgttggagatgctcttattggacccaagcccaaccgaagaaccacaagtctcaggactgagctgataccatttctctgtgaaaacaattaattctatgtgataggcgtaaattgattgcagaccgtagatggtagaaacaaatccttatccctagtaacactttggttctcccattggtgaatatattagcacagacaggcagctagctcctcataagttgtaaccaacacatatggtgtctcactgagatagggaataaaatggtgctccaaattgcattttaggtttgttctcaacttatcatatcttttgcttcctagggatgtatatattacttccatccaccatagaataactgtgtgttagctatgagttagcatgcatgagaatggtaggcattgggacgttatagaatccatggaaagaatatgcatctagttcaattccattatcactgcaaacccttacgcactgggatactcaatcaagctaaggcagggattgctgttcgtgcgcaacagcttctttgtcaatagcatgcaggctctaatgcccatgatgcaaacttactgaacagttccatcccaatgcaaaatatttgagatgcaaagaagaagtacaagatgtaagaccccaagctcatttttcttataaaaattgtaggaataagttgtccttgacaactttgagaattctcactcttttaggtttcatattgcttttccttatgtacagccatatttcgatcaatgagcctttctctccgagatcaagagaactaaagaattcgagagaagattaaattggttaaaatctcggaatcctttttgttccgggacattgtaatttcgaatggccgatcttagtgaggttgtagatttcgaccaaggtatatgtaaaatttcaatatttcgagggtaaaatgcatgtacattcccttagaaagagtagagaaacgtccaggggttttctggttagctccacaagatggtgagctagatgacttgagttcgaaggctcaccccttctaattaattaatattatgtcattttctaatatttacgtcttttctttcttagaaagagcacaagaactgtagtgtaattttatttgcaatacttttgttatatactatttattttccccaagggtgtgtttggagctgttagcatgtggtgatggtgtgtttttattttcctttttgttttcttgattatagcatcccagagtttatgttttttctctactatattcaatgaaattgacacaatcatgtgccggttcgttaaaaaaaaaactttgtttagaggaaacggtaatgctatttgaaaaaccacatagaagggtagaacaacggcagcccatttattattgcaaaatgcggcctgttggaccacagcccatctggagaacaacaaaagcatcacggcccaatccaatagcatcacgtgcacacacgctggtggactgtggtttcatctcgtcaactcttgggcccccacatgcaagggacagccaactgcctccggttcaccgaacgcggtccacggaacaccaccacctcatttttggcggaagaattggcgccaagccgcctcctccttcccgccaagaacaccacccccacccaccttgttcttcttctacttgttcccccaaccaaaaccctcgcgcccccgccgcaccacccgcgcagccgcacagcgcaaatcccccccaccccgcgcaaggtttcgagaggtctcgtcggagatggaggcgttcggcgggttcttcgtggacgagaaggcggcgcgggtggagaacatcttcctcgagttcctcaggcggtaaggccggagccgtctccttccattccatttctagggtttaagcggggttccggttcgtctgacgcgtgaggtgggggattattttattttatttttgttgaaacttggatctgtaggttcaaggaggcggatgcggcggaggcgttctacgagacggagctggaggcgatgcggtcgcgggagtccaccaccatgtacgtcgacttcgcccacgtcatgcgattcaacgacgtcctccagaaggccatctccgaggagtatctcaggtgagatttgatttgatttgaaattttttttttggtggggagttcagattgggaaattttgggatctgtccctggatttgctcggatttgttcagagaactcggttgatgtgtacttagcacaaatagaatttttttcctagaaaaaatacaaattaatttgctcatctgtgacgacaatttggaactgactgcttatgtggatttcattgcatcaggttcgagccgtacctccggaatgcgtgcaagaggtttgtgatggagcagaggactggcgagaaccgtgcaccaatcatctctgatgatagccctaacaaggacattaacattgccttctacaacataccaatgctgaagaggtccgcacttgctcctccaggtgtaacagtttttttttccctgtaaaattaactctggaaataacagttatctgacggcaaatgaacgaattctgcaaatgtcctgaaattcactacaaaagtgtgatatatacatatattcaagggtggggctcattgcccctggaatttcatgttagtacgtttcccacatttggtagaaaattatgtctcactttttatcttgcatttctaatttgtcataggttttatgctaaattgtatgatggttgccataacaattgacttaaattgttgttgtaataggttgagggagcttggaacagcagagattggtaagctcacggctgtaatgggggtggttacacggacaagtgaggtccggcctgagttactgcaaggcaccttcaagtgccttgactgtggaaatgttgtaaagaatgttgagcagcagttcaagtatactgaggttgtaactgtgaaccttatgttctacttttttctctcatgcaatgtgtctaatgaaaggtttctgctccttaacttcagccaataatatgtgtcaatgcaacatgccaaaatcgatcaaaatgggcccttctccgacaagagagcaagttcacagattggcagcgggtcacgatgcangatacatcaaaagaaatacctgctggttcactaccacgctccctgnatgtcattctgaggcatgagattgttaagaggcttagagctgaagacacgtgagnaactcttgctggaattgctttgtacccattggattggcttcacattaaagtattctgtttcggtcattttcagggtcatatttactggaactgttgttgctgttcctgatgttatggctctaacttcacctggtgagagagcagagtgtcgccgggaggctcctcagcgaaagaatgggtctggtgtccaagaaggtgtcaagggcttgaaatcactaggagtacgagatctgtcatatcgccttgcttttgtagcaaactcagtgcaggtatgacctctttccagcaataaatatcgatctggttagcttggttataatatttttattacaaggttaacctttctctttaatgttattaggtggcggatggaaggagagaagtcgacatccgggacagggacatagatggagatgacagcgaaagacagaagttcactgtaagttcaattcagactcgagactagttactctgtttcgaagaaggaaaagggactagccttgtaaaaagaactatgagaaattctgtttacatggtattcgaacattctgttgcatgctagcaggctggcatggataggtgtaaccataccagcatcctttttctatttttttgacaatgagtatcattcaagctccctaaacttttgcatgatcctggtgcactgttgatttagtgtgttacatattcatgtaaggatgttagatcatgaaatggttatcattccacttttttgtttttgtgtattatattctttatttttgatcatatagttttttgtcatcaaagtgtttatattattaattatctccctcccccctctctcttacaggaagaa

SEQ ID NO: 68397 - DNA, 2340 bp, Oryza sativa
gttgtggtaaaatttcagtgctgagatctaatatttcaatcgttgcaatccttatcagtataacgtggcatggcctccagctattctttcaagatttgatctggtatacataatgatcgatgagcctgatgaaaacactgactaccacattgctcatcacattgtgagggtccatcagaaacgtgaagaagcacttgcccctgcatttagcacggcagaattgaaacgttacattgcttttgcgaagtccttgaaacctcaggtttatatctttatgcacttcatatataactttcaacttgtcatcaacttatagatgctttatgtcaatgcagctgagttctgaagcaaagaaagttctggttgaatcatatgttacccttcgtagaggagatagtacccctggtactagggttgcttataggatgacagttaggcaactagaggcattaatcaggctttcagaagctattgcccgaagtcatttggaaagagttgtaagtaaaatcctcattcatatattgcatgttttttagattatgcagtatggtgtctaaataaattaacttaagttcaacaatcaggaatagtattattagttggttgtggtgttaaatttaaaaggctgacatttgttccctccctttgcattggggtttttcaccttacggcataatatttctgctgacttcatttgggattaatttcacaggttctcccagcccatgttcgcatggcagttaaattgctcaagacatccatcatcaggcaagtttcttgaaattgctcaagacatccatccatcatttgcatgatgatttgctaacaaaatcttattaattgtgcagcgtggaatcaagtgaagttgatctctctgatttccaagatgctgatgatggcacaaatgtaccagccgataatgatgctggtcagccaacagaaatggatgctgctcctcaacaagacggtccaggtaggtttccccttattattaaaatggcttttttgtgtgttcttgctattattctgatcattccggtaccttgtttttaatgtaaaatgtagaaaatgagcaagcggcagatactggtaagaagaagttggttataaccgaagaacatttccagagagtcacgcaagctttagttatgagactacggcagcatgaagagtctgtcacgaaagatggtattgatactggattttacactacctttccatttgttttgttttgacttattcgctattttgtatccttaccctagcaatttccaactgtagaagaagcatagtaatatctgcttaggttcaaataagtgaattaatttttactgcttatgtcccatataaggagtaacaagatccttagttgtgatttacttacataattatgagcagcatttctgacacatgctttctctcgagaacaaatgaaattacgatctcgtctagattacagcttccagaggtctaggttggcgagcaattctttttaattgcgtaaattaataaatcctttgtttatattctagaaaaacataatttgcaataattgtctagtactattgtattgctttagcttttgttcttctcttacatcttactagagaagatatatgcatcttcttaaaattgatgtggagcctcatgcaggcttgtagatgcatcaatgtgattaacttgtacgccaaccatttatacagtgtagtaagcataaattgtagttatgtctattcaggtttcaccatgttgatgtctcgttatattgttaggacttaatgctatctaattccgctcctgtataagtcattgcttttagttcatcttgtgccgccctaagtgtttccttttatgaacaaggatgatccttgtcagacctccagctgatatagatgtcaaactgacatgttccaacattgaattgcaggagatggtctggctggcatgaagcaaggggatctgataatttggtatgttgagcagcagaatgcccaaggagcctatagttctacagcagaggtgaaggaagaagtgaagtgcatcaaggccatcatagaggtaaaagccttcattgatcttatcatctatgtatcaatttgcctgcattgatcctatcagttcaacagtatggtatggaaattaacctaacaagactacatttaaggcatttagctgcatcaatttgcctgcactgcaagctcaacattgaccatttatattgagcattacctcagctttccatgttgctaaaagttatcaatcgatttgcaaatgcagaggttaatacagagggatggccatctcatagtgatagacgaaggagcagccccagcggctgac

SEQ ID NO: 68398 - DNA, 2671 bp, Oryza sativa
tatcattcagattcagatgattcgagaaacgtacctttggctacactgtttttagctaacagagagtaggaaaagagcattgtttattttgggggatttgcaattatgacactgcagatattaacctttgctataatgctactagttagctgatatgaattgttggagcttgacaacgtcacaagcagaagcttgcaggttcagaacgtggcactgggtttgcaggtgttgaacagcagcttcagatgttaaagacactggctctctctatcaaatgagagtgactgggacgcaaaaacagcagcagccgtccgttgtttattcagccctgcaggctgcatttctacggcaaaaatcttatttctaacccagaaatcaaacaaccaaataggttgatttgtttttttaatagtaaaagctttcttgaactcagtaagttacattgaggttgattcgttggcctgacaatccgcaaaaataaagactaagaaccgaaatcggaagagctagaaagctcagttaagaagatatcatatttttttttaagataatggaagctttattaatctcagtaaaattctatcaagtgaaacaattattctgagagcacctcggcttctgcacccaaagagtgcacacagccaacaagaaagaaacaaaagataaactcatcatccaaatagcagggacaaaaagaacttcaggagccctctaaccgtagcctagaacgccacccatgcgccggggtagaaaactccatggccactagctccaattgttgacaagccgcaatgatagtaccccgcaaattgaccttctgaaggatagcctatgagcggagccaagataacctgcaaaggagaagatatgttttttctttcaaaaaccacattatttctacaaagccaaatagaccaaatagtggttgttgcccctaataagaccaaagatctcaaattgcgtggttgtcttcttatccaatgcccaaacatatgagttgtactattaggtaaactaatattcgaagcaaactggattaaagaccaaactgcgcgggcaaaacgacaatcaaacaacaaatgattaatagtttcatctttgtggcagaaagaacaagactgtttcctctccaattccttttaataagattattttttgttaagactactccatgacgtaagtaccataagaagatcttaatctttagaggggctttgatcttcctgattcttttgtttatattgggaacatcggtctgcaccaacgcaagataaagagatttaaccgagaatctcccatcagtggttagattccatttaaactcatcttggtcgtgagataatataatattagcgatgcgtgagagaaggtgattccacgccactaacttagagccagtaaggtccctgcgccaagaaaagcttataggactggtttggaaaatttctgaaatagttgcatgtttatgcctaacaacgttatagagacaatgatattgttctcttaaacaggcattctccaaccatttatcttcccaaaaccgaacttgagagccatctttgatgttgaaggagccaaacctgagaaaatcaggcttggccttcattagactagcccaaaagtgtcagtctcctgctttccactgagcttgagacaaaggctgtgaccccaaatatttattccttagcatttgttgccacacaccatctgtagtgagtagtttatacaaccacttgctaaggagagccttgttcttaatttcaagatcttgaattcccaaccccccttggtctttaggacaacatatgatgtcccaccttgctagtctatatttccttttgtgtccatccccttgccaaaagaaccttgatcggaaataatcaatcttcttgatcactcctttaggtatttccaaaaaggacatcatatacattggtaggctggtaagcactgaattgattagtgttagtcaccctccaagtgataaaagtttgcctttccaacttgccaaccgtttttcaagccattcaatcacttccttccactccgaattacgaagtctcctatgatgtataggaatgccaaggtaatggaatggaaaagaaccaacctcacattgaaaaagattagtatattgatctgagctgtttgggcttcaccaaagcagtaaagctcgctcttatggaaattaatcttcaagccagataattcttcgaaaacgttcaacaacatttttagattacaagctttctctagatcatgttccataaagagtataatatcatcagcatattggaggatggacaatccaccatcaatgagatgatgcaccagtccaacaagctgtcctgcattatttgctctctggatcataaccgctagcatgtccgctataatattgaataaaatgggagatagcggatcaccttgtcgaaggcctttctttgtttgaaagaaccgtccaatgtcatcattaactttgattgctacacttcctcccgaaatgaaggactcaatccaagaaatccatcttggcgagaaacctttcatgcgaagagtttgtagtaagaaaggccattttactttgtcataagccttctcaaagtcaatcttaaggatgaccccactcaatttcctgcgatgcaactcacgaacagtttcatgtatgaca

SEQ ID NO: 68399 - DNA, 21722 bp, Oryza sativa
ccaacatcagcatataataaggattactataaagttgtatgaaaattcattaattgccaccaccactggacgtgtttgtacgtgccattcatgattcatctatatggatcgtatccaagccagtggtgtttgaatctcctgaagatgaagatgaagataaagattaagtgtttcacgtaaaacgaggtggtaatagcgtgtgattaattaagttttaattattacaaacttaaaaaatggattaatctgatattttatatcaactttcatatagaaagttttcgcacgaaatgcaccgtttagcagtttgaaaagcgtgtcattttaatccaaaagtttatcctctgaaattagaggaaacgtgccttcaacatcatcctgggtgtggacctatgatgtaaaatttacatatgttgttaggctaagttgccccatagaaattgacaccactaacttctctgctcctcaatggtcttcctgatagataaactaagacatatgggttctcgaatgtgcctatgtcattgatgacaatatcacaatgccgatagcacatacttccataagaaaggcaccaacaaacaatgagtaggtgattgcaagattggccatatatactttgaggctgctacaaatggtgcaaaagcaactaccatagagatgtggactaaacaccatagtagtactagatcacccccactttttcccttggatgtccgaggttgaagctcactgaccagatccaggactacggcatggggcggggaagaaggagagccgacggtgcagttcgggagagggtgcgcggtgcacggaggagatagagggtggcctccttgcgagcgaaggggaggtgcaaaatttatatttctttttctaatttatgtggtgtttggggcaaaatattgtggtttcctgtaaattacaaaatatggggactataattaaaaaaaaggggtctggcatgcaagactgaaacatctctaaaaagctactttgcactgtggggagaaagtcatttgagacatgtgtctctgtcctatgtggcactacgaggcttctcgtagtagtattttgcactgtgaatggccctagagcaaacagtaataataattacaaaaaagaacaagcattattactattgtttaatttgtttgtttgttttaatgctaccaaacagtatgctagcagatacataatgttgtcgaaacgacaactgcatacgtcgaaagacgtggttactcaacagtggttggaaaaatgaaatgtattaaattttgaatttcacttgggatccccccattacatggccctaggggactatttatagccccattacaggttcttactaccagggtttaggttgtacaggggaatttacatgattacccttataaaagggacatttataggggtacataatgttataggggctcatgggcccctgatgggccgtctggcgatcgccggccctatagcccttaggcttgatgggccggaaaggcttcctcggccctcgcgggggcgaacttgtcatggcgaagtcgtcttccttcggcaggtagtcttcgccttacaccattcgcctgagacgcctctggcctggcaaggcactcgtacgactcttcgcctcgcgccgttcttgcttcatagccttcgccacgggtttcggcagatttagtcgaagggcctcatgccatccgccaacaagcccctcacgggtaagggtgagattggagcttcggccgagaccgtgcaaaccatgtggtatggtatgcagcgccccctttcgaccgatgctcctgccgaaacctacattattcctgcgaatgaagtttgttacttgtgcggctggtattattttgccgcgcttcgcctcctgcgattggtggttatatatattctcttttcctgggccgaacagaacagtattgggccttcccatcgtgggctttttactgtgctgctcgatcggtgggaatttaccgtttcgcctacctttgcgacacgtggcgctttattactggtgggtaggcgaacggtcgcctgggtgggctatatattcccactgctctttccttttcaccaccacacttgccattttaccgtgcgcgctctcttcctccgtctcttccttccacagcatctttcgacccctcaggcgtttcgcccaatctcttttttcgtcaccgtaaacgcaccgttctccatggcccctcgcaagccaaaccctgcttcagcgaaagggctggatcccggccgagtcgatgatgacagcaccgcctttttgggggtctctcttgtggacgacgttgagctggcgaagctggtcagctctggggcgttggtcgcggggcaagctttcgccccagggaaggccgtggtgccaaagcctatcgacaaccggacggtggtgttcgccgccttttttgaggtggggctacggtttccgtgcaacgtgttgttgccggagatccttcgccttttccaggtggagcttccgcagttgagcccggcggcgctagtttgaatctccatctttgactgggcatgccggacttccgggtttgagcctagcgccgagctcttcggcgccatattcatcgccaccgtgaactcgaagacggtgattaccccggctggaacgaagaagacggtgttcgccccgagcggtccgatctctggccggtgaacgctgccatgtcgaggtggttctatcacaccatccctttcgcggctggttctgactcggcaaaagccctccggtgccggcgtagggcgattgcgccgaaccgaaaacccaagatcgccgtggacggcgctatggaggcgcggttcgtcctgttgtgcaaggtttgctcctgccttagctgccgtgacttggtggaggagttctgtatgcttcgcatctttcccctctcctagtcgtggcaagtcacgatcgagcaatgggaagaagctgacggtttgccgaacttggttcttcctgaggggacgaacagtaagaccgttcttttgctatacactcctgtgttttgttattttgtcttgtctgacctttaacgcagctacaccctttacttttacagtgtcgaccctcaactaggccgaagccgaagcccgcaggatgatcggcgatgtttcggtagtcgagtatagccagctgctaacgtgacaagcggctgggcgggcgaaccgggtttacaacggcgaactgcctccctgggcgaatccccaaaaagccgatgacgatgcgggcccttcgcgaaagcggatgcgtggacaagtgaagcttgcccccaggaagcgaagggttcctgcttcgtctgactccgacgccgatgacgaggatgatgccgaagaacgtgacggcaaggaggaaggagaggaagaggaggaggtggaggctgtggctgataaggccgcgaacgaggcgaccgaagaccgcgtcgacacccccggctacactcctaccccaagtccagatcacaacgagactggggtggagtcgaacagctcccctcttcgccgaaaggatttggaaggggcgaaggccttagttgcgttctcgtcgggcaaggcggcgaaaggaggtctggtcaagaagatcttaaaaaagaagggattcctcgacatcgctcgcgttttcagcgacgacgagtcttctgacgagactccgacctcacctgctggccgcagtttggacctttcggctgctccccttgctccgctcggcgttgctggggcaggcggtagcgccgccgccggggcttccgcctccgccgaacggatcttgtcggctgcggcgagggttttcgggagccctgtgcgcgagccagccatttcgccgctggccaaggcgaaggggaagtgtgcggccgccgaagcatttgcctcggagtattcccttgcggcgccccacttcgcccctggtgacttcgagacccggccggaccttattccctttgtggagggagtaagcaatctttcttgcccgccggcaccccgagcctgttcaccgaacttaacgagttcgacgaggggtgttccaccatcaaaagtctggcggttcgggtatgccttttcttccttcttcgttttcctcttccctcttttttttacgtctcgcagttaacctttttttcttttcgcccgctcctatctttcatctagattcttgcggctcactgttcgaaagagcgaaccgtgcgggcccgttttgacggttttaagagccgtcttcgggccaaggatgatgaaataagccgcaagaacctggaggtggagtccctggtccgcaccctcaagaaggcgaaaactgaggtcaaacgccttcagtccgaattggacaaggggaaagaggcctgggccgaggttgatcgcctcacggccgaactggagaaggagaaggcccattcggcggtgctcatcgctattacaaccttactaagccgaagatggagtctcttcgccagaaggctagcagggccgaagcgagtgccgcggaggagtcgcagcggttttcgcaggagatggcgaagaccaccgaatctgcgagaacagcttgccaaacactccgcctcgcccttaccgacatgggcgcgaaggtgcggggggtccctatcgaggatgcctcagccttcgacttctccgagtggacccagcaggctggcggattggtttcggactgcgccaccgcgtacggcgcgattgctgtgcacgtgtatcggcggctttcaccttaggcctcttgcagcagttcggctgcgagcacgtcgccgagttccctacctacgcgaagtgggactgggagattagtgcgcagaatatttcgcccgctcttcgcgcgtggcgaaaacaattctggcagaaagacggccggtccgctgccaaggcgcgccttctggagcaactggcgaaggcggaggcggcagatcagggcgaaggagaggacgcggtgggcgaagaggttggaggcgatgcctaggatcacctagaggtgtgaggccctccgccctttccttaggtttttgtagttttgcttccttttttgagtttgcctggagaggcgaatggtgtacattcggcaggctgtcgccaaaccttaaaaaaaaaaggcttttttttttgtatatttggaatgtgtgacaatcttaattactttttgatgatcgaagtctttggcgtattattatttcgctcgtctcgcattatgccatacctcccccttcttccgcctattcttactatgtaagctgcgttttgctttttctgcactgtccatcagggggttcgccgaaagtcgttcatccggccccctttcgggagctggcgaagtcaaaatgagaaatttgtggcagtgaagggtctgccgaaggtgcgatgtccatttcggcctgtttatcgcgaaatggagataaacggtcgcagttataaggttttcaaggttgccaactggctgcgggcgcaccccgggcgaaccttagaagattacgatcttgttcattcaaaacgtttggaggatatggctcgcttttggcgaaaccatcagaagactaatcgtcagggaacgaactttcagcgtcgttacagtttagtttgtgttgcaccccccactcctcttaaggttgtgtacgatattagtagtgatgacgaacctagttcgccttatcattccttagagagggatagtgattatggggacgaagatgtaatttacttgtaaggtgaattatgtcgtgttgtgaaacttctattcttcgattatttttttcgaagttaataaagacgtgttttatttccttttcgctattgtttgcatcgtcacattttgtgcttccgttaggtcggaacatgccggcccctttgcatatattagcgaaataggtgtactgacttttcagcttttcgtcgttcatctttgatctgtagcgttctgtgtcgagagaagcgcttttgcttttatgctgatcggacgtaatgtcgttcggctatttattttccgagacaagctgttgcggtttcaacgttcggcgagcgatgcttcggccgattcgtttcgcccccctggcctttttcgctgatcaggcgttttccttggggtttttccacaaattatcaatcacacgaaaaataagaagaaggcggaggacacagagattttatactggttagggcctccatggtggataatagccctacatctagttttttttttctttttctctctttcttcttttttttcttgccgaaaggcttacatagtgccgaagggcttatatagtgctgaagggcttacatgacagtatgtacatttttacaatttggcgatttgggtgccacccattctagacatagaagcgcttgagagaggcagcgttctaggaatggtcgaactccacgccttcgagtgtcgctaggcaaaaagatcccatcctggacttgtgtttgataaggtatggcccttcccactttgattcaagtttgccaaccgctactgggttcgccttgttctttaggacgaaatgaccaggcatcagctccgtgggtcgaacttttttgttgtaagttgccgaagtgcttgtggcatacttgtgcatgtgctcaagcgcctcgactcttactcctttcaagagttcgagcgatacttcgcgtccttcttcgcccccagagaacatcacccttggtgagttagcccctagctctgctggggtcattgcctcatcgcaataaagaagcataaacggactaaacttggttggtcttgtgggggtcgtccgaagggcccagagaaccgatagcaattcctctggccatttgcctttcgctgccccctcgagtcttttctttagtgcttttaggatcttgccatttgtacgttcggccgccccatttgactgcgggtgttgtcacatcctgattttcgtttcaggatttataaattatttaataaattattattagaatttatattaaatcttcattaatttacaagtgaagttaaatgtgggaaataaaatttcctaaatataaagcatgggtggatttaatttttattaaattctccatgattaagtcaactctctgaaattttctcggatttttcagagctcaattcctaaatgatacaaagaacagttcagtaattatttgatcaataatgatctaattataattgttaagagcttttcttgtttaaaaatccttaaattataaactgttgtttaaaaggaataattagaaatgatcttaaaagcctaaaagataagatctaattttaatttgctaaatctcaatataaaattgggctagataaaattttgttaaatactttgcttaattctataattcctagatttttctgggatttatttgagctaaggaagtatttttaataaatggaattgtatttcatgaataatttaaattgaaaaaggtttttaaaagtctcttttggctttgggccgaaagccggcccaaaacctctctctttctctctccctccccggtccagtcggcccagtccgccgcgccccttcctcctctctctcagccgctgacaggcgggacccacctgtcggggtcgtcgtcctcctcgcgccgccgcagccgtgccctagccgcgcgcaagccgccgccgcccttccaaattccatcgctcctttccatctccggccgaatcgatagaggggaaaagatccccgcgatccactctatcttttctcttatggaatcgtcggctaatttcgtttggaaatccgtggattcgagttcgattcggatcgatctctctcctccgaaccctagctttccatctcgccgccggtcgccgtgggctttcgcctccacctccttgcccctataaaaggacccccgagcttccctctacccgccgccaccctcgccttcgtctctcgccgtcggtagcaccctagccccgtgtaaccttgtgccgttgtcgtcgccgccgctccagccgtgcttcgccatcgctccagtcgccgccgtcgctcggggaggtcaccgtcgtggtcgccgtcgcgtcgccgtcctcgtccgcccctccgccgtcgctgtcgatcgccggagcaccgccgtcaccgtcgacccgaagaccgccgccgcttcttcctcgtcgtcggcgccgtccgttgcttttccgccgttgttttggtcaccggtgagttcgccgtgtcgccctctacccgttggtgtcctccgtttgcgtcgtcgagccgtcgttcgccggcgagcatgcgttgccgagccgccgccggtgttgatgtcatcgctgacgtcatcgggaccgtctgccgtggcccggtcgtggactgatcgatctcggccgtccgttttggataggatcgatctcggccgttcgttcccgtgagccgccgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcattgtaactcagtttaatgtggttcaagttgcaaaagttatataaaataaagatctacatattaaaattatccataaattgaattaaatttatttaattccttttaaatgggctttaattagatttaatcttgtaaaattcataataaattcatatgaagtcagaatgaggccgttcaagtctcataattcatctaaaatcatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgaacatgttgttcctatatttaaattctctatttatttcaactgtgcatttattttcgaatgccattgggtggtgtgaatctattcctttgttatggcctgtttgcattgattactttattccttgataccttgggttattataacttgactagttgagctttatatattggttcagcttgatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttatcttttgtatagcatgattcattgcggagcaccagactgagaagtggcggagataagcccacgggggtcactggggagtccatgccttgttttataagggggtgattatgatccaggaatggtgcactgtggtgagttatgttgtgcagagggtattgtcacagcctctattcgggtactttccaatatcgcgacgcatggtagacatgatgttgaggctgtgtcttgtgggtacagtggtacacctctggccagagtaaaactattcgaatagctgtgcccgcggttatgggcgggttgagcaatgtttttcatgattagtctcacacctctcacaataattattgatgctataactggtaataatttgtttagctcctggtttggagttagatctgtacagccaggtatggttgttttggatggttgggcctgtgcagcatgggtgtgctgttcagtgttgattaaaatttctaatcaataactctaccgttttattactcttaactctttgctaaatgctgcttttgcaaatgagcctatattatgccatcctttggcatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagtgcgaccgacgcgaacctaatttccaggttaagcccttcgcacatttttctgaacttatcagagtcaaactgcttgccatagtcagtaatgaactcttttggcactctgaaacgacaaacaatgtttttccatacaaacttctgtactgctgccgaagtgattgccccaaggggttcggcttcaatccatcgagagaaatattccacagctacaattgcgaatttatacccgtttcgcgccaccgggaacggccccatgatgtccagcccccatctggcgaagggccatattggcgcaatgggctgccgatcatactggggcgcagattggcttcggccatgacgctggcaactttcgcacttcattatttgctcaacacagactttcaacacagtgggccaataaactccttgcctaaatactttggaggccactgttcttgcagcctagtgcgcgccacatagcccctagtgtatgtcctttgccatttctttgccttcggcaaaagagatgcaatgaaataagggttgaagcaccccggagcggtaaagctgacccgagaccatcttatatttcgtggctctgagttgcaaacgcttcgcttctgcttcgtctaccggaagccagccagtttcaaggtgtttcacaaatggggttcgccagtcatatgggtcttcgcccagtttctcctggtcgattgccatgacttcggagcagtccatgggcacactcggagcatgcagaacttcgaaaaagatgcccggcgaatgtgggccaccacaagcagcggatttcgccaaggcgtctgcttccccgttctagtctctaggtaagtgttcgaccgttatgccggtgaagcatttttccatggaccgaacagcctccagatacctcttcattccctcttcttttgcctcaaaggatttgtcaacatggcctgctaccaacttggagtcagttcgaattagcaggcgctggactcccagtgctttcgcctttcttaggcccaggagaacagcttcgtattctgctgcattgttggttgtgtcgaactgcagtcttgctgcgtaccgaatcggcacaccattcggcgagaagaggactgccgcaacgcctgcccccctgtgcgaccacgaaccgtcagagcacatcacccagaattgttcggcgggctcggggtcgggggcaagtactagtgtccattcagctacgagtcagctagcacttgagacttgatagcagagcgtgcaacaaaatgcaagtcgaacggggatagctctgccgcccacttgctgagccggccagtgacttccttgcctcggagtatttcgcccaaggggtactgtgatggcactatgactttgtgggcctggaagtagtgcttaagcttgcgcgaagccatcactagagcgtaagcgagcttttccatttcaatgtaccttgtcttcgctccttgcagtgcttcggagacgaagtagaccggtttctgtccggactctgtttcttggacgagtgcagcaatgactgccaccggcgaagctgctaagtataatagcagttcgcttcctgggggtgggcttatcagagctggcgggctttgcaagtattgctttagctcgtagaatgctgcttggcactctggtgtccaattaaactttcccgcgccccggagggtcttgaagaagggcaaacctctttcggccgcctttgagaggaatcgactgagtgccgcaattcggcctgcgagcttttgtacttcatgtacacttgacggaggcttcatttgctggatggcatcgattttctctggatttgcctcgatgcctcttacggaaacaaggaaacccaacaacttgcctgcgccggatgccgaaaacgcacttctccggattcagctttatgcctgccgcgtgcaagctgtcgaacgtctcctgcaggttgatcgcatggtcgaaagccttgcggctttttacgacgatgtcatcgacgtaagcttccacattccgccccaactgcttgctaaggaccttgtacaccagtctggcgaaagttgctcctgcattccttaagccgaaaggcatcctgaggtgacaaaatgtgccgaatggagtgatgaaggatgttttggggatgtcgagcgggttcatgtggatctggtggtaaccggaatatgcatccaggaaactcatgagctcgcatccagctgttgaatccacgagctggtcgattcgcggcaaggggaaatcgtctttcggacacgctttgttcaggtctgtgaaatcgacacacatgcgccatttgccatttgacttctgcaccagcactggattcgccaaccactctggatggtcaatctcttggataacccctgcccggagtaatttttgtacttcggccttcgccgcttcttggcgatcggcagacatcttgcgcaacttttgttttcttggcttaatgtccggcttgactgctaggtgatgcatgatgagatccgccgggacgccccccacctcgtcagggctccaggcgaagatatcgatgttctttttgagcacctctaggatattctcaacttcttcttccatgtcgcccccagtgatacgagctttgtggggtcggcatcatcaatctgcatttttgttatcttgccgtgaggggtaggctttggcgtgtgcttcggccgttcatgcagttcggtctcaacactgtgcactgctctgttaattatggctagatcgccttttgaagcagccgaaaactgaacctccttgactataatcacccctgtcgggccgggcatcttgagcttgagataattatggtgggaaatggcttcgaacttgttcagggttgcgcggccgaagatggcgttgtagttgtacgggatgtcaatgacgtcgaacagtatttgctcttcacgtctgttctcccccgagccaaaggctatcagcaagagtgcttggccgagaacttgaactggttccccgccgaaaccgcggagcgatgctggtgctggggtaagggcttgggtaggcaaccccatcttggcatatgcttcggcgaagataacatcggccgaactccctccgtctaccaggattcgtcggacttcgaaaccagctatttcagctcagattaccaggggatcttgatgtgggaacataactccttctgcgtcttctggcccaaaagaaattagctggttcagatattgcggcgctccttcaccctccgaagtgatgctgtggaccatacgggtctgcatcttcttctgccgtttcgacaactggcttggcgggtcagctcttgtaatcacttggattacccttcgctgtgcataatggcgttgatcggctaggggtgtttgttcctgaattgcttcgcggggtgcttcgacagttgttccttgctgcggccttgcgtcttgcgcgttgccacgttgcctaatgtttcggcattgctccgtgctgtgcgaagagcgtccgtgaaaggcgcagtagaggtcctttcggaccttcttgcgggctggctgctgatagttgctcgcttgctgggtgtcgacctccttgcggagggcttgcacttcttcgacagccatcaccgccttgcctgcacggtctattctgaactttctccaagttatgggggtttggctttgccttggtggctgtccttggatcgccggctgagactggcggacagagaggggaggtggttcggcaacttgcacttgtgcttgagcttgagcagcggcgacggaggctttgtcgtactcagcttgtatagcatgccgtcgctgtcacgactgagaaaaatacattttcccgaacgctagtgtattaatccccgtcccaggaaaagccggggtacaccacacaaacatgatataaaagacacatctttattatatcgataatatttacattattacaaaggcacttaaggcctgacaatcaaaaaataaacagcagcggactagcgggcctacggctccatcttcacaggcgctcaactggggtataagccaggactccacctaggacttcatctccaaagcttctcttactgaaggggggggggggaaagattgagcaaaaatgagtacaaccacagtactcagcaagccacaccggcagatgcatgactaatgcaagggggtacaaggggtaataatataagggttaggttttgcacttaaaagtcacttagttgcccaaagccaattttaaaaagacgatcctagagctacacagtattattaatcaaggccgtgcacccacacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagatatgtccatcgacccccgacttcgtccatctccatccgtgtacttttgtttataaccagactgagccacaaactaagccttacccactagacatgtggaagtacggtagtgctttgcaacagaggcccgagcttcatccttatagtggccggggtgctactttccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaaaccacctaatgttgcctaattaatcagcgaagcatctacctaaattcatactagtgggaccatgaatagagtacccactagttggggttttgtttatcctagggtgaacaaggtaatagtaacaataacaacaatgataaggtcataacaaaggtaaataggcatggctagataaaacagtgataacgcgggaatttaaataaagcgataatgcattaatttaaatcaaaataattttataaactgggattcaatatgctcaaggatgatgtgacttgccttgctccgagagaacggccttccgaaccttcggcgacgaccgcgaaccacgcttctggaacctccggaacgacagaagctacgcgaagcacacaagcaaagctacaagcctataaagaagcaataacaacacataaaaagaaagcacacagttctttaggttataacaaacattaagagacttgaacgggtcgattcggagctcgtatgaccaagatatgatcatccgaagtttaatgctgttatatggagatttgcggattattataattaagctttgcaactataaaacatgtgtaaacgctagcctggaaaagacaggaaggctgcgccgttgacatgcggaccccacatgtcaacctaaaggaccgcggtagaccgagtacacagagacggtccacgggtcgacggaagcagatcccgtgtgtcaaccgaggcgagtggccgacaaacggactctactagacaccacacgggctgcacacgtggaaaccacgcggctaccgagcgggcacactaacacggacactacacggtcaccacccgcacacgtgaacgactaccgacaccggtacacggataccggggtcgacaaccgcacaacgggtacggggcgacaccgaaaggacgaggacggggcagcgagaggagagatccttaccaccacgcgacgaggcgtgggaacgacaacgacgaacgggcgcggcggagacggccgggaactacgaagacgaacggcgaggggacgacttcggcggcgatccttggacgaaggcgagacgcggccggcacgaggcttgacgacgcggagccgaggacgaagacgacgacggctacagcgaccttgacgaaacaccgaggacggacgagaacggctcgacggagggacgaacgccacgacgaccgggagcgacgagaggacgacgacgacgacgaccggggccggcgaggaggcgacgagggcagccggcagcggctgcacggaggcgaggatggcgtggaacacgccgctgcgatgccgacgacggaggcggcgccgcgagacgacgagccggcaaggatgaacggtgaagacgacgacggacaccggcggtgttcggccgaaggggaagcgatgccgaggacgacgtcgcggctgcgatgccgaaggtggtggaggtgcggccgaccggtgcacgggcgaggagggacgggcggccgaacaactccggtgaggcggatggagaggttcgcggcgacggacaagaacggcttccgggcgaaaccgaggggtggacgaggtggagggctacgtcccgtgccgagggaggggacggcagcgccggctgacgcacgggcatggcgaaagggtctgccagaggagatgccgacgaggaggaaggagaggccagcgcgagcgacggcgttccggcgaaattcgggcgacgtcgtggcctggccgggaaagaggacggcgctccggtgccgggagaggtgatggcgacgtcggccggcgcacaggggacgcggcagaggcggccggaggcggaacagtggcggcaacgccactgtcgccggcggggaggcacttccggaggtctccgcggaaaacagagggcaggccggcgaagaggaggcggctgcgatgctggaggaggcgacggcacggccggccggcgtgctaacgcggcggcaggggcggctgaagatggccggcggcacgggagagaggggacgacggcggggaggtggctagggaccacgggagatcgcgggagggggctaaaacgatagaacggagcgaggggtttccgttttataggatgggggagggagccgggcacgggagagggcggaacggcgacgggaaacatggccggcggccatggaaggtggccggagttggcgcgtccgttcccagcgattgggggagccattcaaggggaaattaagggggaaagagagaggagggagaggggattaattccccctaatcaattttggaattcccggtttgaatcgcgtggatttaggggaggaatcgacgctaggtttcacgggagagaagagagagagaggatgccgggcgggaggaaggagacgaccgagcaggtgggacccaccggtcaggcacgcgtcatcagcgcgcgcacgtgcgcggcacgggcgggagggtgccgctcgtcttgggccgggcggccggcccaggaggagaggagggggaggcggcctgggggagagagggaggaggagggagtgggccgaggggaaggagaggaggcccaagagaaggagggagaggaggagagggagaggaatagagggaggaagagaggactttggccgcgggccgagagagagaaagagagaggggtctttgggccaaacttggcccaaagggaggagggggatttatttttagtttttctttttagtaaactttgataattgttgttgttgtttaataaatatttttggtgctctgaaaattcaagtaaaatttgagggctccttttagaccaaagagaatttaacaaaaattctccaggccacatttgaatttttcttgtacgtattttagtgtttgccaatttttttccgaattttaattaattctattattccttttagcgaatgatttttaatttcgggatgaatttatcaggacgtgacagtcgcttggaatcctcctcgccccttgcgaacccgtcaatgatccgaagtaggtgctcaagcgtctgtggttccttgttggcgatttttctcgtgagttcgccctcgagcaaaccggccgatgcggcatttataaccgacgcctcggttatgtcttgaacttggcaccgggcttgcgagaagcgacgcatgtactcccttatcgactcccccggcctttggcgaatgccgagtaagtgttgctgcgtcttcggctcctcgtaggtgcctcgaaagttaaggacaaaaacatcgcgcaattgctcccatgagtaaatgctattggctggtaaattgaaataccaagaacgggcgatgccgtctagagcgagatgtattaccttcgccttggtattttcgtcaccatgagccgcttcgatcgctgactcgtagatggagaggaactccttcgagtcagtttcgcccgaatagcgcgggacgggtgggaacttgaactagggtgggattggacgagtcttgattcccccactcagcggtagccccttttcgcctcccaccctgtttaccgcaccttgctgcgggtacggtgtggcgaaatcgcagcttgtgcgtgaggttgggccatggcgttcggctgcccggctccaactagtggtacttgctgagccgccatggacgggtcaaaaattggctgtgaccacatcatggcagcttgaattggtgcttggtttgttccgaagcctggagtcggagcttgctgccgaacggttggcgcctgagcagcgttgacgaagtcgaactgcggtccttgattccacggcgaaactcccaggcccagctgaatcggtggcaaccaattaagcgtaccttgacttgtattcccctccgggcgggccgatggggttgtacttgaaatgcagtggggttggttgagttgctgaaggaaagctaggagttgcgcctacagagccgaagccccttccgccactgattgtggcgcttggccaggtggttgatgctgcccggcgaagtacaccggcgcctgtgcggcttgtggcggagagggctgggtcgtcacttgcggacggacttgaggtgggacatagcctgccgaatactgaaggattggagccgacgtggccttggtccgccttgccgcctcgtatgcttgttgttgttcttgcatttggcgaagcatgtcttggagccgtctcatgttctgccgcatggcttccatgtcgccttcggcttgtgcttcggggtcaaggctgacttgggcctgtacaacggcgagcgcagttggggccgctgccggctgcgatggggtggcttggggcaccaccggttggcttgtcgaaaggatctccgccttggtctggagtgcccttgccgccgcagccgccttcgccacgtcggccgcgttcggcacttgcacagaggttgcaggggccgaaggcggttgtgatggcgcttgtgctcctccatcttcggccacgggcgccgcaggctctgctccttcctcggcagccatgtccggtccagcgtcgttctccttccgcctggcaaccttctccttcatgaccctcttcggtggcattcgctctcagtggtttcgctcggagttccccacggtcggcgccagctgttgtcgaaaggacaactgcatacgtcgaaagacgtgattactcaacagtggttggaaaaatgaaatgtattaaattttgaatttcacttgggatccccccattacatggccctaggggactatttatagctccattacaggttcttactactagggtttaggttgtacagggaaatttacatgattacccttacaaaagggacatttataggggtacataatgttataggggctcatgggcccctgatgggccgtctggcgatcgccggccctatagcccttaggcttgatgggccggaaaggcttcctcggccctcgcgggggcgaacttgccatggcgaagtcgtcttccttcggcaggtagtcttcggcttacacccttcgcctaagacgcctctgacctggcaaggcactcgtacgactcttcgcctcgtgccgttcttgcttcatagccttcgccacgggtttcggcagatttagtcgaagggcctcatgccatccgccaacacataagtatgtagaatagaactacaaaataagtaagaatcgataagaattgctaatacatatatacaagtaacatccaatctaatcaataaggtcagggattgtcacgcccggaacttctatccaaaattccaaacgcttacatgtgtgttaaatcctcgtccaggaatcagccgaggcacacaataacaaattgataatagagtactcttaaacaactaattaatattcgcaaaatagcaaattattacagaggtggatagttcctctcaaaaaataaaattctacgcagcagaaaataaaacaaactacggaacagctatggcgactccactccacaggcaacttaacccggaccaagcctagtcctccagatcatcaccttcactcaagtacacctcctctaatgaatgaatattgcaagaatgagcatatgacatactcaacaagccacacagcaaatatgcaagtgcataggataacaaaggatggcataatatagctcatttgcataaacagcatttaataaatatttaagagaatagtaaaacagttgaataattaatcagtattaagtaaacaccatacaacacacccgtgttgcatatgcccaacctcatctgaacaaccaaccccggttgtacaaatcaaacctccataccaggaatataccattccaaaccaggagtcaaattaattatcacaattaccatcaatgaataatgtgagactaattacgaaaaacattgttagacccgcccataaccgcgggcacggctattcgaatagttttactctggccagagatgtaccactgtacccacaagacacagttccacaacatgttaccatgcgcctcaataccaccacggtacctgggaaaggaactgtgacaatactcctcgcacaacacaactcaccacagtgcaccatacctggatcataatctccccctcaaaaccagaggcatggactccccagcgacccccacggacttctcgccgcttttcagtctggcaccccataatgaatcatgctatacaaaaggtaaagccgttgcccacgctggcttgcggttggcacggtaaatgtttcacaacagtagctcgcgaaccggtccttaattgtcatgagcacgaccatcaaaaccatgtgctcacaacccaccattaatcaagttttaattatcaattaattatcataacacgattaaccatcgtgagctaccattaaatataaccataaataataacgcagtatatatgattcatcccattaatgagcttat

SEQ ID NO: 68400 - DNA, 7911 bp, Oryza sativa
agcatgacgtcatcaatggcggccggctcggatggcgacctcgccgacggcggcgctccggctgcttgcaacggcagcgaaggggcggacggtgcgcggcttctcctcgcgaacccggagatagcgacggcgaccggcgacgaccaccacagcgacggcgcggggcggctggaacgacgatggcaacggcggcggctagggcgtcgcggcggctgcgctacaagcgacggcggggctcgggacttggggcaaacgaaagaggacgactaggggatgctttatataggcatgggtgagagagatcgactccaaacgagaggaatcgaaaccggaaaatcttcgggttagtttggagagataaaccgattcttgggggaaacgaaagaggtagataagggaaatatttcccctcaacaaattttaggaaaacacaagagaaaaggttggatttggaggagaaaaaccgagccaattcggtctcagttcggctgctagaggtagaagatgaacagtgctgagggaggcaaattagattttcggctgggctgagaaggggaagagcagctcggcttgggccggcttgggctgcacagcacgcacacgagggggagagatgttgccaacagcttaggagaggattttaaaaacttttaaaaatactttccttgctcaaataattcccagaaaaatctagaaaataaataaacaagcaaagtattatcgagattttatctaactcagttttatgttacaatttctcctagattattagagtttaacttgaaggctttttaaaataatttctagaaatgatttaaaatatggattattaatttagtcgatttttagggcgtgacagggatacactttactgtagcaatcgatcttgtccgtttgctatgatcagacggctgaaaacacctcaaaagtcataacgttcaatactcacgggatgtcgataatttcagataagcttggcggggcttcacttgtgacatagcggcctagtgttaacccaaactctgccacattgccgaggccatgatgaaccaagagcagccagatgaaggtgaggagctccgatccgttgtccaaccgacgcgcgtggagctcaccgcggctcttgctggcagcatagatgaggaggagtatccacgtctccttcaccaacttcaataatgtgccactgaccctagtaatataaatgagttccctagcaacaacaatgaggtcagagtttgtgttgcttgtcatttgctcaagagctttgagcagtaagtccatccttgcgtgaggatccagcttgccaccagcatatttgtacatgtccactaatttagccatatagttcaaatgttccatcacagcgtaatcactgctaacaggcaacatggaggggtgtgctaacaggaggtacatcatatagtttgatagcatcacacattcccatacaatgcctgtcttttcttcccagatgcctggttcaagtaatagtactgaagttgtataaatatctgtgaacaaatgcagttgaatgatgccgacctcaaaacgctgagatatgctcaacaagttcaacctgacatccacattcccttctttagagacccccataattacctcatcctgatcattattggatggtctattattgaaacaatccacaaaacaaccaacaatctcagtggcctcaacgtgtttcacatgacgtacatctctatagatcttctccaagccaaatgcatacaacgcattggacattatcctgggtgtggacccatcatgtaaagcacatgttgctaggctaaattgccccaaagaaattggcacaactgacctctcctcctttgctccaatgatcttcccaatagcaagcaaattaacataattgtgccttctccaacgtgcccatgttagtggagatgccactaccacaccaatggcacatgcttccataagaagggcaccagcaaatagtgtgtaggtgattgcaacatcagccattctatggccatgctttggggttactaggaatagcacaaatgcaacaaccatagcgatgtgggaaatacaccgtagtatgcaaccgatccatgtctggagtatcattgccttggtgtagaggatgtcatacatcatgctaagctccagctctattatctttgctttcacatatttttcacaccttcttataccatgtgttagttcctttcttactttttggccaagttgtgagaccgtgacccccgcaaataatcctcgagcatatagcaccatttgatgagcatagaataccttgctaagatagcttccatatttattatccttttgctcttcctgttctttgtctttgtaaccaccagctgagctttgaaggccatctatgctcccgcacttgagtgcccatgtcctctccccatacttgattataccagcaacaaatatgaaaattgcaggaactactagctgcaaactgatctgaccaaatgaattgcagaaggcatacaaggctagactgacctgaacaacgagattcaataggtgtcttagccatagattgttgtcttcgatagagaaggcagtgatggtatcttgcccaccaagatgaacaaggagaaatggaacccagatgactgtcaaggagtcacttccaattttggatttgtattcatatcgagagaggagaccaagggcataaacagcaactaggtctgctcccacataggccagccaaatgaatatcagtatcaatttgttggttctacggcgtcggaggcctccagtgaagaagagaaagagctgaaggaatagactcaaaagaatcatcaattggatttcccatccactccatagttgcaccagattggctcatgttcgcttcatactgtaatcaatgatcgatgatggtatctgtcccttgggctactgtttgttgcatatgttcaaatgttagtgacaaaatcatgtactgaaaatattaaaaagccatatattacaagtaatgcaatcacataggtcatttataacttttttaattagtatgaactaaataattttctcaacaataaactatgtatttcacgtaccaaaatcattgaagaaagtattaaaatgattaaaacaaatgtagcatacatcaaatccatggaaagtgtggaaaagcgcatatgtggtttgttttgtgttttcatatctatattttctataaagttaaagctcactaagtctaaagctcaatatgcaaatatgccacctcgtcatccacgagcaataactacttatcaaaaaagctcatgcaaacatgcaatatcatccataatttatttaattctacaaatcaaaatgcaaatagatccaatcatcacctctctcatcatttccgcaatatttcaacaaatatatccatcatttttataatagttaacatacattcatccatatatcccgtatcaaagcagagatattatttagtttgttacatgtttactactaataaatccttgctttttatttcttttttccctatcttttgtttcttgtgatataaatcttggccaacaacctaaatttcatgtataatcttttacaaagcctattaaatttatttctctccaaacatggccagacaaatcagttttatttgttactaataattaacatcaagcttactccttgctcgattattgaaaaaaacatatatatttaaaattacttagtaattcccacagcaaagtgcgaggaatcacctagttgtttattaaaaaataatggcgtaaaatcaaaatatttgagtcaatgcttctctttgcaaatgtagcgtcatatgttggaaacctaatctatctcttcaataaaatcaatattaataatacaaaatcccaacgtacttgtgcaaatcgtgatgggccatattggcaatgtatatcttttattgtgatattatcaactaaatatccttcataggaaaatgctttaaccactcttactttatatgcagtaatcactgctacgaaaactattttcgcatgtggccaaagtagatcttctttgcatgcggccagctgctccgtctacgatcaaaggctattttcaaaggcgggtgaccaactaagttatgttgtcgcctacgaagaatgtttaagcgctaaacaaatcaacagccgcttgacgcctgttgatggtcgttatagaccaatttcaaccgtcaatatactcaaaataaaggagaactagatatgcttacaatgtatatttgttttagaataatttacttgtacttggattctatttgatttcagagattgctatataaagagaaggagaatcgacggaaaacaaacgaacaaccaatcgaaagccgtcgagaggtagatttgtggatagatgggcctacaaatccagagaaataatctcaaaaggcccaaaacaccacgtcactggactgaggaatcaacggggaggaggcctgccaaaaattgggcagattggccaggtcacggttcggccaaacccccatcacagccgttaaggctagtgtttggcatggacattcaggattcacttccaacaacggctgtagggcatttccgacctttccatctgcaataaccatcatactcagtctataaaaggagctcacctcactcacttctccacagactcaacaagaagatcaaagctctctctcaagtttagttagtattctagtgctagtggagtaggaaatagaatagttttcttagtcctcgagtcttcaggagaattcgggtatggctctagtatcttctctctcttttgtaagacttacacaattaatggaatatgcttctttattcagttttggtattttacttcactcttattatttgggtaccgacttcactttacatttatctcgatataattgtgtagctagcttaccagagatatgcaatggtgtgggtataatgaccatgcaaatgattgctctatgtcatggtagcggatatagagtagtatttgataatttaagcatggtgcttagattattaaatatcattattttgggttatatgctgcgggacaacaaaggttggccgctgatggtgacagctcagtacgagtattcctccatgttagtatataatcctaagttaatttcatggtatgggtactcctccatatttattttcggttggacggccatgacgggttgtcgtaagggactcgacaatcaggggtggtcacttgaaataccaggagggcttagttagggggtattggctacatgattgtatactagatagtgtaaattaaagatacctgtatactggaagtattaggatgaattcttttcttattctttctccacttagcctaggatttatttaatgagagtaacttacttcttcttcttcgtgtcactctacccttgaattaattaacacaagcttagactgtgacttatataggtaacatataaattattaattattagtatagtcttctcttatcaatcttccattgagattaaataaatacgataccttggaatacttcggggtgaaatgctacaatggtatatccgtgcgcttgcggatctttctgcgcactaaccgtaatataccaggaatatttatgcgccattgctgggatttatatttctataatgtcgttaagaaacactaacaaacatttttggcgcccttgctgggaagattaataaagagattactatatgctactaactttatatttacctctgtatagtcactgtcctttgcaggctaaccttgtttttttttcacttttgctgtgtatggctggttttgatttgacgaaaaacttccaagacaattcagatgctttcttcaggagtgtgaagccgcgagttgtccctctgcagaaagctctttcgacaaagaaagcaaccatcccagtgtcaccgagcttcaagaatatggctgagaagaccctccgctatttcactgcaccctctactgacaacgtgccggttgggccgcaaatcaacttgggggatggcgatttcgatctaaacaccagcctcattacgatggcacaggcaagcccattctgtggcaagcctaacgagaatgccaagtgcttatcttcaacagttcctggagatctgcagcacgtacgcaatgaaaggcgtcagcccagacgccgtcaggatcagactgtttccgttttcccttctagggaaggcgaagcagtggttctacgctaaccgtgcatcgttggatacctggaacaaatgctctatggcatttcccttctagggaaggcgaagcagtggttctacgacaaccatgcaacggtggatacctggaacaaatgctctacggcatttctctccaaattcttcccgaagggcaaaactaatgcccttcacataagaatcttaagcttctagcaaagaagggacgagtcgattcctgaagcatgggaaatgctacaggagtacgtggccgcctatcctcatcatgggatggacgactggctgatcctgcagaatttttataacggactcactcccttgtcccgggatcacctggacgctgcagctggaggggcgttcttctccaaaacggtcagaggtgtcgtcgatctgatagagaagatggtttcaaacatgggctagagcgaagaacgactccagacccgccagtgtggcatgcatactgtcaaggagatagaaatgctggctgctaagcttgacctcctcatgaatcgccttgaagaccaagagaagaacatgccccaaggcaccgttaaggccttggatgcacacatcacgtgcgaggtctacggcaactcgggtcattccgagacagactgtcttgagacccgtgaagaggcggtgttcatgaacaatggatatcatccacaaggaggtcaggggtggaaccaggcccgccgttttaccaaggaggcaacaacaacaacagtggtaacttcaataaccagcctttctcgaaggatctcatctttgcacaagctaaaactaatgatgctttaagcaagaagctagctgccaatgataagatcttagaaaatataaatgctaagctagaaggattccaaattagatatcagtactatcttcaaataaaaatcccatatacttttttttaaaaaaaatctaataataatacgattaaaatggtttttccagtacacacatataggtcgtggaggtgccagagactctggatccagcggccgtcaacccgcaatgtgctaagtctccaatcccgctccctaccaaaactctagcatggccaagtttgaaatcagtcattactgtgcccgtccggagcaattactttgccatcctcagggagaatacgggtgccatccacccaccctcctatgaggctacgaacgcgcagcctagcacaaggcgtcacctccgcacgtagaccaatcgcggtggtcttaatgctacaaacgacagatggactcaggtaaaggcccatggtcagtggaggacggcacggccttcacatccccattcaagctcaacgcccaccccacgtcctcgcttcgtgccttttcaagagaagacctagggtaggtgcttcatctgcctagataaaaaccatcgtgcgtccacctgcagagacccggtccgatgcttctcctgcaggcactcagtccactgggttcgcgattgcgattgccgcactactgcgtgccctcgccgttgctccttgccacacaaatcctccatgccccgccgcccaccctccaccccgtccctcatcagctttggccgccacactggaaaagctcttagctggcctagccagcccacccagagcgcctgccacctccgtcgccgtgtgccctgaccgggaatatggcgcttctaggaaatgccactacaaggcccatgcatgatgaatg

SEQ ID NO: 68401 - DNA, 6627 bp, Oryza sativa
tatcgagatacacttcatcaagtggaggagcctcaaggatgcgctcgacacagccctcatgttttgtgtgtgcctagtgctcgatagagttccccgccatgcttggatcctagacatcatcaaacaagtcattgcccgccgatgcgccttggaatcagttgatatgaacctcgtgcagccggtcgacacgcgcttcatcaagctctggacatggatggcgaacccgagcatgatccctaaacacgtttggctcatcttcaccaaaaaagtgtgggatggctcgacgaagtccgtcttggtgatagagacatcgctagaacaatggcaacacggcgacaagtatccggtgctcctccactacgacgaaatccatgacaacaccacggtgaccgtcgacctcctcaacccggtcaagtgcgagccaatgaagagaagcctcctggcctggcaccttggggtgatcgatggcgagcagtcgctggcctgcgtgtttgaggagttcccccatcacccatagccgccgcgtctccccaaggagcacaatgggctgcgaagtggaaacaaggataagggccgcaaggagagcagtagctgccgaagctgctacaacgatgaccaccccgacaagctatgggaccatccctgacgccggtcataccgcgacgacgacaaagacgatagaggcaaggacgtggggcgtggcagtgaatcaaatagatgcgaggggctcaacggtgcgctccagcacacgtactcgctgcggtgttgaatgctggagaaagcagccgccacggcatacgtcatgatgacagcggtgacggtggccaatgagctgctggtcctccctcccgtgcacaagagcctgccaaccgatgaagatctacatgcacgcgaatttaacaagttttttccaccttaagctctcagccttgcaacattctacagctatcacggtgtgaaccctcagcccctccatggtcgttgaccgccttgctacgatcatgggaaagctctcactacacatgctaggcagtgaagcctggtccggagcaaccatcccggttcgcaaggtctttaagcgcatcaagaccgatctagaagggcctccatcgttgtgggaggttgatgatgccctttaggaaaggcaggagcggggcctccttgtggacgacccggagggaccggagctgatagctttcacattgcctggagcaggagaagcgccaccgaccgctggggacgacacccagcagttgctgctacagcagctcacctcgccatcgccggcgtgaactccaatgcaaccgatggacgccgggaccagaacagatggcaccagagcaaccggccctgaggaatgctgaggatgatgacgacaatggagagaccctatgcgccttgttcaagccagtggccctagcaatcctgcctatgccacgggtgccctatccaaaacatgccattggggacgatgccatagaaggcaacggggtgcgtaggagcaggcgactagccaagaagccactggctaaatgaaagtgccggtggcgatcaaggcgcaacttaatttgtgccagcagcttggcttcattccaactgaaagggaaactcactgatcaagcccttgcggagtacaaggcaatgttcaacactcctttgccgcctgaggtcatccaaggccgatgcctccactgcatatgtaggcccatcggacgccgacgggctcctggaggtgttcgccaaggctaatgtgtagtcctgcccacgtgaactgtgcactggcaccacagcggcctgcttgcttacgatcacttgcttttgttgacatcaagacgatgccacgctgcttgctatcgtgtttgagacgctgcgacgaagacttctatcgtcgcaattcagcaaattggcattcctcctaccccctcccccccccccttcggtgcagaactccatggacaacgtaatggtcctgccccggtgccgcaatttcacacccatgttcgtcgtcataccctctgcctctgttcttctttggcgccgcaaatccgcgcccaaccccctcaccgcgactgccatcactgcctcccgactttaacgttgcactacatcttcgctcgcttagactccaattcattggagcggtcagaacaatttacaaccagactatttggaattgcttggctccgtccaaatgcaagttcttctcttggctgaaaatcgaaattagagtatgacggctgacagattatacagaagagagggtggaagctaatcaacatttttgcaccctctgtcgcaccgtgcctgtatcagccctacactgtccaaaatgatctgggcggaaatacaaagatggacaagggtggacctttgactacaagagtgggaaagactgcgcaacggtagaagattggtggtacaaaatctcgcgcacagtgaacagttcaagaaaggcacttaaatcgttgatcatcctaatagcgtgggagctttggtgcgaaagaaatggtagaattttcaggcaagtggcttctatgccggccaccatcatcgtcgagaacaaagaggcgtgaacctggatcgttgcgggtgcgataaaactcacagagattaccccagcagagtaggtcccatcggtttcttttgcgggcccgcttggtttcttgtgcctggactcggtaaatattatgtagttttgttgtacacttgtactccttataagccgcatccttctctatcagtacataagcgacaaagcttctgcccttcttttttaaaaaaaaaaataaaaaagacattggtgtcgctcccctcgcgctcaattgcggtggccgtcgataaccaccatgaacaggaagggctgagggagaggggtggtgagggcagagctggggaccgtccccgtcgcctgggaggtggtatccgagtcggagaagtcggccatggacggcagatccacattgatgcaggatcctcgccaccgccgggggactctttatcggataggaggcggtctatcgtgagcgacggtggacgacgcacggtgctggcgagagaagcaagcagaccatgcgcagcggtacctgtcgccatccttacatcggatgcgtttcgactgctgctatctatgctcgcgtgcaggagacacatatctatttttcttgtttttgtgtactctctacagtaaataaattattatactcgtatgtatggtgttgagaaacatccaagtaattatattactacttacaataaacctcagtaaataaatttgctatggatgaaactaattaagagcgacaagacatggaaatgttaacgggacctaatctggcattgacccttttttttttaacttttgggcgattgatgcatgcaatgcagaagcaagaaaatattttttttaatttaatcactgccagggctttatcttgtagtgtgatttaatttgggagaatagccaatatggtccctaaagtttcgcttctggatcattttagtccttaatctttcatattgttcaaacaagtcctttaattttgtcacgtgggctgatatagtccttggtcccaccaaaatcgccacatggacatgccatgtcatattcctatgcaaaatctatataatttgtccaatttacccttatatatatcatagcaaaataaaaagacaaaaggtaaaatgtaagagcaaaagtatacctcaaaacggtgaaaaaaaaggatgagtatttttttcctatggttatgtctaattcacccttatatttatttttctatgatataagtaagagtaaattggacaattcatcatagattttgcatgaatgatgacatggcatatctatatgatgattttggtggacccaatgactattctaggccttatgataaagtttaaggatttctttgaaccatttaaaaggttagggactaaactgatcctacggagaaactttagggactaaagtagctattctgccatttaatttcattaaaagaaaagtatttacaaaatgataattacaaaggaaccactaaaaacatcacaaatgttgtaaccaataaaaactatttgctttaatgggaaaatatcttttttaaatgaagcaagaaagtaatttttttactgaagcaaacaagtatttttttttcttactaggcgatggatgcatacggattcagagaaaagtaacttttttaatgctctgacaggtgcatgcatgagggatgtgaggagcaacagataactcaggaagcaggaggagaaaaaagagaaaataccaaagagcctcctgtgaggcgtgctagcggtttcctagcacgctacaagtcatgtagcgctaccggtctatcaatatcaatatgcttaccaactacatgatcccctgtatttccagtcccaatcaaaatatgcgtccgttgattacgatttatgtagcaatgttatttttagttggcatcagcatcattagcttaaaatagttagaaaaaacagaaagagacagcaactgcagatcatggcttgattgaagttcagcattttgcattcattggctatgcatgcaattgtttaatttgagacctcgtacactagctagttaattgcttaagtaagatctcagacaatgccacctagctagctaatgatatagtatacacaaatttgacagaccatattgattcatataataaaatatgtacggttacaggaaattaagcagcaagccacaaacaagactataaatcggtttatatatagtaacgcataccgtagatttctttgggcagttccaaccaaatggcagagctagttacacagatgcatacaacttcgattggttatggaaatgtgcctatagctggtggtagaaaccttgtcttgttagtgatagaagaagaagagcccctctaatttcttaatgatcttttaaaaggagttgagagaaatagtgcgccccataaggcaggatgggtggggccatatcaaaaaatgaacacgaaaagaatttgattcttgaggtggggacattaattactaaggcatatcggtgcttactgaagcgggagataaaggaaagggatgctcaagcttttggaagctccctagacgaggtaatgaatatatttagaaccagtcgatactccgcgccttgctttgctacgggacatgtgactgaatgcatattatatactatctccatattttaatgtatgacgctgttgattttttgtctaacgtttgaccattcgtcttattcaaaaatatttatgtaattatcatttattttattatgacttgattcgtcatcaaatgttctttaagtatgacataaatattttcatatttgcacacaaatattaaataaaacgaatggtcaaacgttggtcgaaaagtcaacggcgtcatacattaaaatacggagggagtacatcatagaaaggaaaaagtacgaattacccccacccccgaactatcgcggtcgatcaaattaccccccgaacaacagaaccgaacattcttcaccccgaactatataaaccggacgaattaccccccctcgactcaatccgcggtggttttggtctacatggcgtatgcgtggtagtccagtcagcattctatttataaaaaaaatatgggacccacctattatactccttccactcttcctcaatctctcactcttcctctctctcttctctctctctcactctctgtctcactcttcctctctctctctcacaggtcagcggccggcggggggagggggggacacagagcagcggcggcaggggatgaggaggcggccgctcggcgcgcttcccccctccctctcggcggtgtgcgggcggtggcggagtgcaaggaggacgcggcggcagtgggcggcaccgaggagggcgttggaggacaagggcggcgggacggcggcaggggcggacacagcttggggcggtggcatggcggcggaggtcgctcggggcgtcgaggacaacggcagatggcagtgggacaacggcaagcgagggtcggtcgcggccttgttcttccggatggaggccaccgaccgcctggcgcccagccccacagtcctccgacatccggccctgtggccatccgccgcccgcacctccgatggcgaccgtcgacgcatggatctccgtcgtcaggccctctctgccacgccgctcctctgccactcgggggaatcctttgccaccgccaagggaaacagccacctcttcactgcgacaaggtgcacggctggcgttgtcgggccccctccaccgtgccgctccgacggtgcccctaactccaccgctggccagctcctccgcagctgctgcctctcgcccacccaaatcccgcaccgacgatgggcgccgccgccggctacagggacctctcctccgtatgagaccgccgccgtctggactccgccttctcggggggaacggggctcgatcccgtggacaatggcgccccttctccatcgacctagaggccggcctgccaaaccccgcgccgagagaagagagaggaagagtgagagagaagagaaagcatgataggtggctcccacatttttttttataaatggaatgctgacttgacttccacgtg

SEQ ID NO: 68402 - DNA, 2749 bp, Oryza sativa
acttgcatattaagttttaaaaatgcaataaaaattatgaataatatgtcatatttgcatgatatttaaaatgttctatataataattgctagtatgtaatgatgtggcatacttgtatgttaagctttagaagttagtggacattaaatttacagtaacataggatacgatgtcaatcctaaagtaacaccttgaaaatttcataaataaaaatattataaaaaattaaatatgtttttaggttcgttcaattttaaaagtacaggagtcgtataagaaatttcttttttaaaaaactcgcatgctaacttgagacgactagtctcctaactgcagctcatgattttctaaaaaatatatatccaagtgaattcgcacagtgaatttcaccttaactaaaccatataacaataataaaattaaaatagccttcatccgttgcaacacacagatatttttctagtaaataaaaatttcataatccaaatttattgctcaaaaaattcttacaaaaatttgcatcatgctggctcttccaaattttgttctgttatttgccggtgccaaaaataaggtaaaattaaaccctaagggtttgataaataaaaattatctacttatgattattttttattttttagaaaaagaaaatttgttttggtaaaaggtataacccaaagtctttttaaggtccttaaccaattttcaaacagtctgtaaaagggtgccctactttttacaaaaagtctactttacctccttggtgcccaactcctttttccttcccttcccggcccaatctagccaagccgacccagcccagtgttggtatttcttacgaccatagataaatccacaagcgcacggaataccgctgcagcacttcaccttcgggtgaccccaaacggatatcgaactcagggaatgggtgtgttaacgaccaaatttggtaaaccatgaaccaggttcaacatcggaaacaaagtggattcagtgaaggatcgtatttaggaaacagagtgcgtatcggctgcaagggcatcggctgaagatggcatcagctgagatggatcggacaggagatagccgatacagccaatatagccgatttcgttgagatagtgatgacactgtttccggaatcgaccgacgtgctacatcaggattgccacgatagagataagctcgcagatagacaattgtatctactaattaggatattttgaatagtttctttagagatatgtttcggcaagagtctgccgtaaagattcgtttgtatcttagagtttgttagagataagagtcatgtccggcaaggacttatcatgtatctcgggtataaatatgatccaaaaccatgtaattaacaacaacaattcagtaacactttcggcgcattgtcacccttttctactttcattgttttcgacgagttcttgcttttgggttgagctgcatcgatttcgatcttcaaaaagaggtaaacttgtcatggcggcttgcgttctcgggattagtgcttccatctttatgatactctaatattgtttatataaatcgtcgagttatcatatatgcttcataatcttcattagtttcacgatttaacctctgatcgattgatatctgttaccgaagagcattcgatagagttagatttcgttattaatctagattatatagcatatctaccatcttttagagattttcatcatcttgcttagatcttgtatttattcttatgcttaatgctgcattggttgagttcgatctattaagtaatatttataactactaatatctagctcttttatgatcatcaatagagatagtatcggtgtttcagccgatcttacctgatttagctattttgtcctttgtatgcttgattgacatgataaatctgccctttatgttaagatcttattgcattaaagagaattaggtttattatctaatatatcttgtttgtttcaatatcttagtatagagtggtatcggagtattagccgatacatattagatctatttgatcggctatgctataaatgtatatataatcttcatcttaaagtacttttgagtataagtgatttatactgtctcgacttgctgttcgatctgtcccaatcacatggttcaaatatattttaagaagatgattatatatcgttaatatctacaaacgatcgagtagatttaacgttatattatttttattactcattgccaatctattaccaataccattggctcagagtttgaacgatacgtcatcggcactagccgatcggctatcgtctttggatttaaccatgatttctttgtgcttctttctcgttgattgcaagatcaaatcaactggcacactttgaacctaagaggaagatttaggacctgcacaggagttaagcagatctcccaggctagcgtgtgtgtttttctgtaatctacctaaggctaagacaatccaaggacaacaactatagatatgctaggcaggctagagaggactttctatgtgttttaattatctaagctaagttaaaggtaatttcctatctattgcttcgggcaccgacccctgctggtctgccagcgtggttccggctatagctctatgatgtatttgaacgtggaggattactaggacgggattcagggttgtcaccacttgccacctacctctgacaaatccgtgggatacacaaagaacaaagataatctccaacctacacaccactt

SEQ ID NO: 68403 - DNA, 925 bp, Oryza sativa
agtgagatatagcaaaatcgatatttccccaaggatccggtcctttcccttcacgagcaaaccagataggttccaaaaagggctaaccctcatcgtcgtcaagcggtcaaagtagtcgtcggagtcggacgaggtctaggtttttccccgactccgccggtcgccccaatgccgagctgtgccgcgggccgccgccgctcgccggtgtcggccgtggctgggagcgccggagcgggcggcaccaccaggtcggagaggcgcgtgccgctctggaacctcagcaatgttgtcggcgggagggcccgcgcggcgaaggccgaggtttgtgcggtatggcttgttgcgggattttggggggttatgttgctcggccgatttctttggcggtaagattgtttgggttctcattcgttgaaggaaatggagtataaatgtagagaaggggatgagttcgtggcatttctagcatgttttattggatcagtttgattaggcatttattaatattaccctcgtcttgatcaattttgtgcagcatttatacgatttcgcagtgtttactaccatgaacgaatcatccgtttcctgcatcagtttctcgtaacaaacatataattatttcggtgtctgcgtcacttcattttgcttgtccaaccagctttgatgcaacatttgattggattcggtgttgtctgatactctattttcgtccatgcatcaggctatatgtgttcttcttattcatgcatgttccatcatttctctattttattttactttatgtttgggtcatccatctgttaacatattatgtatgtcataattatgtcgatgacacactgcttcatgatctttttttactacgaatttggtggcactattgaactgaaattcgatggcaattcaattctgtttatattgcaga

SEQ ID NO: 68404 - DNA, 1519 bp, Oryza sativa
tattaaaaaacggaggcaatataatacaatgagaaaagagtcaaatgctttattattgagcaaaaatgatggtattatttttatcatcttttagcggaatctatctaaccatagttaatcagcctgtgttagtagaagtctgtatcgtcatgcatcaacatatcatgagattattagttatagctaagtacagcagtgtaatcatacttagcatatcacgagactatcgggtaatggacaattatctttaattgtgctagagaaaaaaaaaagtgctcccttcgtcccataaaaaactaacctaggactggatgtgatacatcctagtaaaacaaatctaggcatgcatatgttcagatttgttgtactagaatgtgtcacaccagttctacattcgtttttttgacaaagggagtaaattacaatccatactatgtattcttaaaaattcttaaaagttttcatataatggtatcctttaaccattttcatttacacaatagctaactttacattttaatttggaccaccatattctatccatcttcaagtccggtgactcagtaatcacttcgcacattaactctctctctctttctctctctctccattttctttttccatacgacagttggataaccgatagatctatcaagaaagagcccgatatagcgccttcgctcttcgtcgggtcagctcctgccttccaaagtccctgcaagcccaatatctccgacctcaatggcaacgataacaatagtgcgcatcacgataggggaggagaaaaagacttgtcggttactagaggttaaggctgcgcatgtaaaggcaaaggagaggaacgatggtggttcatggagaaagagcagtgatggcggtgcgtagagtgcagttagcggttgctggtggtacgaggaatttgttatcgacacaatcgtttaattttttcctaactattgatgatacatgggtcaccagttatataaagaaataacactagctagttttaaaatactaccttgtcccaaataagtgcagccgtgaaaatccgtgttaaacttttgaccgtccgtctcaaatttttaaataagataaaatgttaaacgttggatgtgaactttacaaaactatactaaaataggatggaaggagaggtaagtaaaaatattgagataagggcagagtagtcgagtacctctcgttgtctcctccgctccttgcctccttgcgccgccgccaagacgagtcgcggctgaacaggggagggccgggcggcgatctccatcgcagcggaggggaggggatcctggtgcgtcctctttctgattcctctctctctctctctctcccaccccaccgggactggaatttgcttgcgcttctcttctagatcttctcctcctccttaatttgatagccttaaacctctcttaaataattcaaggaataacagtttgtttgttcacccaaaagtttgggggttcaactgaacccccatgtcccaagttggatccgcccc

SEQ ID NO: 68405 - DNA, 2589 bp, Oryza sativa
taatcaccctcttctcaactgctcaatacataccctattcctttgctgtctgctatcaaacaccccaggaatttagccatttatgtgaaggccccatttattgcatgtaaaaattactccactcctgtagaacaacggtttcctgtgatggagttcaaattcctgcattccagatggagttcaagttcctgcaaatttcttgtgacattccaagtggggctaaaattgtctctgctaatttttctacttctatttttctggcgttatcttcaggtatcactgatcagattctgttcagcggtctcaaaagtctaatgcatattccccttaatacaaagatgcgctccctgtgtattcccaaaaaaaaagtctaatgcatccttctgagatcagaatttaaatcgtatttacatatgtaggtaatattcagaaatgcaaatgcccggtttttggttaacttttctaatattttctgttttgtgggggcgccagatacacaatgtaggaaaattaatcttcataattgtatttcttaatcgtaacagagcatgctcaagcagtttagcatccttttgagctgaaacatatttatattggcatactagatattatcaatctccagtggagtggaattaggtacagggtagttgattcttgggctgcgttcaatactccaacatagcatgtaccattagtctgttaccaatgaagcataaaaacaaaactccaatggaaaaccaattcagttgtgctagaacataactgtacctgatgagaagtcaaaagacagagtcgttttgtcatcatgttctgcgaggtggaacttatttggtgatatcttcgaaaaagccaaaattacggactgtcgagcaatgtgaagagggaatttgacttgaaatactaagtaaatattgtctccatagagcacagctgcagaaggaacgtctgttgtgagcaacttgccttcatctactttaactcctgagctagtctgattacttaagtagtattgcttgatgtatgctctcccttgattatcaatccagccaaccatagcacttgacccaaccatctttccgtcatttgagaaaccaatcccaacccatccagatgaatagggtgctgaaagtacaatgctggtgatgttatcttcactcttcaattttgaatactgcaagatgtgcagagaccacatgaactaagaatagatttggcgactttttattatgaagaaagcggaacatagcactttacagtatttgtttaaaataaacaaatattgatgttgaaagaagaataatatcaaattttacatggccagtaatttttttcctagaaacatgtgcatgtttcgtaatatgtttttcagtaatgacagtcagatacttctctttgagaatgaaatgttcaatatctgaacatttttggatattcctgtctagtacaatatctttctctctaaatttgtttcttagaaaatgctttcagaattttcaattcattacctgtggctatatattatactttcaaagtgttcaattttaattctcccgcagatatcttctgcagagtaagtttgcacaatttaaagatcaatagttctgctttccactattttcttggtggccgtggtactagtctgtgaaacgagggaagagaaaaccaaagtacaagatcggattcacatcttggactagtgtgaacatgtgcaagggacaagaactaacggacttgggcagcccaagtatttgctggaacatatatggagattattttttgactgacttgctcactgactaccatttgtataagatatttcaatggttataagttactaacaggggttcacaatgcacaacaaagaaaaaagtaaccatgtaaaaatttgagtatcagagtaacttaattttttattttgtaattgaagagcattcagaagaaattactcaccattatctgaagatcaaagtatgaactttcagtattcaaggaacctaacaatagctatgttgataacaaaaatgccaatttatttctatcctgctttcattcagcacatatatggtactaaagttgtgtgatgatgatcgatggtgaccctcacgtcgccctcacgcgggcggctcgggggagaaaaccctagccgcccgcgccggcacctcgccggcctctagccgcctcgccgccggcggagccagccgccggaaaccgcgcggtcggccgggaaggcggcggcgggagaacatcctcggggagcccttcctcggcgttggaggcggagcagcgtcgacggggcggtggtcgacggagcccgcggtcgatggacgtggctgagacggatccgggcacgccggagacggatccgacccccccgggcgcggatgtggccgatgacggtgctctgcgtccggctgccagtggaggcgggcagcgcgtcggctgcggccggcgaggggaggtggtggcagctcgcggcgacggcggccgacggaggcgcgcggaggtggcttccgctgtgcagcggcggagctcgtgcggaggtggctggccggcgacggcggaggctggcggctgcggaggccagcaccg

SEQ ID NO: 68406 - DNA, 15003 bp, Oryza sativa
  unsure (1)..(15003): unsure at all n locations
aaagtgttcagttcggaaccacaggtatccctatgtgcatggacggccactgcagtgaggatcactgtgatgtacacaaacaagacgacatgaactcgccttggcacagccatctatgttgatgtagagaaaggagcaactaccagctagaggtagaggatgttacaataagatcataggagcaatgaaccctactgttgggatgaagtaatgggctcatgtggagttgttgcatgatgattgattctatatttctggactgatgctttgagtgggaggaagagaaaagctgggtagtttgcaatggtggttatggtggttggagccatcatggctacttttctaaaagaatgctaaaagcctaccttgcatcgtacttcttcagctgagatggaaaatggctcatggtaacaccagccaccaggtgtggaatggaagtgatcaaaagtggtttttctgcaatattgtagttggatttcgcttgcacaatcaatggcggcagtaaccagcaagaaagcaagctgtagcaatgtgacagtttacccttaggtattctatcatcgcatgattatagggatgaaaacgacatgatcattgatgcattattcttggaatctctctgcatattgggtatattagaaggaagatggagaaaaacaagaagggctggataatgctgcctctctgaattagccaggttccaggcatgaaagagagaaggctcacaagtcacaacaaggaaatgaaagaggtcaagaacttgaacaagaaggatcaaccaaaaagatatcagcactgatgtctgtactctggagacagttgttcaaccaggaaaggattttttgaacataactgcatcgataactcttgtgatggcctttgatactcttgaccggtaagtgaacaacagaacgaccaatattggtatgtactacctctgtttcttattataagtcgttttgacctatttcctaattagtttatagaaaaatttagcaacatttataatacctaattagtttcattaaaactaatatgcaatatatattgataatacatttgttttgtgttgaaaatatttctatatttttctacagactgatcaaacttaaaaaagttgactataaaaaaaaagtcaaaacgaattataatatgaaacaaagggagtagtaatttctcgtaaaaccaggacaaaactcaagtttaagtaaaactggattattacaaccaaaatatatcatgtctaagtcgttggaccaacgcatggaggggaattgtttctagttaaccttcttgggagatttggatcatataacctccgtttagattttaaaaaagttgacatgtgaggtcatgtgaggtcgctgagactccttcctcaattgagatataaggagaaggtatatgatcaaattttttactgtagctaacctatgtttccatgggtcacccaaaattcatgcacaattgacaattcctcacgtttcgaatcaactctgtaacggaagacccaaccagaacaagaatagggagagaccatggatgacccagaataactcccttgttttgcactaaacttagaagtgcattcttggtccattcatgccctccatcctaacggattattctctcaaccccacgaaccattcaacgcgaagtctgcacgcatttttactcttttcctcccaacaaagcaatcattcccctgttttgctgccaattgcagctttcaagcatggcaagacgaataagagacccttttccttaattttgntttggatcattccctttcagnctttgattttcctggtatgacatgaacattgttcagattatttgttgtctgaagcccttatcaagatttgattccaggtttgtatttccctatctgatcttcaagttgttttcttctgataatgaggttccccatgctgtggtaccggttttatttgatgttgatagccatagcctttcagaatttcctccataatgagtagtcttagcgcaatgcaatttcaacatcccttacaggattcaccatagtgcaaatgacctaaaagtttcgaaattatgagtttaatacatttaaagttgtaaaagcttgctaaatgttcagtttcaaattcattttagatttcaataaacaaagaataagcacaatcaacctaaactgttcatcaagtggctagcaacttgtcaaggaggcctgagagtagcagaacattttttttcatttctttttgataaatgaagctttcttaatctcagacaatttcatcccggtgataaaattatactaagactactcctaatttaagtttttccttttttttaaaaaaaatagattagattaaatccggcctctgcacctttgtggggtatatacagccaaacaaagtcacgagtacgtaagattttgccattacatgggaaaaaaaactaagtttaacagatccggaaagaagaacaaaagattaagcttcgattcttcttctaaaattccaaccaaaagtagagtaaaactccaagactcgttttcttcttcagttttacctgcattgtaatttttttttcattttccagtttttacactttcactcaaattacctatcaaattttgacattctgccctgtgaagtttcagattacctagaaactcaagctttcaataaactaacaacgatggaggacggcatggatttcagccctcataaaaatagcacagaacagaatcgaaccagctttgaagaagatgatcaattcagcattcgatcagcaccctccaaaccatctccagacaagaaatcgaagcccaagaacaagccgaatcatcactccgacaagacggcgaacccgccgccgcagaggcccgagacgacggcggcgctggtgacgacgaccgcagcagcagcaacagcaggaacaaaccgtggcgaggccgtcagcaacggcagcctggacagcatcagcagcggcagcacacggagcaacagcctggagagcagcagcaccggcgccgcggcgnnnnnnnnnnnnnnnnnnnnnnnngcgtcgacggcgtcggtgtcggcgtcggggcagaacgtgaagcggcacaccggcggggacagccggtgggaggcggtccaggcggcgacggcgcgcgacgcgccggcgccgctgagcctggcgcacttccggctgctgaagcggctggggtacggcgacatcgggagcgtgtacctggtggagctccgcggcacgtcggccttcttcgccatgaaggtgatggacaaggcgtcgatcgcgagccggaacaagatggcgcgcgcggagacggagcgcgagatcctgggcctcctcgaccaccccttcctccccacgctctacacccacttcgagaccgacaagttctactgcctcgtcatggagtactgctccggcggcaacctccattccctccggcagaagcagccctccaagcacttctccgagcccgccgccaggtcaggttccacttcggaattttaacaaattgtttccacggagcttggagcagtttgaggaaattaacctccgtcaagtttgaacaaatttagacagcagtaactttggtaccaggaggcagggttcactccatcggttaaccccttttgatcggaggtcaccgaaatttccaaaatttagttgaatttaaataaatattactaaaattaatgaaaaaattgaaaagtttaaaaatttcagccgaagtaatattgtattgtaggggaaatttccagccctggcaggaggtgctagaatttgcagaataattttagaaggaatttgcacaatactaaccttattagttgcttgaaaaatcaacgagtgattttcctacgctcgaggatgtaccatgaagcacactattttctagtataaattttggtacatttatctatagtcatgtatcacgattgacaacaaaatatatctattgcctgtacctcatgtatcatcattctattgtagatttgatctgaaaattgaaacttgcgtccgataatttgatctaaaaaaaatatgaaacttacgtgggaaaatttgaactttgatgcgtcgtcaggttttacgtggcagaggtgctactggcgctggagtacctgcacatgctggggatcgtgtacagggacctcaagccggagaacgtcctggtgagggacgacggccacatcatgctctccgacttcgacctctccctccgctgcaccgtctgccccaccctcgtcaagtcctcctccgtccacgccaccggcagcggcggcggcataggcagcagaggagacgccatcgacggcggcgagagcatgccggcgaaccagggctgcatccagccctcctccttcttcccgcgcatcctgccgcggcgcagccgcaaggcgtccaagagcgacatgggcctgctgctcaacggcgcggcggcggtggagttcaacgcggagccgacggaggcgcggtccatgtcgttcgtgggcacgcacgagtacctggccccggagatcatccgcggcgagggccacggcagcgccgtcgactggtggacgctgggaatcttcctctacgagctcatccacggcgccaccccgttcaagggcgccggcaaccgcgccacgctctgcaacgtcatcgagcagccgctccgcttcccctccgacggcggcgccagcgccgtcgcgcgtgacctcatccgcggcctgctcgtcaaggagccccacaagcggatcgccttcaccaggggcgccaccgagatcaagcagcacccctcttcgacggcgtcaactgggcgctcgtcaggagcctcacccgccgtcggtgccggagccggtcgacttccggcagtacgccgccgccgcgtccgccaccactcccaaggacaagaagccgccggagaacgccgccgccgccgccgcccccgccgcggcggatggtggcggcgcggccaactcgagcaccggcgagtcctacactgactttgagtatttttaattagtactatatatttattcctgacaatattgttgtgcacaccagattgttttgatcgatggttgtgaagtatgagaactcgattcgtgataattaagttgtactaactcattcttggactatggtagattcattgtaaacctaaaattcatatgaaaatgtagcgatttcatttgattggtttgttatatgtgaacatctgttacttgttattgtagtatatgttcaaactaacacgtgattttagtacgtgtatatacttcagtttaattgttagatttcatatgctattttgagcaaaggtaggttttcaagttaaattggatttgatgtaagcacgggttctatcttgatatttctctgggcaagagatttttttttgtcaatatttatcctacgtcctctaagaaataatcaattgctcctcaagttcataggtattatttttgttttttggaacaactaacaccgagctaggttttgcggctgtcgcctgtcactgtctatccacaactaattgctccattgctccactaccgaccatccgccatcagcgtgaggacaccgctgacccgatgccctcccgccggacagccaccgcatgcctctatggcacactcgccactctggcctccctgccatcgttgcgtccttccgtggcgttggctaggtcagcctccctgtcttgcgccggcctcccaccggcgtcggctgtgcctccccgccagaccggcctcctacgcgcatcctcgcgccgcacggaccttccgccgccggctgcgcaactcgcaccgcgctgacttcccgttgcctccggccgcgcatctcacgccacgccagcctcacgttgctgccgccacgcatctcgcgccatgccggcctaccgtcgccaccagctgtgccgcctgcttctcccaggctgcccgcacctccacggcctcctcaccacctcgtccttctcggaggagccgaacctggccatcccgcgcctcctccgcgcgagcacgccatggtctcctctgccggtgccatgatctcctccaccgacaccatgacctcctccgccggtcctgaatgcggcgcggccggtgtgctccctctcgatccggtcgcgagggggccaattctacctccgtcagcaccggatcggccgtgtccagcccaaacggcgtcagaacccgtcgtcgacacatcgcggcccctccgcccgtgtcccgttgatgccccagccaccgggtcttggagcgagctagaaggccacactgctgcccagctttgccggtggctgctggcgaggcggatgaggggagggtggcggctgggttgggacttgccaccgtgtcgctaacaattgtacattagaagcttcatatacagctacatgactagaatcgttttcgcaacacataacatgagtgttctaccattaaaaaaaatagccgttatcaaacagcgtcaactctaagccatttctaaattcagtaatcaacacctagagaaaaagggcagctaaggcaagagcatcaaaattttcactatccaactgattttgtatactctaaagaataatatctttgggaagaaaatcatgcctaacatgtcatatatacattcttgaatgagtataactgacattattcataaataaggggaaaaaaatagcaagggactttcacaattactgagcacaactaaattcgtaagccttaagtacaatggacgatacccctgtaattctaaatatttcacactgaagaatagtgccttcattactgtattgatacaaaatgatagtatacttggtgctaatttttggcttaattttcctacaatgaccaatattttgtttaattattcaaattataaatcattataaaaatgagagaatctattatatacccctaattttttatactagttcaacaatttgccatcgactttgtctccctctataataagccaccgactttgtaatttttttctagaatataccactggggtgggtacttctcaaaaaatgcctaaaatttccttcaagccattctctttcacaattgattgactaattagaagtttcaaaaaagtataaaagtttttgttagctttcttacacaatataaaagtttgtgtatatattttaagattttctgtcatgatttcttttgaaaaactatttttatgtggcatgtgaaagaggaaccacatacacaaaagatagctggattagaaaaataattttatgtagcatatgaaggatgatttacgtaaagagcatcaatacaagaatattctattagcatatgaaacataaatttcattttgcaaattgaaaatcttgaaatatacatagacttctatattatgtgcgaatgctatgtgaacattttcatatttttcgatacttctagtatgtcaatcaattgtcgacccttatatgttcgaagggcattttaggtgttttttgaaaagtatccacccccaatagcatattatataaaaatttgataaagtcgatgacatattatagagagagataaagtcgaaggcaaataattgaactgaagtttcttgagacaggtgatatatctgaagaaaacgcttcaattacaggatataatatgggcatgatcaggattttagaagatataaaccacaggttaaaaccgataagatgaccttaacagtatatatagaaatgacatctaattctagccaactcaaagcaatatatatatggctcatagctacctactaaataatgcatcttcatattcttaatgtacctttaaacttccataagccgattaatgtctatgaaccaagcatgcacttcttttgaagggactaacttgcagcaagccgtatatatccagttggatgtagaggccgggtaaaaaataccattctctaaaaaaataaaatataaaaaaagcaaaatgttagttaaaaacttattggtgtggtggagtgcaagtgatccctctgtccacgaaaacctcgttctgtattattgatccatagagagtagtaaatccatggagtcgagtcctaccaagttgccatcactgagtgcaattgcaaatcaacagctatgcgaattttgttatgcaaatatgcaatggatgaaaaaaaacatatggcttgtcagggagcttataatacagctctaaatatacaatgaataataccaggttgagtgacaggacaaaattaagaaagttaagttttgcacttttgttcaatcttttattacagtgtttcatgtagatttataacaagaattatatgcatatttatacaactaatatccgcaattaggaaatatatgcactgatacagttcaatttttttttatcttttttagagaagggtatttttacccggcctctatatccaaccggatatatatagtttttttaaattaggaacttagcctatcgaatagggaacttagctctcaaataatccaatctgaaattcgctcctatggagatttgaactcagggtgctactcaggtcactgcaaccactaggctacatgccctttcacgatacagttcaattaaacacaccttttagcaaaatctgtgcaattatatattctctcaaaccatactttagatatggctgctccttcctccagagatcctttttagatgcaccactatacttgactccccaagacaattcatactatttttccatagagtaacagaaacgttcttattcctcacagtatgaagcaggtatgtgattagcaacagaaaaatctaataaaccaagcaaattcacctattctgctagcaccagatctctgtatttctggagcatatcatttgtcaagattctagaaacaattgcactctccaaacttttcaatgtacttcaagatttcattaatcatggactgccacaaccttcaaattacatggcactggttttgacacagatggtgtactttacatcttaaagattgtgtcctcattagtggcaagtcagttagatatcaacaatatttctgatattttcagcaatgaacagtgtaatttacgtactcctgtatatctgaaaattctaatacagtagacacaatgaaaaactttagaataggtctatttggacgcaatgaattagagagataattctgaattcaaacaatgacaccggttaaacccatcgacaatgcatgaatatcagcacgtataccatcagaaaattaattgattcgaagggaacgttgatcaaacaagaaaaaaaaaagatctgcttccaattcctctagaaatatgaaagtgaacattattaatccatgaaataatttaatttgggacgacagaagtacagtagtcaggcataaacacaaacaccttcaatgcatctttctgacaaaacaaatgtgcaagaacagaaaagaaacatctccactccaaagcaacagcagatcgaagaagaagatgaaaataccttccgttcaaatccatctcctagctagcgtgttcgatcaacttggtgccacatcggcttctccgatcaatgggcgatcggatctgcatcacactgcctgggaagactgcaggacgcacgacgcgagagggagggtagggaggaggagcgccgcgccgccgccgccgaccgctgagagggaaggtgatcgcgtattcgcgtgcgaggaggagtctccggctcgtagggaagaggaaaccgcgatggtttggtttggtatacgcgccagagttcgtatgaattaccaaagtagaatccatatcaaacacgaagagcctcccatgcataccgccctcttcgaaattgatcgatcgatcgatcctcgtgtcgatcgtgcgtgccaccccggcggatggatacatcaggcatgttcgccgctgcgcaggttccgaggcggcagaggtcgcggcgtgaggagtcgatggaacgcacggagggccaagtggtggtcttgacgccatccgggagtactggcaatggagatggagatggagctctggtggtgtcgaccacgtcgtcggacagaaatagaacgccgcgagttcgcccgagggagacgacgacggtagcggcggccgctgaccgtagcgtgctcggcggcaacggtggcggcagtgttgacgtggccgacggcgactccaacaatgccgaaaaggagcagcggcgcaaggaggaattcgatagagagcggcggcgcaaggggaagatggtcgccgaggaagagagcccatcaaccgccagtggcggcggcatgccaatcggcctgcccgccgccgacaagctcatgggtgacgccatccgaggtggccgacgacagcacgtgacgacagcgatcggaacctgcaagaacaccaagcggcgcggccacggcaagttctgggccagcctaggcagagacggcgcgtcgacgtcttcggcagggtccgacatggtcgtgccgcttgacgacattgccgtcgtccacgaccggctgcgcagcctcctcaacggcctcggcgccgtctcgccgccggtgcgcgtctacggcaagatgatgtggcgttccgaccgtttgaaaagccaaaaccgtttacaaatatcacgcaagaaggatggcgagttatccccgtttgatagcatcctaacgctggcggagaagtcagccgccacaagtaagcgcaaaaagaaatccagcaagcctaaaaataagaagaacggtgagtctaaagagaagaaggatgagcataaagagtacaatgacaatggcacgaacaagcctaacaatgagcctaacaatggtgatgatgggctgttcgtgcaggcctacgaccgcaccggcgaggagtacatcctcacgctgaagtacattaaagctaataactcgtatcgtctcatgggtcgtccatggaagacatttctgaagaattgcagtcttaccctccaagaagacgccaagaaaaagggtaagaaggccatcaaaaaggtgaaaaaggttgccattgctaacgaggccatgatcgatctatgggtgtttcgttctcagaagttgagccatggcaaagacgaccacaatgacggccgcctcgggctggttatggtgcactacttcaaaggtgatgctccacatgctgacgccgccttcaaggccaacgaggagctactactgcttgcgcccaagaagaggaagaaaaaacatgagggtgagtcctcatcgcatgatgcggttacggaggctttgccacaggaggagccacgtggttagcgctgtcgagctggagatagcggccgtcatggccggggagactggtgtccagggaggtgcgccggagccacatcatggagtggaggtagttatggagggtgtacagttggaaatcagggatattgaccttgaggtgctgttggcagcacaaactctatttgaaatgaagaattctggccgacggtgatatggatgttacttgagttataagtagttaaaattaatagccaccatagtttttccttcatatatattattggatgtcacggttagtactagtaatttagacaaattaccttaaaggaagttgactttgcatttgagtatggtctaatttcggactttgcgtcaccaaacaacaattgagttgattggaaacctgatggctactaatattgattgatactccctccatcgaaaaatgtatgacgctgtttgtcacgcccagaaattcgctaacccgaatttcaagcagaatctatattaaatctctgtccaggatcagtcagagtacataaacgacaatttgatagacagatccacgtcttacaaaaataacaaaaagaaactcacatacgcagcggaaaaacaaaataaactagacttaatcttcacgaccaaagtgaagcttcctccataaaccacatgcaatcctcgacgtccgaaacaagctcaatcgtgcacaatcaaagagtatgtgcacaatcgggcacacctagaaggatgcacaaccaaagaggtaattgagtgttgtatatgttacataaggatgtaaatgccattgggatacttatgcctagacatgagggaatattgattgggaagggatctagtctaacttggctaactataagggatggatagggttgtcacaacttgtcgcctatggtcccccgttgatctagactaccttcccaaataaacttgtagctaagccccacgctaacgtatcatgctactactttgctcaagtgcacatactagcaaagcaataaagataaataaagtaagacctttatctaaattgaagcaagaatcgataagtatggaatcattaagatgacttgataagtaatgcaaaacagtaagattcacattgtcgaaccaggaagatgaagacggtcattttgattggatgacgaccatcgaccgatcaaaattcgactactgacaaaccagagatcaaccaccgaatgttgacgaggccaaaatttcccaacttcttcgcattagagagtcggcgaagtccgacaaccgtagcgttctcatccaaactccccactcccctatttcctgtaacaccgtatctccaacatctacagttgtttgctctacacattgagcgggccacgctcatatggtaccctgcttataatttcgtcctcgtttcgtgtaaaaaggttgactaggggtaccatggttggagcacaaatgcttataagcaaacctttacccacctaaacttcctaggtggtattgaaccaccaccacacctataactataggcttaaaatgggttggagtattacatttctactctatttggacaacatggtgctaactagagcttgatctttagctaccggtgttttgcaaataatgtggaggggaggggtaatttatagcctgggggtaagtcgatttctcggtcgacctaggttagtggtctggcctacctgggttaggtcatctgagcatgtggcactggttggatcccttcattaggtcgattggtgtcatagacggttccaatcgcaccttgaagtcggtatcgcttctcgaatactccccacgtgtggccaaagtcgattgaggattgggctaggttggctgggctaggaaagggcacctcctcgatttggcttgtcttggtgaagttgggtgaccggaatcgtttgacaccattttgtgatcatctatccttcaccagcacctttgtgataggagttttgggctcactgtgcacttaggtgagtaacatttgttaacaatacagaaaaatgtcttgattgacatgccattaaataatattataaagttgtttatgttggaattataccatttatgtacaacaatttattacctcatggaatgtcacgcccggaatttctatccaaaattccaaacgcttacatgtgtgttaaatcctcgtccaggaatcagctgaggcacacaataacaaattgataatagagtactatcaaactactaattaatattcgcaaaataataaattattacagaggtggatagttcctctcaaaagaataaaattctacgcagcggaaaaacaaaagactaaacagcttccttacaaaaaaagactaaacagctatggcgactccactccacaagcaacttgacccgtacaaagcctaatcctccagatcatcaccttcactgaaatactcctcctctgatgaatgaatattgcaagaatgagcatatgacatactcaacaagccacacagcaaatatgcaagtgcacaggataacaaaggatggtataatatagcttatgtgcttaaacaacatttaataaacatttaagagaatagtaaaacagttaagtaattacgcaatattaaataaacaccatacaacacacccgtgttgcataggcctaacctcatctgaacaaccaaccccggttgtacaaatcaaacctccacaccaggaatataccattccaaaccaggagtcaatttaattatcacaaattatcaccaataatgagtagtgtgggactaatcacgaaaaacattgttaacccacccataaccgcgggcacggctattcgaatagttttactctggccagagatgtaccactgtacccacaagacacagctccacgatatgtcaccatgcgcctcaataccaccacggtacctcggaaaggaactgtgacaatacccctcgcacaacacaactcaccacagtgcaccatacctggatcataatcaccccctctacaaccagaggcatggactccccagcgaccccccacggacttctcgccgcttctcagtctggcaccccataatgaaccatgctatacaaaaggtaaagccgttgcccacgctggcttgtggttggcacggtaaatgtttcacaacagtagctcgtgaaccggtccttaattgtcatgagcacgaccatcaaaaccatgcgctcacaacccacctttaatcaggttttaattattaattaattaacataacacgattaaccatcgtgagctaccattaagtataaccataagtaataatgtagtatgattcatcccattaatgagcttatgtttctaagcatggctaagcaattatacatatatagcatttagctgaaccaaaccaatatataaggttctagctaatcaaattataacccataggaaaatacagtcatcttcggccataattaaatgggaaaaggctcaccacccgatggcattcgaaaataatgcataagttgaaataaaacattagttttaaacgggttcaacatgctcaaaggtttgtttgggatctgtgtgacttgtcttgagcttccacaaaaacctctaaaccttcctcaactgaaacgccctccaacgaaacgtcggaaactaaagcaaataaacaaaatcaacaaaacagtacaaaaacaagcatgaacaatacatgtggatatttttaacatgtagatctagattttagatgaatttagcaacttgaaccacttgaatcggagctacggttaattagttat

SEQ ID NO: 68407 - DNA, 11078 bp, Oryza sativa
  unsure (1)..(11078): unsure at all n locations
ttgattcggataaaatacaaggatttaggttccgattcttagggaaaacgagagaggaagataaaggaaatatttcccctcaactaattttaggaaaacacaagagaaaaggtcggatttagatgggagatgataaatggtccttcccatgagggagataacttatgcctatctcgcgtagattgaatcttcctcaaaaccatatctccgactaaaaatgtgcgtgatctgacattgcgattgtgatagcgccgcaatccttgtaaataccgagccgactgaattaatgctgcttctcgggcttcttccagtcggttgagatcatttactcggtcgtcttcgtagcgctcctctttgaaattacgaaatcacagagattcaaattccacctcacttggcaacattgcttctgcaccatagactaagaaaaacggtgattggcccataggccgactgggtgtagtgcgaagagaccaaagaacttatggcagctgatcagcccatttgctggcatagggacgcagtcagtcaaaaactcatgctttgatgccttgaagtaccataccattggcgtgttcaacctgtccattgctcataggatgtgctatagatgtgtaacaaatcttgataccaaaatcttcgcagaagtctttaaacactccaccagtaaattgggtgccattatctgtaatgatacgattaggaaccccaaaccgatgcactatgttgatgaaaaaatctcgagcattgtcggcagtgattgtaacaaccggcttagcttcgatccacttggaaaatttatccactgatacagaaagatgagtgaaaccaccggtagcccttttgaaaggaccaaccatatcgagcccccaaaccgcaaaaggacaggaaagagggatagttttcaacttttgagctggtagatgaatttgtctagcaaagaattgacaaccttcacatgttcgcacaaccttctcagcatcggatactgcggtggggcagaaaaaaccctatctgtaagctttgccaacgattgttcgtgcggcagcgtgatttccacaaatgccagaatgtatgtcctgtaacaattgccttccttcatctaaagagaaacagcgttgcagaattcctgacggacttttcttgtataactcggtctcaatcataacataaagcctgctacgtcgacaaatccgctcggctttgtctttgtcttgaggaagctcttgcttagtcaaaaatttgatgaagggttctctccaatcggtatcaatcacgctgacttcttgggtccctaccttctcgattacatcctttcttggtactgttggctcataaaggtgctcaacaaaaacatctgaaggagccgcttctcgctttgaaccaaaattggctagtctgtcggccgcttcgttgtcgtgccgaagcacatgagttaactctaaaccatcaaatttgtcttccaatttatggacttcttgtcaatatgcagccatattatcatctaggcaggaccactctttcataacttgattgaggaccaactgggaatcgccaggaaccaccagacaccgaatccctagagaaacaacaatccttagtccatggagaagtgcttcatattctgccacattgtgcgacgcagaaaagtgtatccataatacatagctcaatctctctccagtcggggaaatcaacacaaccccagctccagtgcctgatagcctctttgacccgtcaaaatgcatagtccaatactccagcttctccacaagtgtatcttcttgacactcagtccattcggcaacgaaatctgctaaggcttgggacttgattgaagtgcgtggcttgaaggataaatccaaagacatcaactctagggcccacttcgtgattcgcccgtttgcctcgcgattatgaagtatgcctctgagtggaaacgatgtgaccaccgtgaccaagtgactctgaaaataatgggataatttcctgacggtaattaaaacaccatataacaacttctataccaagggatatcctgttttggagtcgccaagacctcgctaacaaagtagattggctgttgaactttttgaacatggctgtcttcctctcggtccacaactaagaccgtgctcacaacttgcgatgttgccgacacatataataatagcagctcttgcggatgtggtgatgccatgactagtggagttgtgagaagttttttgaaatcaccaaaagcttgctgggcttcgggtccccactggaaattgtcagtcttcttgagtagcttgaaaaatggcatcccccgctcgccgagtcttgaaataaaccggtcgagcgccgccatacacccagacagcttctggacatctttctgggaactaggcggtttcatgttgaggatgtcattgattttttccgggttggcttgtatgcccctacgagacaccataaagccaagcggcttccctgacgatactccgaaggtgcacttttcgggattcaacttcatcctaaaagcgcagatgctagcaaaggtttcttccagatcagcgattaggtcatctttttgtatggttttgacagctacatcatcaacgtaggcttcaacattgcgaccaatctgagttgaaaaacatctctgaatcatgcgttgataggttgccccagcgttctttaatccgaaaggcatggtgaatagcagtaagctccaaatggtgtgatgaacgaggtcttcaagcagtcgaattccttcaaactgatctggtgataacccgagtagcaatccaaaaagctgagtagcttacagccggctgttgaatcaaccacctggtcaatgcaaggtaacccaaagggatccttacgacacgatttgttgaggtcgatgtagtcaacacacatgcgccattgtcctgtcttcttccaaaccaaaactgggtttgccagccagtcgggatgtaaaacttccataatgaagcctgctgctaacagcttggttaattcttccttgattgcgtctttcctgtcttgtgcgaaacggcggagtcgttgtttgataggtctagcatcttctttaacatttaaggagtgctcaatcatctctctaggaataccaggcatatccgatggtttccatgcaaaaatatctttattagcttgaagaaaggtgatgagcgtgctttcctatttacaatctaactcagcacctattacaacagttttggatggatcagatggatctaggggaattttcttggtcttggtatcgccttctccagtcttcggtgacttggtcacaagcacttctccttcggctgcggttgatgcaaccagtcggatctcattccgagcaagtgcaatctcacgggtctgggccatctcacagctttccttatcgtaggtgacggcttgcttgatgtcgctccgcaaagatatgactcctcgaggtcgtggcatcttcatcatcatgtaggtgtaatgtgggactgccatgaatttggctaacgccgggcgtccgagtatggcatggtatgccgtttcaaagtcagcaacctcaaagcaaatattctctgtgcgaaagttctcccgagtgccgaaggtgataggcaaggtgatctggccgagtggagtagaagacagccctgggatgattccatggaagggagcgctactcggcttcagcttagtgcgcgggatctacatatcgtccagagttttgtcaaaaaggatattgagtgcactgccaccgtcgattagtgatcgtcggagcttgacattgcgaaccaccaggtctagtaccaggggataccgccccaggtggaccactcggtcaggatgatccgagcggtcaaacttgattgttgtttctgatcagcgaaggtattgtggcgtgtcgggctggacgacgttgatctccctatcagtcagcttttgtttccgcttggactcgtaagcttgcggcccaccgaagataggattgagctctttgcgagaatcttgaaaaccagtcggaccatcgtcttcgtcatccttcttctttgaggttctttgctcccgatctgtcggcttctttgcttgcttggtgtattgctccacaaactacttgtagatgaaacaatctttggctgcatggttggaatttggatgatgtgaacattgggcgttcatgaccttgtcaaaagtgttgatacgcgaacgctgtcgggaagatggtgatgcaagtgccacaaggtcttcaagcttacgcttgagatccttattgttgttacttccattccccctgacggctggcgtatctttcttggacttccaattgatgctcgactgcttagaggcgttgacggcatcatcagacttggcatactcgttggctttttcaaacatttgcttaactgtcctgggaggtttgcgtccaaatttgccaaccaagagcttatgacaaacacccttggtgaatgtagctatgatgacgtcatcggtgatgtttgaaatcttgttgtgttgctcagaaaaaaaccggatgtagtcccgaagggattcaccgagcttctggatcgcattgtagaggttgaagtaggtgcccggacgttcgaaagtgccttgaaaattggcgatgaagtgctcacggagctctgcccaagatccaattgtaccactggttaacccatggagccaggatcgggcagagttagcaagggccgccggcaaataatttgccatagctttactgtctcctcctgctgcgcggattgcgaggccgtagacggtaagccgtgtcacatcctgattttcgtctaaggatttataaattatttaataaattattattagaatttatattgaatgttcattaatttacaagtgaagctaaatgtgggaaataaaattttctaaatataggatttatgttttattaaattctccatgattaattatactctctgaaattttctcggatttttcggagctcaattcttaattttaatcatacaaagaacatttcagtaattattcacatattaaattagtcattaaatggtctgattataatcttgttaagtattttgagtgtccaattggtttcatgatttttcttgaaattattcgggaaatggaagtatttttaacaattcaaagatcatttcggtggttaatttatttgaaaaagtaaattaaattcccttttcctttttgggctgaaactggaaaagtctatttatttatcctcggcctattcttcctctttgcctgcttcctgtctctttgtcttccggggaagtctatttcttatccctcccttcttttgtttttagcccagcaaaaaatctgttttgcttcccccgcgctacagtatcatcttccagctccagacagagcccgacccagccgtcctgtgcctgtgcagccgccgcttttccctccaaatccggcctcccctttcgatcttttccagaattagttgaggggatttgtttccctttttcttctcttccgtttcttctaaggaatcggattttatccctttgattcgagttcaaatcggtcggataaaccttatccccgaaccggcgaaccttaaccaatccgccgccaaatcctctcgggtccgagccgatctcctccagctttggctataaatagaacccccaagacctcctctttcgtttccaacccctagctcgagctcccgttccctagccgtctctccccgcagccgccttctctctccgccgccggcagccgctccagccgtccctagcatccggtgtagccgtcgcctccggtcgccgtcatcaccaccgggttcgcaaggaggagaagaagcccggccactagttccttttcgccgtaacccgctggaagcccctcgacggcgtgaatccgatctactccacctccggccgagcctcgccgtcgactccgtggtttctggacgtcgtcgtcgctttcttcggcatcgcagagccaaggtgaagcccgtccactggttttcctccgctaaagattgccggaacgccgctgtcatcgtcgaccagtacctcaccgcccttcggagttcgtcgccggctgtctcccgtcgtcggtcgtcgtcgtgccgcccctcagtgagttctcctcgtcgtgctctttcttccggtgccttcggttcgcgacgtcgtgccctaggttgccggcaaacgttggaacccgagcctcccgccggtgatgacgtcatcaatgatgtcataaagcccttttcttttctaaaataaatcgtgaatccttttctgtataaggctaaaatcagtttaatcttgtaaaattcataactaattcacatgaggccattcaagtctctaattcatctaaaatcatgatctccatgtttgtttatttttatgtgctgtatattttgtttttattagtctttttctcggtttggcgtgttagcttgtcgtttctgtcattgcgaaggatcgtgagtgcgtcggaagttgttcagaagactaattgaagaccgattattgcaaggagatcccaaacacaatcctttgagcatgttgatcctatattcaaattctctatttatttcaactgtgtatttattttcgaatgtcaccgggtggtgtgaacctattcctttgttatggtcaatttgcattgaatgccctattccttgatacctcgggtaataaattgattagcttgaaccttatatattggtttggttcagctaaatcatatatatatatatatatatatatatatatatatatatatatatatatatatatatatatatatatatatatatatataattgcttagccatgcttagaaacattagctcattaataagatgaatcatactatattattacttatgattatatttaatggtagctcacgatggttaatcgtgttatgataatcaattgataattaaaatttgattaatggtgggttgtgagcacatggttttgatggacgtgctcatgactgcaatgttactgttgagaaacattaaccgtgccaaccacaagctagcgtgggcaatggctttacctttcgtatagtatggttcattacagggtgccagactgagaagcggcgagaagtccatgggggtcgttggggagtccatgcctctggttattgagggggtgattatgatccaggaatggcgcactgtggtgagttgtgttgtacgaggggtactgtcacaatcccgtttcgaggtaccgtggtggtactgagagcatggtgacatgttttggggctgtgtcttgtgggtacagtggtacacctctggccagagtaaaactatttgaatagccgtgcccacggtcataggcaggttgagcaatgtttttcgtgattagtctcacacctctcacaataattagctcctggtttggagttagatctgtacagccgggtatggttgttcaggatggttgggcctgagcagtatgggtgtgctgttcagtgttgattagaattgatgattattctacttttttattgttcttaaatnnnnnnnnnnnnnnnnnnnnnnnnnnnnnnctatattatgccatcctttgttatcctgtacacttgcatatttgcagtgtggcttgttgagtatgtcatatgctcaccttgcaataatcaagcaacctcagttgaagaaaaatgatccagaaggagaagacgtttggcttataccccagttgagttgcctgtgggagtggagccggagctttgctagattttatttttccgctacagttttcttcgttgtgaggactaagtacctcttcagtaagtattagatgctttagttattttgatgaatatgtatattaaattgtcagtttgtgtacctcggctgattcctggacgaggattttacgcacaaaaaagtttagtaattactagtaaatttctgggcgtgataagttcagaaattacgagtgaatttctgggcatgacaagccatgactcgggattggttttgccgtcatacttctcgataccagtcggcttgaagctagccagccaatccactcgacgcaggtcgcttgtaaaagctacaacgccaacttcgtcgtcgtgatgtcgatttggtgaacagtgtggttggtggcctctttctgcatggcgttgattgagtgtatcacgaagatcgatgggttgccggcgacgcggagagtgaggctgctcagcgcggcgatctctatgttcattagctggcgagtgaacagagcattttgcatgatccctgctcctgcgattggatcccgaggcagcaacgctaaggcttggcttgtgccgtgcagagaggcttggctggtggtaatcttgggatcagagaggttcaggccctctcaatgataagtaatatcctactcctgtccggggattgatccgccgagtgtgttattgatcgtatgatctagaggaaaagttataccccaagaggcactcggacccctccttatatatggggaggtgtccgtattacaagatacaacccatattcctaacggaataggcaagtaaagataaaatacaattgtaaccgactaggatctcggatatttccttgatacacaagttacgaatttatcccaagtcctttaaagatattctatgtaaatatggtacccttatacctagtcggatatacatgccgtgtgggtatggggtatccataatctccacagtagttttgctacatcagatagcaatttattttttgtatatgatatttttacacttaaaacatttgcatatttaaatagttcaaacttttgttcggcatcaaataattatgtcattttatgaggctcagttctttcgtagaaccaatcgacgacgaaactccccaagagcccaaatggggaataaattgcgataattgctgtaattgaaataaatggagctgttgaagcatccaacgtgttcctgtaattaaagttggaatattagactactattatctatcaagagtggatggtagagtattcatgcatgccataaatgccaggccacaaactacataacttgatgattctattttttcccatttcattcttgtggataccaaaacaacaatccaaataaaatgaagtgatgagcaatccaaaaataatatttatgtgcagttagtatattaattcattattgactatgtatgtttgtgttacaagaaatagaaaatccatatactgaacatgtttgtgctaaagaaaatagaaaatcatttaatcaattgaatactcacttgttgtggaaactcgcccgtttctagttgcatattaatcaattcttttgctgcatgatatagtggcgatggatctctttcaacctgattttcattgaggcattatgaaataacattgtagtacaataaataatataatagacaattagtacctactaaaatgaataatgaacaaaacacacctaaccagcatatattaaagctaacattgcccaagcagtgttcacaacatgagatctactagccccaacataaacttgttcaataaaagaatgtaatctaacattatcaagacttatgttcatatgctagtacctatgttgtgtgacttgtgtgtgtctgcatgcaaatacaaagtcgtgttgactaggacatccatggctgtgaatgcatgactgagagagaatgaccaatacatcaatttcaaggcattgtgtgcattatgttactttttgtttagatcaggtttggttgattattgattcaccgattatttaggaccaactagcacatatggaaatttagagtaaattttactttgggccacattttattactgatgtttcattttgtaccaccctttaaccgatgttttcacttttgacagggtaatctcacccttgttgcactttggacctccccgactctcttctgaagcacacaaacgatttcgattatgctgggttgtactcgtcaatgaactctacaactatatgcatcatctcgctacaccgtcgttgcgttcggttctccttgtcgagctagttcccagcctgacctcctcatgacccgaagcccataggagcgacgtgagtcgtcaactcgaagcttccatgaccatctctcccgctttgtcgaagcgccaactgttgacgtcctcgtctgtcattgtcgtcatgaagtctgcaatgccaagccctccactgtctgcctctttagcaagcgagaagatcaccgaagctacatcatcgctgtcaagctgaagcatcgtcgctgccccgagttcatcgccttcaagaccacaccgccagtcccctcctcactattcggtcatcttcattttcgtggcgaggatctattttccaatatctccctcccattgccctcgccttttgccatgcttctgtgcatcgttgacctctgtcatgggccaccggcaccggtcagtgcatccctcctgcgcatagccgcgtgtttgtgcatgtggcctcttgtttggtgtcccatgggatccacttgttggtctcttctctgaggcttacacatgggtctcactctgcttttttagtggaccgtctcagtgaatatttatgtgtatgatgaactagccatttgacccatgggacttggctactggtcgcttgatccttcctttcctcgagcgctgatgcattggacataatttaatggtataatcataattaagtagttcagaaatattcacttgaattgcatataattttggattgtagtttctcagccatacgagctccaaattggcccgtttaagttgctcaatttatgttataacttaaatgttgtctttatattcagttgtagcttgttttcttgttcatgtaggtgcagtagtttcaaatgtttctgttgtgcagttcaaatccgtcatagaagtcttggcaatccgtatcgttgagcatggaaagtcatatcataatctaagcatgttgaatcctataaaattaccattcgtctcggtttttaattaaaccaacacatatgtggaaaaaaacaccgagccacctatacgccaagccgatctcctctcttccgtcatccttatcctctctgccctctctccgtgtgc

SEQ ID NO: 68408 - DNA, 728 bp, Oryza sativa
cgctggataactggttttgcgggacgattttgtaactcgatgacaagttgagggaccttcggtgtactttttcccccagaaaatagagtactatttttcctgcaaaacacatatgggctttcagcccaaaacaggtttatgggaaaaagttcctacctgagtgcccgataaaaataaaaatatcgggcgctcctcattctcagccactcgtttcttatctcgctctccctcttctcgcttctctcgctccctcttctatggacgcggccgagcttcgcggcgttgacgatggcggcggcgcagttgtggctgacatggccgagctcggcacggcatcgacaacggcagccacgcggttgtggctgagcttggtctgcatcgacgaccacggtgcagatttgccacatgagcacgtggtagtgattctagggtacgtcggtgccacctcctcatccacagcggcatctgtaacgccccgattttctttcgggattaaaaatcattaaataatatattttttagaaattaaataaaagttaagtcaattcaatcaagtgaaataatgggagaatttaaaatttttcctttaaaaatcattggccgagaatattttgcaatactctttgtgccctaaatattctccgaaattttcgcatgaattttcggagctcaaaaaataattttaatagcacaaagatcatgtaatcaattaattaaaaagaaaagca

SEQ ID NO: 68409 - DNA, 14188 bp, Oryza sativa
  unsure (1)..(14188): unsure at all n locations
nnnnnnnnnnnnnnnnnnnnnnnnnnnnnnnnnnnnnnnnnnntcgtctgggcctccgtcgtgccaatcgttgtcgtcgccggacttggaggtttcgccgtactcaagtaatcaatggtgcagatgagttacgttgggtgcctgcttgttcttgccagtttaatctgcagtcgtttgcttagtgccagtaatgagtgtgtttttgtagcggtttgatatcaaattactgttttatttctgcactgtatatgctgtttctgaattaatttacctatcaatttgtgattcgagtgtacattgatcaaaacagagctactgatttttgtccttgacgggcgacaagctcgccggaaaacgcggttgctgcgaagtcgctgaacccggtgtctctcaccacctcgtgttctcgtcgtcgtttgcgcgcggcggagctccggcgagctccggaagcgggggagatgacatctttgttttttatgtgaaccgttggatgtgatttcatcggcccagatggagacggataagctgtacaaatggcagggcacgttaccactggcccagaaaaatacggccggtctggtttagtaggccgaggaaaagattggcccattatgattggcagcgatccatatcaccaattcattcttgtcattctggcccaacttgctctttggcgcatgtaattatcagactattcaaatttgttgttttttttatattattaatacatttaaaaaagactattcaaatatatagtattaggttatgtcccattgaatatttggttgctatatttttgaacggagagattagcctttacgctattgccaaaatttgaatttttaaaaaaataagtttgatgtttttctcatcgtaatttattttacaatttaggttttaaaacactaaaaacatattgtcagggttacgggttaggtataccctttgcccttcgatatacgttacatattgatatggcatacccacgcgcatacggatatttcctgtatattctaaggaaacctttcacggaatctatagatgggaagaatcctactcgggcagaactgggtcgttggcgtatcgtatagggtctgatacctccgagttctatgaggagacctccacatctgcgatataaaaggggccccccgagagggggtttagacatcgaatctcaaagccaacacaacctccacagcctacgaagccggagcttacgaggagccaactcatcgagagctagtcgaatcaactcgactacaatctcgccggatccgacaagttcccttgttctctttgtaacctgtgttttctaccatataatcccacatcaactggattagggctattacctatcaaggggcctgaactagtataattcttatcttttgtttgcttgatgtcgtactacgtagatccttgtaccaacgtaccctaataccttctatatccggtctacgggtatcacccgtcgacagtggcgcgccaggtagggggccttggtactcaaggttctactactatgtcatccagcttcgttgacaacaacgtcagcaccagcctcagccaagtactccctgcttcaacaatgctggtatggactcaagtcggcgaaatcatcttcccgatttacaccacgacgccgatctcaaccggtcctccaatgaccggagacgagaacgcagtggctacgaaccaaggcgattccatgtcgaaaaatcctcccgtcgagacggagaacggaatattgacgacatccaagctcaagaaggattctgatacggccaaaccttgtccttccgatatgaacacgagccgacaaagatgacttccgaagccacaaggtcttggtgtcctatccacaaaactaagaaacacaccctgcaagattgctgggttttcctcaacgtccgtgctgaaattcgtgcctgcaaagaacgtggaattcagcgtacttctctaactcgggatgtctattgtcctattcacaagacaaagaatcacgacctctcgagctgcaaagtctttctcggcgccatgaaagctcagtctcctaagtcatatatccccatcagggataacagcaaggaacaaggagcgactccaacttcagatcgattcgttggggtaatcgatatcgatcctcacgaaccatcggtcttacatctcctcgaggactatgggtcatcgacaacgagcgcgccgcgggaggtattggctatcgatgacgttggcacatcagcgcacgccaacacagaagcggggaatcaatcgactactccagcccagcacatcagggttgttcaagcgatactgagggaaactccctacgatcccgttctgaacgttgacctcgagcgttggacagaacgactacgggaatcggtgactaacctcagcaacgcgtttgaagaagccgctaccgcagcacaccaggagcagccaccaactagcaaggccaatggtgaagatccggaacggagggaatcacctcaacaagctacccctccacctcgcggcactggcgatcttccagatcaaatcaacggccaccgagaagcacgacgcacacgagacaacgtgaatcgctctcggcgtcatgtctcttcacggcgccatgacggcgccatgataacggaaatcgaggaaattgctcaaacgaggaccgggaccatgacaaccaccacgatcacaacgatcgagaacgacgggtgccagacaatactggtcatggccgccgccgtatcgacgacgacgatggagattggcgccgagacaacagtggaagacgacgacaggattcccgagatccaggccgtcatcctcgtaatcgtacgccggaaccaagtgacccatcgtcatcgtcatcatccgcgtcctcctcattgtcagacagacatccacgaaggacacacgaccgccggcaacccaccgcccccaacgctgggagtagggctttcggtcgttccctacgttatgtccgatggcctgagagattccgacccggagcaatagaaaagtatgatgggagcactgacccagaggagttccttcaagtctactccacagtactctatgctgccggagcagacaacaacgcgttagcgaactatttaccaactgcgttgaagggttctgcacgttcatggctgatgcatcttcctccctactcaatcccttcatgggcagacctgtggcaacaattcatcgccaatttccaagtaacatacaagcgccacgcgatcgaagacgacctacacgcgttgacacagaactcgggtgaatcattgagggaatatgttcgacgtttcaacgagtgcagaaacacaattcctgaaatcaccgatgcttctgtaattcgcgccttcaaatccggtgtcagagatcgctacactacccaggagttggcgacaagacgcatcacaaccactcggagattattcgagatcgttgagcgatgcgcccacgctgatgatgcgctaagacgcaagaacgataggctgaagaccgggggagagaagaaaccagccacggacacatctgagtcaagcaagaagaaaaatcgcaaaaacgggaaaaggaaagctcaagcggaagtcctcgcagcagaatacgcgaaccctcccaaacgcccagacccacaaagcagcgacacaaagaaatcatggtgccccatacacaagacggacagacattctctggaagattgccttgttttcaaaaagtcgctcgagaagcacatggcatttgaaaaaggcaagcgagtacgcgttgtcgagacgaacgaagagacggctcctcacgaatcggactcagcgtatctagactccgacctccacatctcacacatcttcggcggttccacaacgtactcctccaagcgagaatacaagaaagtggaacgtgaagtctgctcgacatggcagggggctgcacccaagatgaagtggtctgagtagaagatagagttctcggaagaagaccaccccaagaccgccgttatcccaggacgatatccgatcgtggtcgaacccactattcggaacatcaaggtagcgcgagttctcattgacggtggtagctcaatcaatcttcttttcgccagcactttggacgcgatgggaattccgcaaaacgagttgacaccaactgatcaacccttccatggaattactccccaatcatcgtccagacctttgggcaagattacgttgcccgtgactttcggtcaagccaacaacttccgaacaaaacagatcacctttgatgttgctgaattcgatacagcttacaacgccatcatcgggagaactgcacttgcgaagttcatggccgcatctcactacgcatatcaagtgcttaagatgccgagaccgaagggaacaatcactattcaggggaacgcaaagctggcggtgcaatgcgaaaagcaaagcctcgacatggtcgagcaaacgcccagcccacccgccacgactgagccacccaagaaagtgaccaagacaaacaagacgccgaaattagacagcgccatcaagattgttccactctccagtgccaaccccgacaagaccgtcaagatcggggcgacactaaacgagaaataggaactcgcgctcatcaccttcctccgcgacaatgccgacgtgttcgcttggcaactgtccgacatgccgggggtccccagggaggtgattgagcacaaactcatggtgcgacccgatgccaagccagtaaagcaaagattgcggagatttgcaccagaccggaaacaagccatacgagaagagctcgacaaacttctcaaagctggcttcatcagagaagtacttcatcccgagtggctagccaatccagtcatgttgcggaagtccaacggaaaatggagaatgtgcgtcgacttcaccgacctcaacaaggcgtgccccaaggatcactttccacttcctcgaatagaccaactggtggattcaacagccggttgcgagttattgagcttcctcgacgcttactctggctaccaccaaatcagcatggcaaaagaggacgaagagaagacagcattcatcacgccgttcagggtattttgctatgttaagatgccgttcggactgataacagctgggaatactttccagcgcacggtccagggcgcacttagcaaccagcttggcaacaatgtcgaggcttacgtcgacgacatcgttgtcaaaaccaagacaggcgactcattgattgacgatctgtgggaaacgttcgacaacctccgacgatatcgcctcatgctcaatcctgagaagtgcacgttcggagtaccgtcgggcaggctgctcggattccttgtctctggcagaggaatagaagcaaaccccgagaagatcaaggcaatcgagaacatgaagtcgcctacaagactcaaggaggtacaaaagctaaccggatgcatggcagcactaagcagattcgtcgctaggatgggagaacgaggacaacctttcttcgctctgttgaagaaacaagacaaatttgtatggacacaggaagccgaagaagcattcattgcactcaagcgctacctatcaaacccccccgtacttgttgctcccccaacctaatgaagaattattcctctatattgccgccacgccacactccgttagcactgtcattgttgtcgagagagagaaagtacagcgactagtttattacgtcagcgaagctctccacgacgcaaagacaagatacccacaaatccaaaagctgctttacgcagttatcatgacatcaaggaagctacgccactattttcaagcccacagagtcacagttgtctcctctttccctcttggtgaagttgtgagaaacaaagacgttgtcggccgcattgcgaaatgggtagtcgagctaagccagtttgatgtccactttgtgccacgaacagccatcaagtcctaggtactcgccgacttcgttgccgatcggactatgccagataacaaatcagacaaccaaggcgacaatgcaacatggacaatggcgttcgatggcgcactcaacagccaaggagcaggggtaggatttatcttgacgtctccctccggagatcaattcaagcacgcaatccacctcaacttcagggcgaccaataacactgcagaaggactactcgccggggtacgagctgcagctacacttggggccaagcgactaatcgtcaaaggggactccgaactagtcgcgaaccaggtacacaaagattataaatgctctaaccctgagttatccaagtatctcgcaaaagtcaggaagctagagaaaaagttcgatgggatcgaggtccgacacgtctaccgcaaggacaacgtcgagccagacgacctagcacgacgtgcgtccagacgagaatcgctcgagcctggcacttttctcgatatcctgacgaagtcatcggtgaaagaggttagcggtgaagtcagcccgaacacccccgacattagctcggaggtcaccgaggcagaacgcgccgttgccgacatctaaaccacagacgactggcgcatcccactaatcaaattcatcagcagcgaggagttgcccgaggacgacacagtggccgagaaaataacccgtaaagcaaagatctactgtatggtcggcaatgatttatacaagaaagcgccaaacagggtacttctcaaatgcgtctcgaccgacgacggcagacacctcctcctcgacatacatgaaggcatatgtgggtcacacgccgccggtcggacattggtcggcaaagcttttcgacaaggctttttctggccaaccgcccttaaaaatgcatgcgacatggtccagcgatgtgaagcctgtcaattccacagtaaacacacaaagctacccgcgcaagcactccagactatccctctgacttggccattctcgtgctgggggctagatatacttgggccattcccacgaggacagggcggctacagattcctattcgtggcgatcgacaaattcaccaaatggatcgaagcagtactcacgggggaaatcaaggccgacaacgccatcaaattcatcaaagggatattttgcagatacggactaccacaccgcatcataactgataacggctctcagttcatcagcgccgatttccaggactactgcatcgggctgggggtcaaaatatgcttcgcctcggtctctcaccctcaaagcaacggacaagttgagagggcaaacggcatagtactacaagcgatgaaaacccgcgtctacgacaggatcatgtcacacgacaaaaggtgggttgaagaactcccgtcagtactatgggccgtacgcaccacaccgacaacgtctaataaggaaacatccttcttcctcgtgtacggctctgaggccatgctcccaggcgagctacaacatcagagtacacgagtacagaagcactccgacgagaaccaggaggagcagcgagatatcgctgtaaatcttctcgagaagcatcgggaacgagttgccgtccgagcagccagctatcaacagaccctccgccgttatcacgagaagcgcatccgtgcacgcatactttcgatcggcgactatgtcctccgacgagttcaaagccaagcagggcaaaacaaactctcacctaaatgggaaggaccttacacgatcacacaagtcttgcggccaggcgcattcaaaatcgcagacggcgacggtcgcgaattagcaaattcttggaacattgaccaactacgtaaattctttgtatgagtcaatatcattcatacctgtaagcacccttacagtatcaataaaggctatttctaggcccatatcacaatcaacgtgtttcgcccgatgatccctcactctgatgacacctagcgttgaaacatgtccttatgtccctttacgccgtctcgacaaggcctccgaggaacctaagggatcttcggctggggacgcccagagccgataaggccttgtcagatcctgtagagacgaaagaccatgtaagatctggtcgtgtaagagttctcaccgtgcgtattaaccacgccgtgaaatcggaaatcaactttccaacttcacggctgggggctaggatcagagcttattcaaccaaggcaggtcaaaggtccaagagccttatcctccgagaaaactcctccgacgacaaggctaggggctagggagagtgtacgaatcaaacggctgactaaagtcgttaaccgagaacgcactcttacacatgacatccagagtaagagacatttgtcaaagatagatttctttattcacaaaatactccttacagttttttcacaaatctttcgctacattacatcttttcctaagatatttgtcacagggtacgagtactaccaagaaggccaacgccagtccatagactggaagatcttctcggccaacggtgacattgaccttgccagatggtctatctccgccggagtcctccgagaacgagcaaaaccctcacgaagatgttcgaggtccaggtgcgggcgatgatctcgtaagcaagccaacacgtgccccccggcatatcggctcgatcaacgacactcctgtttcaaggcctcgtcgatacgcttgccgattccattgagttgggcacaggccccattaagccacgagatgtacccggctgccgactcctcgggatctccgcggactactcgaagctccctgcatactctggccatggatgtgtagcaactcttcaagtacaagttaaaccatacctcacggcctcggagcgtttccacaacctgctctttcttcacggccagcatggttctctcgagctccgccacttcaaacttcgtcttccagtattggatacgacgatcttggctagcaagggcaccctcgagatctgctaaacgtgataaccactaagtcaagctatacatctctttcgggaacatggctgacctagtcaggtgggcattaaggggtgaagggactactaacctgaggaagtcgttgccatccttccctctatatcaaggggttgatccacatggtcaggcgagacgtgtggttcaaactcgagtaccggaattactgccagtgactcgggctgcccgcgctgctggatatcctcgtcatcaatatctctacagaggacaaaagttcccgaggacagcataccaaagtaagccgggatagtaatcgcacgcacaaaggcggtcagagttcgagttttacacattatctaggaaatacaagaagtcctactcttcaaaaagagggagaacggactcccccagatcaccgacttcttccatcacctccttatgcgtgtcgctagccgctccctggtccaagatctcgcgcagatcgagttcaggacgcgacagccttacacacgcgaggacatgacacgccccggtgtagattccgtttgacgtctcctccgcaatcctggccgcatgcttggagggatttcccccatcgccgtcgccagttccgcgagagaggaggtcagcgaaaactcatcgggattcgccgggatcgtggacgtgacgccgcattccccggtgagctggtgaagcctagtgtaggtgaccctcaacgagccccggatctcagataggttgttcccgagttccgacattcagtcctcgagccccttccattgtcgctcgttgccggccgccaactccctcatcttcgtgaggtcttcacgggcttcagccaactcgcgcaccagtctgtcagcacgcgcgttcgccgtcgccgcttccgacctcgcctccgcaatctcgcggccgatgccgcgagcaccggcttcgaggaggcgccccatctcgacttggagctcctcctaggtgaggactgcagctggcaggtcacgacctgccgcggggcactgactgggccactaggtgtcacctcccggctcccggctacgggcacgacatccgtcgaggccacgacgggcgacgcactagaagctccttcggacttggctcgcgcagcctttgcccgcgcctccctacaggacgactacgagtcagacaacaatcgaataagaggcgcggggattcaagaattcatctacttacttctcgccgattgtcacaatgcgttgtcgtcatggaggtgggggagacgcgtccgaggcctagaagacaatcaacgcaaagtaaggaaaaatccttcttgctgcacgatttaacgataaaataaattaccgagggggtcgacgccttgcgacgttgtccgattacagacgagagtttcctcggctttgtcagaacattgccaccgctagtggtggcagcatcagacgcctccttgacgaccttcactttcagagatgacgccacctgatggtccgcgagcggtccgatgatatcagtcaaaggaagggcctacgctcaatcaagtcataaagtgatttcgaaaggagaatgcgggatgttcatcgaatatacttacgttgatggcttcatcacgttccgccgcccccttttcacaaagggacatagggatgtcactcgccgtggtcgggccactgatcatcacttggccgacgcggcgctccacggtttccccgctcagacctgttaatcgagaaccaaccttcgataagtcaagaggaatgcgaacacaagtatgtcaagataaatgcgagaaagataccccgaggagaaacccgggtcacgtcctctggcccggaatagttataagctggatgggcccgagcctgaagcggttggatccgcctaccaacgaagtctgcaacgacttcatatcccgacaaaccccgtactcagagattgtcgatgatgtcgataaacgactgaagagagggggtcaaggggggctttgcggtccaagacggaatcttgttcggttgatcttcgggaaccacgaagtcagggttcgagtccttgatctcaagataaaaccacctattcctccacttgctgtgagaagaagggcactggaagggaatgtaacgcgacttcaggccatcccgaagtcggaacccgacgcaaccagataccctgttggattccatccaacgcagttcatagtaaaagcgaaaaagatcaaggaaaggctctaccccgatgtaggcctcacaaagatgcacaaagatgctaaggaaggcgatggaattggggttcaaatggagaagagagaggccatagaaattcaaaaccaggagaagaaatttggaaggtggagggagaaaaccgcagagaacataatcttcgatcgcaaccatgcgacccaatatgggctgaggattagtacctcctgcttccctctccatggttccatggccaggaagagcgccatcctcctggagtttcttcaacgttgcactagtggaagctgatttgccgaggtccattgccgatagaaggtcgccgaaaagcgagcctaggttgatgaactagggtttcttgcggcggcagagaaggcaaagagtgcttggaggtggtgtgtgtttaacaggtttggcggacttcaagatggactcccaaaattcctttaaataggcgcactaccgacggtgcgaattccagggaacagagagagatgtccgccggaaatttctggtcccgttacgcgcggcggttttttggacttcagtttaaaattcgctcgtgaccgttgagcttcaaatggtgtgctcgactacggtctatctccgcggttctcgcaccgggaatgacaacagtctcgacacccgaagtcgcaaatggttgcacgagttcattttaagcagaagtcgggggctactgtcagggttacgggttaggcataccctttgcccttcgatatacgttacatatcgatatggcatacccacgcgcatgcggatatttcctgtatattctaaggaaacctttcacggaatctatagatgggaagaatcctactcgggtagaactgggtcgttggcgtatcgtatagggtctgatacctccgagttctatgaggagacctccacatctgtgatataaaaggggcccccggggggggtttagacatcgaatcttagagccaacacaacctccacagcctatgaagccggagcttacgaggagccaagtcatcgagagctagtcgaatcaactcgactacaatctcgccggatccgacaagttcccttgttctctttgtaacctgtgttttctaccatataatcccacatcaactggattagagctattacctatcaaagggcctgaaccagtataattcttgtcttttgtttgcttgatgtcgtactacgtatccttgtaccaacgtaccccaataccctctatatccggtctacgggtatcacccgtcgacacatataacatataaaaggttctccataaattacatgtaaaacaacttatcagctataggccaaaacgatagaagattaaatactactccctccgtttcgaaatgtttgacaccgttgactttttagcatatagttaaccgttcgttttattatatttaacaatgaataaaatgataggaaaagaattaataattacttaaattttttgaataagacgaatggtcaaataagtacttaaaaagtcaacgatgtcaaacattttgaaacggatggagtaaaactactccacattaagtaacaaaatttattgatagtaaaaggtaaaattatatcggtcaacaacgacagctatttgaagtcggaggaagcatcaaatcgtccttcgccgcggcggcggcggaggcgtcagtagccgagacggcggcggaaggtgtaccaccccttcttgcacggcgcgccgatgaccctcatgccgcgcttgcacggcttggtgaccaccttcgccaccatcctcctcacgaccgacctgcgtttcttcgccggcagcacgggcaatgcctgctgctgctgctgcgctccggctccgccgccgctcttcctcggcggcgccgccgtacatggcggcgatgaagacgacgccgacggcgagcgcatgaagacgacgcctctctctatcgtctcgccggcgatcgagcagggagatgatggaaacgacgagtcctgtagagaatggctggcaacgcgcggctgctgcggcgacttgtcgaataatttgcgcgcactcgccgttggtttggtttatgtttaggctgcatcgatttgggcggtggttggcacggttagtcttgctaatcctttttttgagtttttgtttttatttattttcgaaagaatgaaaaataatggattaatgcgacagggtacaatgttaaaaaaaaaacgatcagctggaagaaggaaattgttgtcgaaagctggaagaaggttctccagtaatgacgcttcaattaccattggttgatccatgtacaaagtccaatacactcaggactcctttggaacgaattttacaggatttagttgaaatcctctaaaattctccaaaattcctccgattcgaactcccttcctaaagttaaattacatctatctcacaaatagctctgctatgtatgtgtgtgtatgtgtgtgctttgcttcagttacgcgcgtcgctcaggcgtgtcggcgtgccggcgccggtgccggggcaggagcctccgggcgtccgcgtcagcgaggcgaacccgggcatcgacatcgacctcgtcatgccgccgccgcggggcgacggcgacgacggcgccgacagcgacgaggcctgccgctgcagcatcgggtgcgagctgccctgcgtcgacacgctgtgcaacggcgggagcccgacgacgccggggtggcacggcgtgccgggcctagcgctgccaccgccgctgcggagcggctgcagctggatcttcaggtacggccgcgacggcgtggtctcgacgaactggccgtgctcgtcgtcgccgtcgtcgtcgtcgagggagcagacggtgctggtctccgtgcggatggtggagtcgtcgccgccgcggtgcttcttcctcctcctcctcgcgtctttcccccacccatgcatcgtctctctgatccttcgcgggatcagggcagccttgtactttgaccccatctgttgtcgtaccagcacagtgagattagttcaatcttttttttttggggttcaaaattaaatactagaccttccattttcagaatatatgataccgttaaattttg

SEQ ID NO: 68410 - DNA, 1304 bp, Oryza sativa
aactgagaagctgcttaccccaatatgaggcggcaatatactatcaggtggttcttgatgaagcatgaatcataaccaaattgccactgcagcataatgatacaaccctgttaatattttaccactttacaaatgaatgctagctcacagcgtcttatcatgccgtacgaatttcccagaaaatgttgctgttaacaaaggttgagacagaagtagttacccagaaccagaagaaagaagccaattcaaatgagttctgcagcaattagcaaaccaaagagtgtataagttcaggcttgcccttaatccttttcaaaagttaactagcaatgcaaatgtacctgaaagagaatgaaatggatcagccacaggagaaattctggtttcttgaaccaaaagagatcatcccgtggctttatccttggtccgtatgcattcatctttgcaccctctgctgttaaagttgctatgacgtatgcagctttgcgccaactagaagaacaagctgcaggacattcagattatggtcaataccacatcatacatgttacggattgtgcacgaagcaagctgcaacttacagtaacaggaagaatggctatccaaaagtacaagttcgatcctacaagaaaataaccatgtataatgctggataatgagacagaaatatgatagtagtgacgatattaaaagagtggttggaactttaccgttgatattgaataacatgaaagcaacaacaaaaccccacagcagcccactgcataaaaggattaaatgagtaagttttctgattatatatctccaatgagaaaaataaaatggaagtaacatccataaataagcagcgcatagacaaaattataagggtgtactattaaaccaacctcactccaacaatcttctcaaactcctcttccattgagcgtaccatgtaatcatggaaatcatatgttggtgcaagattgtgggtctgcaatcattcttaagtcaaacaagagagtacaactaacaaatttcagcacacgccaaaccagcatatggcgacagaattttgagaacaagaatattcaagaacaatgaaaacaatatatatctactctgttcaaaacagaaaaaaaatatgtatatccactcaacatggccatagaaaaacaactgcttaccattatgaaacccttgcggaggataaggtaatctgctcgaacaacagattgaccaaattgtgcgagaaagcaaaactgtatggtaacacaataaaaaaaatgttagctgtgaacacagcaaagccttatgcctcacat

SEQ ID NO: 68411 - DNA, 1282 bp, Oryza sativa
caattagctcaaaatatgagaaaagtatgtggctttcagtaaaagtagctcagtagttactaaaacttacccatcaaccaaatacttttgcatgttgccctggaacttctggttcatcttgtagctcacctcctttcttctgtagaaaaacatagtctactatgtagtaaaattaaagtaattcataaactgagtaagctataagattcatattagctatgcctctgcacatgcaagaaacagaacatgtgacaaagtacacatgaaattgatgttccagcagtataattagctaaaaataatcgactaccccaactagagctgaataaaacttgttcacgtccaagggtataatcatcatgatggtttcttctcatgccaacattgattcataattcttaatgctgttgcatatttcaccttaagagtttgcactttgcagaccaaatgtggcatgccaaatatattgctgtttcctttttacaataaataaaagcattactagttgcatagcatccttagggccaaacagttacaccaaaatttcagtaagttgacatatatgataacatatcaggccccccggcatgccaaagacagcgctggcaaaccactaaggcaaaattagcaccagaaatctgacattctggattgaaattatacagttggttcatcgacttctgatctatagaggaagttgcaagtctgcggcgcacttgaagcacccagcgctggtggagatggatgaggccttaccgatcgcgcacctcgacaaataccctcagttggagcagcctatcgatggcgaccctgtgcttggcggcgtactcgtcgagcacccactcctccatggccgcagcggccaccggcgccgacacgtacagcatctgcagcgcgtacttcttcgcgagcggcgggagcgacctgcacaacgaagtggcgaaaacactcgcgatgaaatacagcacggaaacgcatcgccgcagccaagggcaaggccggcgcggagtgggcacctgagcacggcctcgcagatgaaggcggagtcgtagagcatgtcgagcttggcggccggcagcgcggccaccatgtccatgaagttccgcgcgaccaccattacctgcggcatcttcgccggggggtggggggttagctcccagcgccgatccggtgcgccgccgtgccacacacgtagagggagcaagagcgaggaggggataggatgggaatatccggcgaccaggcgagagcgtcggcgggagccctaccggggagatagcgg

SEQ ID NO: 68412 - DNA, 3922 bp, Oryza sativa
  unsure (1)..(3922): unsure at all n locations
tccctcggaggttttgctaacgtgtcgcatacgtagcagcaaggactcggtcttctttccatgtagcgttgatgtggcgctcaagtggcactagaaataaaaaaaaaagtgtggggcccatttgtcattcaaaaaatatatagtgtgggacccactgccatgtggggcccacatgccatcctctctcttcttcttcctccgctcttcctcccttctctctttctttccctttctcttctctccccttcggccggccgcggggagcacgggctggagcggcggcgagcggcggcggcggcggcggcggtggaagctgacgcggcggcggcaagattggaagttcgggactcgctgctctgtgggctgtatgcctcgctgctctgcctcctccaccgcggcgctcccggcgccggcgggtccagatccttcgagacggtggactcgctcaacatcttcagggccaaggactacgacgccaccatcgagttatactgggcgcccatgctcgccgagtccaactctgacggtgccgctgtcctcgacgaccgcctcatccgcagtgcccccatgaacaagcactccaccttctggaagggcgccgacgtcctcgtcttcaactcccaccgctagtggatgaccgacgacaagatccagatcctataagctgctagctagcaaacacatagtcatacatggcgtgaacgattgatggattcgtttgtgagattgtttgtgtgtgatttgtctggatcgatggattcatctggcggcggcgactgctacaaccagacgttgccggtgggcgcggccaacgcggcgtcgtaccgcgggagcacgagccgagggatgctgcaggtccccggcgctgccgctttagcttcttggggaagaaggggagagaaagagagagaagggagagagggaggaggaagaaggaagaggactaacatgtgggccccacatgtcagttggcccacatttctttttctgtgaatgattaatgggttccacacatatttttaattctaatgccacctaagtgtcacgtggaacgaagactcggtcaatatcgtcacgtaggcgccacgtcagcaaaaccgccctccaaaaccgccgagggagttaaattgcaccagttttaggagtttgggggtcgaaatatccggttttgtggtttagggttatggattagatttcgatcacagttgagggtcacgaagtgaacttattcccttttatgttagattgggctacaggcctcttgaatgaaaggattgggctacccaaccctagcccattttggcccattggcaagtttgtgtttcaaagttgtccatgcatggataattatttatattttttttcttgttttttttcgtttagacgaaagactcatgcataactacacagcacgctcacgctcccatgaatgtgcttttattttaaaactacccatgaacgtgcttaacatactcctaactacaatttcctatcctaactaaaatctgatgaaaagaacccccgaacgtgtataatatttgctcgtttttttcaatttcagtaccgtactcgtactttccaggatcaatccgtcaattagccgtccaattttttttccatgtgaaagaaataaaatgtactagaaaaatgaaatcatttcacaggtatactggcaccaacatgacaatttacaagtctagagtctggacatcaccaatgttgacgtacacgtacgtgtcaaatcgctttccgtgttaaaatcttcctcgccacacaaaaccaaaggtgcgcgttacatgactttcgccgagcactcgtctgctgcgacgtcaaactccaaatttatacatcaatacatgtggttttgaatttttgctaaaaggaaattcatgtgtggtttaagtagacaagtagtagttggaattttgaaatggtgttcctgtactacttcctactaccaagtactacgaaccaatgaaaaaaaaatccggcggacaagttgaagctggaaatggtcagatcaaaagtcaatacgaaaatgaaactgatacttgccgactgtcacgcaattaataccgataccaagcactacccctgtttaaagaattaatagtaagattatactaagaaactagggttggcagccagattttagcatataggagtagttcgatctttgggttttacaaatacatctttctcaaatcctagactgtcatcagaagcttgttgttgacgaatatcgtctaccaccgaaaaaataattagccacaaatacaagtaataatgtcaagtttagaatttaaactcaggtgagctagttctatcacaggataatcattttagttacgcctattttgctttgtaattttttttagacatgctaccacaaggagtaatatagaatttgttttttttttcttttttctactttggaaaggatggtttttacacgaaattttacatgaactgactatttcctaataaaatcaaataaaaaaacctacgatccaatagtcacaaaactccaaacctaattcattttccatgtgactggggagatcagtcggttgatgaacgataatgtttttctttttctcaacacaatttcataaatcatcgtagcgttacacacaagctagcgcgtaatgaacattattaacccaggtgcaaaatcacaaatcacattcacccaggtgcatatgctaactacaggtgccaggattaaaacctactccgtactcattgtccgcatggccgtgactccacaccacacaagtactacttccctaatttacgcgctaacttttcttaatcaaacactctacacacgacttatttgattaccacgtaacagtagctagtaatttctcccccaacttgttctccggtctccacatctcataggatttatagcacatcattacgtatatcatcataacaaaacatatcactccccatcaaacattatgacgtagtactatgtaataattagctcccttcatttttaataattaagatatgccttttaaattgttaaatagtacatttctatgtgaaaactttctatataagaatttcctctaaaatatatcaaataaatataatttgaagtatgtaattattgaaacgcaattgatcatacgctaatgctttctcattatgggtgtacttacttagtcctcttgttcgtcttgcgaagagccgagagatttgtcattttgctatgtctaggtgtttcatattataagttgtttattttttttctctagccaaacttctttaaatttaattaagtttataaatgaatatagtagcattttttaacataaaacagacatccaatgctggattttattaaactaatttgttatttttgatattactaaatttttctataaatttagttaatcatcttaaccaagtttgactaagaaaaaaaactacaagtacacttcttttcaaggtacagcagcgtcacggcaaacccgtatttccacaagtatatacggtagtacaaaatacaatagagtagaagcaacaatcatttaatctttcacggaaaaacaataataagtaatatataaaataaaaacaaaataaatgaagcaggcagcaattaactcatgtcacatccgtgccgaaacaatccaacccaaaattcccacatccatttctccagcgaccatccatccatcgcctcctctttccctcccacctccacacgtcccctcctcttccccaatattccacgccaccgccgccggtcaacccctccgccatnncatgcagcagcagcagcggtttctcccattcccattctttgctcccacgcgaggctgcgcggagaacagccgcacaggtggggtgggggtgcagaccgagctgaggagtagccggagttggtggtgagagacgcggg

SEQ ID NO: 68413 - DNA, 2037 bp, Oryza sativa
tgtaaccctgtgctaactgctaactgtcccatatgctttgcttccgcgaaacttcgagacgaattcgtcgaagcaaaatgcatatactccatactgtttcattggagaaaatggttttctctatacagtttatctgaggattccgtgcaagaacagggaggtttggaaattgcgtgttagccgaacccacccccaccacccaaaggaaaaagcaagcacctctctttttctcctgtggaagttaaagtttaccctttttctgatgggtgatggacaatactcggctcagcataccactattgctccaaatttgggtacagtgatgcggaagaaaagtagtggatgttagaatttagagaatttcggtggttgaggtgatcaccatgaagtagtattgtttttggaatcataccccaaaaatttaggtggcggctgcaatgtagctagggccatattggagcatgacgcaatggcttaatgcaatggatggcccaaccaaaagggacatgcgacagttgattggatctggttgggcgatagcacttgcgaaggagataaacgaataatttttgggttggacaatcgctttcctagacttggtgcctgcttggctgagcttcagattagattttaaactttaggactaattttagtggttttcttcgccactttcttgtctggctctagtttcatagtaattgctaaaatggaaagctgaaaaacctatctaaaactagtctttagaaatcaagctttaaaattcgaaattgttttaagttataatctgatgcagaaacaagcaggaccgatgacgattatacctctccgcacctttttttttacaataatgcccctccacatttctattactgctaactaagatggtagtataaatagatctaaacccttcgatcaaatgagattaacggttcagattgctttctaatgccaatggagagcaccatagtggggctccaattaatttgggctgttattcatacctttcttgccgttaggatgtcaaaggtgctattctgtatactagatgcatactttaccatataaacatctagacatttacattccttgtaagtttgtgatatgaactagtaattcttttactaaaactttcactcaccgtgcaggtttatctacacttttattggcctgggagtctttatgtgcttgttgacttgctctggtcatattgcagctgaaactgcaaacagccactgtctctcttgtgtatccttcaagcagcttggtttatggagttgttttggtgcctaactttacacttttatgtttttagttaataaagtgaagttacctgcgtgttcgttgaccggatatgttctatagtacagaactatgtttttttactggtttatataattgaaatgccacaaaaaaaaatttcggttgagcagatctttctttttaacatgagcagatcatttctgaaatgacagtgcaaacttctattcccttttatttgcgggccaactcttgatccatttaagcctccaaccttacatgtaactcaacctggtgatgcaaggactattttgccttaacctgacattcagtacatgatttttgtgtttattattattatattggaaggagcaatcaccactgacgtatttctgaatagcaactgggaggaggtaaggatcatttccttctgttgttttttcccctctctctctctctctctctctctctctctctctctctctctcaatacaacattatggtttttaactgcttcaccaacattacggtatgcatgtatgtattcctttgtaatggcatgtattttcttctattcgatcggtgattgtttggtattttccaacccttcaggatttccctgatgacccatctggaaagtttgaagaattcaaggattttataagatcaaattttgagatttgtgaatggataggcctctcggttgtcgctgcccaggtgatattttctgctcctttgctgaactaggacccaattcattttttttccttctataacttg

SEQ ID NO: 68414 - DNA, 5961 bp, Oryza sativa
  unsure (1)..(5961): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgaagaaagacaacaatgttgacattggatcaggaattcgaaagatactgaaatgtgatgatgaaatgcaacagtttaggaacctttgtgattatatgccctttatacttgtgttgtaggccatcgattgtgttcatagagttagattggacctctgtatcctcagctagtttctcttgcttgaagagttattgccgttgttggacgatcaatctatattgcagtgttacacaaggtaactgatgaactgatattactatgctgtcgctcaagctgtattcaagccagacaattttgtcttctttttgagctttatggacttgattgctaactactcaattgtagattgagaatttgagttttgatcaagaagagcggtaccattttactcctgaaagatataagctactcctccgtagcattttttttcctgtgaaactaatgcctttgcaaacgagacctacctttttgtgccggcaggagtacacaatctcgggccctgtgatttagatgactgattggatttttgtcacagattatctacttacttaattatagagataaattaagacttctataacaagtggtctaagcaatgcatagaagatttttttttttgaagtgtgaagtaaataatctgtttcaataatccggtgagtaatacgtaatatcaaaagaacagaggccggcgtgcaaggttgttcagaaccatctgttcatccatgaagtgcaagtactgcccagcccaatgccccaagagcccacagtacccttgtcagaaatcacgagtagtacaagggcttgaacacaaaatgacccatttgaaaattcgacctcctccgctttggcgttgaacagcaaatcgcgtgtcaaaactcaaaagcggacagaattagaaacttataaaatctctctcgctgcctccacttcttcttcctcctcctcctcctcagatccagcaatccgcgataccaccattagtaccattcgaagcgccgccctctactcgccggagaggaggaagacggagcaaagggagcgcatcagataagcagaaggcatggggctccccggcgccgagccgccggcggccagcggcggcggcctccctggattcttcggcggcaagagcaagtacgtccgcatggacgacgtgctgccgcaggagcaggaggaggacggcgtcggcggcggaggcggaggcgtccgcgtccgccggagccacagcagcaggcgctacgtcttcgcctgctctgtcttcgcctccctcaactccgtcctcctcggctacggtaactaatctcctccgtttccacatgaatctctctcgcacgtatatgtgttcgtgttggctgaatcgatggagaatttcgatacgcgtgcttggatcttggcaagttcttggtgatcctgcacaaggagtaggaaatgttttggccaatcgcgttgactatttcttcttcattagtcttcggtctttgatggcgactctccagcttattccatgtctgttaccttgtggcgtttagtaggagttgttgagtagtctaaactacggttactagttaactggttagtaattagcaatgcagtttcttcataatcaagaatcagtagtaactagtatcacaatgttttgttcagatggatttctattcactactgatatcgaatagtccacttatttggaatcatcgcgatgctaatttcagtcaacggcagctagctcgtagtagctttttttttttcgacagcattttagcaacacactaaaaatttgactagaactaactttttcttttaagataatggaattgatttcattaagatgaaattgcacccgggcaaaaattaagtttaagataattacacacaaaatgcatatataattcaatttctgtgtggtaataaaccttttgttcccagatgttggtgtgatgagcggctgcattctcttcatccagagagacctccacatcaatgaagtgcagcaagaagtgctcgtcgggtgcctcagcttcatctccctcctcggcagcctcgccggcggaaggacgtcggacgccgtcggccggaaatggacgatcggcctcgccgccatcgtgttccaggccggcgcggccgtcatgacgctcgccccgtcgttcgaggtgctcatggtcgggaggctgctggccggcgtcggcatcgggttcggcgtcatgatcgcgccggtgtacatcgccgagatctccccggcggcgtcgcggggctccttcacctccttcccggagatcttcatcaacctcggcatcctcctcgggtacatctccaactacgccttctccggcctcccggaccacgtcagctggcgcgtcatgctcgccgtcggcatcctcccgtcggtgtccatcgcctttgcactgctggtgatcccagagtcgccgcggtggctggtcatgaagaacagggccgacgaggcgcgcgaggtgcttctcaaggtcaccgacagcgaggacgaggcgaaggagaggcttgccgagatcgaggccgccgccgccgtcgcgagcgccggcaagtacggcgacaagacggtgtggcaggagctgacgaggccgtctccggtgatccggcggatgctcatcaccgggctaggcatccagtgcttccagcagatcaccggcatcgacgcgctcgtctactacagcccgacgatattccgggacgccgggatcaccaccgagagccagctcctcgtcgccaccgtcgccgtcgggttcttcaagacggcgttcatcgcgcttgccatcgtgctcatcgaccgcgtcgggaggaagccgctgctgtacgtcagcacggtcggcatgacggcctgcctcgtcgtgctcgcggcgacgctcgccgcgctcgcgcacgggtcggcgtccaggagcgctggcatcgccgtcgccatcctgaccgtgtgcggcgacgtcgcgttcttctccgtcgggatagggcccatctgctgggtgatgagctcggagatcttcccgctccggctgcggtctcaggcggcggcgctcggcgcggtgatgaacagggtgaccagcggcgccgtggccatgtccttcctgtccgtctgccgcgccatctcggttgccggcgccttctccgtcttcgccgtcatatccgccctgtccgtcgtgttcgtctaccggtacgtgccggagacgagcggcaagacgctggaagagatcgagctgctcttcggcggcggcggcggcgacggcgaggcggcgcggggagaggtggagctcggtgacggcgagcacctggtgcacaagggatgaggatcttgagttattgaccaaatggatcaatgtgaacttggccatttttttaggtgggttttaacagtattactagatactggtgttgcggtgaatgcaaattgcaaaccaaattgttttgttttagagcactaataggaaagaaaatatctcatactcttttccaacttcagaatcctctgtagcatcaacgaatcatacagtgtaaatgttggtgccactgtgccagtcaatcagtcacagttggtaatgctagtaagctacacttgcacatccatgaaaccattacagtgaatgtaaatagattctgaactgaattattcaaattcattgaaaaagagcgaatttccagtgagttatatgatattttagcaaatagaagaaattttatgccaaatggaagtttgacatctaaccacatggtataagagcaattatctcgagtgaatattcagaacaaggtgatacctcaagtttaatactctgcaattcagcaattgtgcaagttcatgccaaaatgactgaccacagctccaaaatttcactctaagccttactactgaatacacaataacacaaccatgaaaatgtgggcagattcctgatacaaattttgacaatttgactttttgcaaaaactatttttacaaatgaaccgctgccaaaacttatttcaaatctgacccttttgctcaatgccaaatcatgtggcgctgaacttagacatctcagcgccacgttagctggcgctgaatgcggtgccacgacggatgggagactaagtcagcgtgccaacgtacattcagcgtcatgctatttggcgctgaggtgtctaaattcaacgctacacaatttggcgttgagcaaaagagtcagatttgaaataagttttggcaacgattcatttgtaaaaatagtttttgcaaagagtcaaattgtcaaaatttgtggattcctgactccaactcttttaagctgaacaggtagtcatcaggttaccaaacatataaaaacgcctcattagtcttaaacaaatggttccctccttgtttcttcctcctcctacagtctcctccttcctccagatccaattgctagtccttttcccattcacaagccacattcttggagcttgcaagaggagagaagaggatgagccaaccatagccagagcacagcacaagaaagacggtgagaatggggcttcgtgccaccgaggcggcgacgggcaacggcggcggcatgaggagccttccggatttcttggggaggaagagcaagtacgtgcgcatggacgacgtgctcccggatgagcagggagatggcggcggcggcggcggcgtcgttcgtgtccgcggcggcggcggcagcgggagatacgtctttgcctgctctgtcttcgcctccctcaaccatgtcctgctcggctacggtgagcccctctcctgaatttgactgttcttgattcagatttggttgtattacacataatcaggggtttattttctgattaaagcaagatttgcagctagtaaaatatggggattgtatgtcatgttaatatgcttttagaagatgaagtgtttgaaaagttatcatcactgacagcccactctgcttcagattcagatgaaatgtaaattttgaccggtaatttggttcagatacttgttatggttgttaatctttatctgagtctctctctcagacagccattgacattgtttgtctcgtgaacaatcgatcaaactttcaaatggatgaaatatctttgcacaaattgtcaaatcctgtgttacatcgtggctgttaattttcagatgttggtgtgatgagtggctgcatcatattcatccagaaggacctccacatcagtgaagtgcagcaagaagtgctcgtcgggtgcctcagcttcatctccctcctcggcagcctcgccgccgggaggacgtccgacgccgtcggccggaaatggaccatcgggctcgccgctgccgtgttccaggccggcgcggccgtcatgacgctcgcgccgtccttcgccgtgctcatgatgggccggctgctggccggcatcggcatcgggatcgggatcatggtggcgccggtgtacatatcggagatcacgccggccacgctgcgggggtcgtacgcctcgttcccggagatcttcatcagcctcggcatcctcctcggctacgtctccaacctcgccttctccggtctccccgaccacatcaactggcgagtcatgctcgccgccggcatcgtcccttccatctccgtcgcgttcgtgctgctggtgatcccggagtcgccgcggtggctcgtcatgcagggccgggccgccgaggcgcgcgcggtgcttctcaaggtcaccgatggcgaggacgaggcgcaggagaggctcgccgagatcgaggaggcggcg

SEQ ID NO: 68415 - DNA, 1832 bp, Oryza sativa
  unsure (1)..(1832): unsure at all n locations
gacggtgttcatcgtgatcgccatcgtcctcgtcgaccgcgtcgggcggaagccgctgctgtacgtcagcacggccgggatcaccgcgtgcctggccgcgctcgccgcgtcgctctccctgctcgcgcacggcgcgctgccgcgggcggcggcgatcggggcggccatcctgacggtgtgcggcttcgtggcgttcttctcggtggggatcgggccgatcaacatggtgctgagctcggagatctacccgctgcggctgcgcgcgcaggcggtggcgctcggcttcgccgtgaacaggctgaccagcggcgcggtggccatgtcgttcctgtccatctgcggcgccgtgtccgtcgcgggtgccttcgccgcgttcgccgccatctcggcgctgtccgtggtgttcgtccacgtgttcgtgccggagatgagcggcaagtcctggagcagatcgagtccctgttcggcgccggcgccggcgccggcgaggtggagctcggtgacgcggaacatctggtacaagggaaagaaatgagctgataagtagcatgccaacgaagtagcatctcactcttatgagcttcttggtcatagttgtgattactgattactaagcagtaaacacgggatatcaacttgcaaactctgccatgactcttcaccacgcaccccgcggttcggcggttaccatggtaaccacgaaaacatgataaccacacggtttggtaaaacctgcttacgatacgtatgagtgtattgggcgtagataacagcaaggagaaaagctcgttctcttttcttagacgccaataaatgaaattacgaacggattacgcaaacgaagggagcagcctggcacaacagacagtacactacacagaggaagcagcatctgttccacttccacaccagaaaatgggcgtgcgctcgtttctttgcgtgcgaacattttccgacggcccaccagcaaaatttttcaaggtcgcaccacgaatcggattggggcattgggccatttttgcttgctgcacgagacgtttttctgccagttttattgagtttttctatagtgattttggataaatttaaaacacaaatagaaatctgactagtactacttagattttttttaacacaaactttaggcataaacaaagatagagttcgatatgatttcttagttaatgaacaccacttaaagaccatatttctacaaaagactcagattcttcctattgcatgttcgcatttgaatgcccccaatgtaatccagcacttcccgagtaccttatcatcctttccaacaacatacctaggtctgccccttcatctgcgcaagtcgaggaaaatcgattacgtcccactgcttgataaaattggatctaaaatcccgggttggaaggggagatattactcatcagttggaagggagactctcgttaagtcagtgttcacggcaatgccggtgcactatctcactgccctgccggccccaaagtgggtgatcaaaatgattgacaaaatgagaaggactttcctctggaagggagaggaaccggagaacgtcaaaccggggacgagtctagtaaactggcagaccgtgtgcatgccgagagatttgggaggactggggatccttgatttggaaagattttcattggctttgtgactgnnnnnnnnnnnnnnnnnnnnnnnngatcacaacaggccttggaatgagatggaactacctcgcaacgcaaaagatgtacaactattctaggcttgcactgaaattgttattggaaacgaaaagaaaatcctattctggaaagacaactggctacaaggaa

SEQ ID NO: 68416 - DNA, 3886 bp, Oryza sativa
aaacgacaagtattatcagctcggagggagtagtaaatttcaccttaattaaactatataacaataataaaattaaaatagccttcacccgttgtaacacacggacatcttttccagtaaaaagaaaaaaagggaaaaataattctccgtattgggcctaacgtatatgaggcccatgctctctagtagcacctaaaattaagcccaaaagggaccgatcagttctattacgaacggattagcgaccattaattaagagagcgcgtgacggattaagcgaagcgaaccacgcaaataatactacacacgcgcgtcacggacaccacccagtcccctccccacaccacgcgccgcccaaaacctccgccgcgtttcgcaccaccaccaccgccgccgaccatggcctccttcttcgccgacgacggcgccgacgagctcccccgcaccgcctcccaccccttcgacgccgacgacgacgccgcgcccgatgcatcaggaggcgccgccgccgacgacaccggatacggcggctacgcctccttcgtcgacggcggcgtagaggatgtggaggaggaggaggaggagatcgccgtggagtccgagggggtcccgatcggccacgtctccggagggttctcgccctcgcccttctcccccgacccggagctggacggcggcgacggccctatcctcccgccgccggcccagatgggggcggaggaggggatcctcctccgcgagtggcgcaggtgagcaccgcatctgatctgtccgggcctttgccgtttcggctactgcttgcttgctttcgctggtgctagggttccgacgcatcgagcgagatctaacgcttagatctgatatttcgcctaattttcagctaggtggggcggaatagagtttgtagtgaggctgtattatcgtattatatgtcgattttagttaggatgaaacttgaacttgttgtttaggaattgcagtgattgattaggctgaggcttcaactggttctgaattcttagctagtggtactgaatttagttagtgcaattgaatctggtttggcaggagctgttgttaaatgcctttgcttgtgaggaaagtttgttagctctggtactggtatatgtacaaaataatcgctagttagcttctactcatagaacaacaagatgcttgatcagtgttgcacacactccaaagggaattgatgtctttgcatgtgcattaaaaggctcatgtttcttgtttagtgaagttaaaacactttaagtacttgaaccattcttctctatcatcatggtgtggaaatgagcataaggccaatctcattttgcaattcacccatggtctgttacatgtttcaactttcaagataagcctcaggcttaagcaataatgcagtacacgtaacagttttctgagttaatgagcaaatgcttagtttatcttgagctatcttacatgtttcttggtgaatggtgatattaatcctaggtcttaccatgatgatggttcgcacccttactccttttgatgcttgtcttaggatgctttaattgatcttaaaatcagcttgatttgccagaacataaatcaccatttttagtgctatgccacatgggcatggaacgtgctcggcaaaggtgtgtgccaacaggagcaaactggctacttgtttgtgcttctgaaatttgcattttgtctgtcatgatcttatattctgcacttgcacgctcttctgcacctgtcaaatttttagtagtttcatgtatatccattctcagctcaaattttgtaaggtggtaatgttagcagttttactaccagtggtatgtgtttttgtgcctaatttatcctgtgcttggtataatctggtcattacaattgcaacagtatattttgcattagtatatagcgcaggtgagccacatctgatctgtttcggctatgccatttctgctattgtttgtttgcttccgtgggagctagggttccaccccttcaagcgagatccaacgcttagatctgctatcttccctaattttcagctagggagggcgtcatacagttgtagtgaaattgtcgttaaggaaatggcaagtgatcgattagtttgaaggtacaaccaattctgatctggttctcatgcccctgcagtatcgttcttcaagagctgctgtttaactgcctttgcttgtgaggaaagttttctagctctggtatacgtacaaaataatcattacttaacttttaccgatggaacaacaaggtgcttgattcattatgcgcacactccaaaggggggctgatgtctttccatgtgcaataaaaggcttatgttgatttgtttagtgaagaaaacctaagtacatgcaccgatttcttttttcagcctggcatggaaattagtgtgaggccagtgtcattttacaatacatgtatggtctattacatgtttcaactctcaagataagcctaaagcttaagcagcactgcagtaggctaacagttttgtgatttatgatcacaggcttgtaaggctagtttgtcttgagctacattatctgttttcttccagttggatatcttggtgaatcctaatatttatccagaacttactcctttggatatttatgtcctctaatgtatcagatgctttatgtgatcttaaaatgagtttgtagtgccagaacataagtcactgcttttagcgctatggttggccaaaggtgtatgccagcatgagcaagctgtctacttgtttgtgcttctgtaatgagcactttgtctggcatgatcttatattctgcacttgcacactcttctgcaccagcctatccagattttttgttagtttctcgtatatccattctcagctcaaaagtttgtaaggtggtaattagcaattttactaccagtggaatcgtgttatgcctaatttatcctgtgcttggtatgatctgaacattgtaatcacaatattatacatcttgctataatgtttttgctttggctgttctctagtaactgttttccttatcatgtagaattatattatgttcatgatctatcttttgaacagcatcactattgtttcaggcaaaatgctatagttcttgaggaaaaagagcggaaggagaaggagctacgggcccagatacttgctgaagccgaagagtttaagaaggctttctatgagaagaggatacagaactgtgagacaaacaaggtccataacagagaaagagagaaggtatggggctcagagcaacttctttagttattatatgtcaatgttcatagcatgtccattaagttctcatgagtgacaacttattgtgtgctgcagattttcgtagctggccaggagaaattccatgccgaagcagacaagcagtactggaagtcgatatcggagctcatcccacatgaaatagctaccattgagaagcggggaaagaaggacaaggacaagaagccatccatcacagtcattcagggccctaagcctggcaagccgacagacctctcacgaatgcgccagatcttagtgaagctgaagcacgctcctccaccgcacatgatgcaacctccaccagcgtctgctgctaaagacggcgcaaaggatggtgctaaagacggcacaccagccccagcaaatggaaccaagaagcctgcagagagcaaagagaaacctgccaacggatcgcctgcggaagcagagaaggagcagcctgcagcatcggagtaacttatggtagctctacaggaacgcccgaaccttgactgcagatatggaaatgcattttatttctaatccctggatctgtctatcctgtatttatctttttatggagatttgcgtcaggatggctatgtatca

SEQ ID NO: 68417 - DNA, 3388 bp, Oryza sativa
aacaacacgattcacaattggcacacatctaaacgtgtgccctctatgcactgtcactcaactcaacatgcaaaggtaagacaagaaacatagacccagcatcagcatcaatcagcctggtgatgttttccttccattttcaccttggctgatctcggacaccgtgggtggcaccaccgtgctgaacatgtcggaggtgtcggacgccgagtgcttgaacctcgagttgctggagttggtggccttggagaccgtgccattgtagtcgtggatgtagcccggcgccgtgagctcgcgctcgttgatgcggatgggcttggacagcatcgtcaccacctgcggcatcgacggccgccgcgccgccgccgcctgcgtgcagaagagggccgtcttgatgtaccggaggacctcctcttcagggtaatctcccatttctgaatccaccagctccttgagcttccctacctcatgtagctcccatgcctgttaattgtgaaagctaggctgagtttggcagcaagagttggtaactcatcccccacacgcacgtaaaacggagcgactcattagtacataattaactaactttttttttttcaaaatatggattaatatgttctttttaaaaacaacttctcttttgcaaaaaaaaaatagcgtttaacagtttaaaagacatgcgcgtggaaaacgatagagatgagttgggaaatatagctgcgtaattaacacggccttaattgatgcagaggctggaattatacttccattctctaataaaagatttagatggagagtccagcgattacggcttaattggaatgtctctagagcaaatgtctgaaggtgaaagcaaatctctgaattttggatagtaaagatgatagtaagactgaccttctctaggagaatcttatcgtcagccaggagactccttgaactactcttgccacttacgatctcaagtacaaggacgccaaaactgtatatatcggctctcttcgtcaattggccatgccatgcatattccggtgcaaggtagcctctgcattgaacaaatagatcagttcagttactgcaactgcaaggttactttctactcaaacaaactgctaaatgctgaaatactcacgtcgttccagcaacacgggtactgatgtgggtgatattatcagggaataacttggctaaaccgaagtccccgatcttggggttgtaaagcttgtcaagaagtatattgctagccttgatatctctgtgcacaatcggtgacgcaatctcttcatgcaggtatgcaagtcctttggcgattcctatgcatatagcagatcttatgctccaagtaaaatttgcaggttcgctattagaacctacagaacacaagataaaaggttaagcaacaaacgaaatcaatgcacttatatagaaaaatagtcattgtaacatatcaatattcatacccaacaatgcacggtcaaggctgctgttttctaaatactcgtataccaaaattcgattgtttccttcaacacaacagccaattaattcaacaaggttgggatgcttcacattggtaataacatcaatttctgtcaaaaattctcgaacgccctgcctggattcagcagaaagaactttcaccgcaacatctcgcccatttctaatagttccctgaaacatcaaagcattggtaagaatgcaaggactgatggcttcagatttgaaagggatataaccctcaatggactcctcccttccacatataaagaaaaacaaacattaccttgtatactgtcccaaagccacctcggccaattttattactgcggttgaagttttctgttgctgatctcaactcagaataagagaaaagccccttatgtttttctcaggcggaatacctgaaagttagttacatttagttaagtaaagcatggaatcttaaaatggagcttcagtactggcattctctagcctaatatgatcgaatctgtgatagggacaatatacatgtttctatttcataaactctgttggctgctatgcaaattcagcataaattttgcaagcaaatacagttcgtaccgctaacgccatgagagtaaggattctctcctttcttggattttggaatgcaacaccaccagctcatatcctcagttgttgtggctgtcttgtacacttcaacatgcagaagaggaatcttcaggaataattattctgcaggaattcattgcgaaacaaccacttagagagttgcaaattgagttcatttgtacattttatatattttggatatatagtacagaaaagggaaaataaaaagtaggacatgactctctttagacagaagtctgcgcaaaacttcttgttagaactgataggtagatgcagatccacccacattagcctgtactagagtaggtcaggaactggagtacaattaaatctcctttttgaaaccgagtacaattagatcttaaatccatcattcctcatgattaaagcacaaaagaacctcatactggcaagctttcaatgataactgattaatcggtgccatgattgtgaacttgcgattctcatgatgaaaagaaacatgacccaaaattttggggatgccaggtgcatttggaccacatagctccaatctcaggtgaatataccagatgttccactggatccaatggccatgtatggcacatgtaaatactaggttagcacctcatccactgaacagttcacatgatttgcaaagcaaacggccagatggcatagctgccaagaacaatcaccaaagcaagctgaagtttggtgatttcttctaacaccatggtccactcgcctcaatctgtatgcttgtacatatgcatattttcatgggagtatcagcatgtcttaaaccattatcatccacttcttttccccaatcaattcaaacacctcataagtaacggatcatccaacttgtttattcagaccacaattccaagaattcttttgttcgcatcccagcggatgattcgacggcatcacttattttcagaatctctgtccgaatgatgctttgccactcaagaaaaactcttgacagatcgtcatctgatgaacacaaactcccagagcatcaccacatcacaggtcaggactccagacgcatcatcagaaatcaggtggagaaactctaggctaaaactagtgtgcgagaaagcccaagaactaggaaatcaagaacacgaggggataaaaacaacaagaggcaagaaatgctcgagaaagcagcagaaaagtaccaaagaaaaacaaaacgttgaacactatggttacctttcttgcttggcgctctcttccgatgagatcgacggcagaggagatcgaagaggacgga

SEQ ID NO: 68418 - DNA, 2218 bp, Oryza sativa
cctgcagccccactacttactccgttataaaatataataataaattattttagttttcttgttcctgaaaatattctatctatctcctaaaatataatagtttcttcatcagtattctattttgtcaaccagttaaagccaacccttatgccttttaatttcgttcacctaattaattttctcaactaatcatattcttttttaagctttggtccttcttaattaattttctcaactatttttttcttttaatttgtctgttgttcacactactttttctaacctcaaattttttttatatttcggaagagagataattctgtggagcttgcctggatgttgccacctgccgccaggcgtggagctgtcacctgtcacaagaacactcaatagctagtatcctgctaattaccagcgcgcgacgcaatcgctgccgccatcagcacagataattagcattaagccctgcccgatcattctccctaattattgcgagaccaagattattttagagtataattaggtgctactactgctggtattgtatcccaaccaacctgccggtgccagccagggacattgctcgctgccctgagcctgtattggcgcctaacctgatgaatcatatccatcagggtcgtcgcgtacgccgaccgcagctcgatcgatcgcacgccggccacttccacactggggattgtctgtggaactagggacttgtttagttaccaaaatatttttcccaaaaatatcacatcgaatctttagacatatacatgaaacattatatatatatatatatatatatatatatatatatatatatatatatatatatatatatatatataaactaattgcacagttaatcgtaatacaatttttttagcctaattagtctataattaactataagtgctacaataactcacctgtgctaatgatagattaattaggcttaataaattagtctcgtggttttcagacgagttatgaaattagttttttattcgtgtccgtaaaccccttctgatactgataaaacgtttgatgtggcacccaaaatttttttttcgtgaactaaaacaccctagcttgatcatctggaccagcggctgccaacgaacgaggagtcagtagaaaaaacttggtgttttcatcgctcttgtcactacgtgtagcctacgtatgttaacagtacacgaaagaggagagatatttacgtgcttgagaaataattttctacggtcctgtcgtttcgctcacgcttatagttattcttattcgtattacttgttagcaatcaaaaaataatttaagtaattattttatgtgtgtacttgatgattcagaattaaatattgtaaaataaactacgatgaacaaatcatgaaatcagcttttaaaatttaaattttgtcttataggtttcactataagtgaaatgataaggttgtacgtatcaaagctagggcatgttgtttttaaggaattgaagaatggaatgcatgagttattagacggtgtagttttcacaaagaaattttctgaaaaaaatggattaatacctgacctctaaatccaaacagttgtacacatgaaaagaaagtaaactgctttaaatttatattttaactctatgtggtcacaaaatcattcatctaacccgaacaaaaatcaagccctaattagagttaattaacgcaagttaattaatactactacatgatttaactcctcgttttaagtgagctcctgtgttttcttgctgttggcttaggtggactggtgacgagtcaacgactgacatccgctgctatttcctgttttggttttggatgattgctgccttcttgtcaaccaattatgctctgttactgttgatgttcacacgtccatctggtgtgatctgatttgttttgaaggagtctacgccacgatcatccaattgccctattgttgttgttactgtataagactaatgtgactcgtcagaagcgaagagctccatatctctgacggcatcgtataaaaatagtattatgtgttctctcctgttgtgtttttgttgtgttgtgccaaactactacttttcagcgtgacctaatcctttcgtcacaggttgtcaccagccacgagcacgaaatgataatgcatgtcattgatccttctcataaatcaatcgtatcttaaagtctgaaattaacgttttttttat

SEQ ID NO: 68419 - DNA, 2237 bp, Oryza sativa
attcctgcagcccttctataaaaatcctgtaaaattcctatgttcaaaaataactcctaaacatatgaattgttggaaatttagaatgaaaatgctagaagtattgtcaccaattgtttattaaaaaaacatttgatttctgaactgctagattacatcaaaatttggaatgaaattgctagaactctatcgccaattgttcgtcgaaaagattttctatttctagagtatcatattgcatcaaaatttgttcagggagaaggggaaaaaaatgtacgatgcgcatggaaggtgggtatagaatgcacgatctgcaagacacaaacacgtgtctacaggtcaactgtgtcacacgctgtttttataagttaaataaaagttactgtaaccatactatagttatgctctaaagattttcttttttcttaaaaaagaaaactgttgtcagatttggatagccccaatcaataatcatcagtggaatgagacgtataaccaacgaatcatcttgcggtaacgtagccggccggccgccttcccacggaggccggcaatggtgattcgttgaacattttgatcgattcgccgctgctgacctcccagcgttgatggcgatccaaccatatcttaccatatatccccgagcatccctgctaagagcaaggataatagtgggctataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagtaagctatatgtttatctgaaagagaaagataaacaaaaaaatagggagtattggctctcatgcaagagttaactgcacacaaactccaagaaatatgcattaaattcatggtgagagaaagagagaggatgaagaaaataatgataaacttatagccaatttactatacatgttagctttaacattgactaatagtaagtagtgagctctactattaaacttgctctaatgctgccaatggcaacactgttagcttccataattactgcgcattatactgcctcatttgaccgtggattttttttctctgcatttctgcctcctgttcgtggccaaaaattcagacaacgctgcatcagacgtgttatagtactcttgttatttagtatttgacttgaaggtcatctaatctaccggtagagaggcacattcgtatgttgctcattatagtggtacacttgttggttagtggtaatgctatccagtgggcaggcagtggcatctccattgcttttcgccattattatcaccgtgactccagctgcttcaccatgtgatttgctgaccgtcatgttggtgcatgcatcaactcttttcccatgtgtttcttttcacataaattgatctgacgatcttcaagttgcttgcagtaatacgtacagttcgtttggtaaaattcagagaggtgtatcaatagtaggagtagaatgaaccttgtgttcagcttccacgcaatgtcctccgacatgacaaatgacagtttatgggactagatcaaacgattatctatttcattatctttaaaaaaatcgacggttcagtcaaaaagtactgcatttcttaggataaattactcgttattgttcgtcgcgatgtgcagatagatgcagtttagtttggttttgcctgcatccacggatgataggtacttgacagaacaacgagcactatgcgactaagttggatgcttcagttttacaggaaaaagagcagaggactgatgttgattcaacctgcagtacctgaggccacaacactttgcctaagtcatgggtcgttgacatttgatatctataattttctttaatctatagcgtcttttactaagggctgcaggaat

SEQ ID NO: 68420 - DNA, 1090 bp, Oryza sativa
tttttgatggactagctactctctcaccaggccgtcactcagtgctctaagattagtggcaagcttttgcggcatcgccaccataataagagtaggaaatgtctcgactcccttgtcaactatggaaggagaggaatgcccatgtccttgatgatgttctatctcaagtgctgatggtggtggagcagattgtggaagaagggaggcaatgggtggcgacaactgccaatccagttggagagttgttaggcacatagcttagttatgtttagtgtagtttcttcctctctcggtctcagcttaggagctttgttgggtgatcgtctaggcgtgtcactttttttctaatatattaacatgcaagaggtcatagcttaggagctttgctggttgatcgtctcggcgtgtcacttttttttctaatatattaatatgcaaagtttttttacgtgttagcatatatatatatatatatatatatatatatatatatatatatataatatatatagagagagtaacgtctctgactttttaaaggtgacaagaacagtagatcgcccattggaattatccatagaaagctgatgagtacgatgaattaaagctggtcatgggattggtcaattaatataacactatatgattgccttttttttcctccgcttggtcataacaaaagacagagaattgatacatagggctcggtcattttcttctagatacaagaaaattttgccccgttcttttctaattaagattcatattttatctcagttttcgttagcacacttttcaaactactaaacggtgtgtttcgtacgagaactttctatatagaagttgctttaaaataccaaatatgtggatttgtcaagtttgtaataattaaaacttaattaatcatgtgctaatggcattctcgttttccgtacgccaacttaattttcatcttcatcggttttatgtcaagtcagcatattttactctaccaattactagtggaaggtgcaatgaagctgaaaaaacatgtgaggaaaacctgcagattaaaaatatatttatatagaactgatataaatatattttt

SEQ ID NO: 68421 - DNA, 2003 bp, Oryza sativa
cacatcatgttctagatttgtttttttatgagacgaatgtgttatttctgttgctgatgaacctgccaatgtcccatgataatgtcctatcttgatccataaatcctctggaatctgaatgctcaaaaataggattggcatttgggtactgagtacggtatgactgaatttattgccaccggctgcattcaccagccggtttggcccataaaatccagcacggtggagtgggttctctattaagaaatctgtactacgaagcctgtatacaagagtggctttaccaaacggcaatgtagtacaactgttcatcaaccagtttttcagcagctaactggtcctcgtaagcaatttatctggtaagcgtatcgaccaatgtttgttagtagtgtcaggttcagcactacacctcctacatcatggtctttccccaacagtgatgagcctgtaacaagctgactcatggttgctggaatgctggtaattgcaaaagagaagaaactgtcatggtaatgagcatatatgtacttggaatttcacactaggagttcaatgtggaacacaaggtttttcctcactaatttttttacactgcaaattacaaatctgtacaagcatttacaacatctgaccacagcattggatctagtcagaattcacaagttctcttgacaaagttcaatctgctcctggggttagccacatcctacgacaaggaacatcctctgcatgaatgaataagacatgcgtcactctccgaaaacaattatgagtaggtcattatgagtagctctggttattttacatgagaatcataggcatagaagatgttgtccggagcaacaagaggcagcttctcaatgtacataaacaggcgcctaaggttctctctagtaatcgttgccatgtcaatgacatctcggtcatctgtgagcatccacagatcaccagaatttactcttttgaggctgtcacggcagaaggggcaggactgggatcttgagcgcctgcaacaaggatagcacatggttcaaagaatgcagcaatatcttaagagagttcgtaaccagtgaccacatagttattcatatagcagagaagctatttttaagttcatgtactgaagatataaattgatatgtatgtcctttgaattccttatgttcatgtaactggtaaggtattttatacataaacattagtactgtcatttacgtgcggtactacatgctttggtggcagagtttttgcagagctatgtattgacataagtttgggaaattatgaaactgaactgatgttcttaaggctgtttttccctttgcaagggatcatttgcttagtggggttatgccatagaagggatttcacaggagctaaattatagtgtcaaagaaaaagtgatctctgaaagaccagtaagagttaagcacaaagctgacaaccttgctgcaatgactgaaaaatatgcaatgtcttgctgtaataatcaggtacagatctattaatgaggttgcagcatagcaccatcttatttattgtgcagagccattcatacagagtaaaacagcgtgctgctattaacctctcagaaccaaaatggtccactatatctggacagagttttactcgtgttttgactaaactaactttgaattgaagaactaaacacatctcagactgttaccaaggaccaatacggcatcgattaaccattagtgatgaacatgacaaacaatttttgggatggaaggatttgattctcaccattgacggtaacacttcatgcacatagcatggctgcagttgggcaagacaaccttgttattcatctccatgcaaatcccgcactcttcctctctctcgacatcaatctcagaaacatgcctcttgctctcatcctcatctcttcttctgtatctctcagtacagattgccttctgcctccggtcatcgacatcgctgataccctttgagtgcatgagtgagggaaatataacagc

SEQ ID NO: 68422 - DNA, 2540 bp, Oryza sativa
cagctatcccaccgaaagcttctacgcgcttcctcctcctcctcggtgcggtgcggagccgcccgcttagtcgtcttccacttcgcggtgttcttcgcttcgcttctgcttctgcttctattcgttgcgtgcgcggagcgggaggagggagagaggggcacgcgtcccaggagagagagagagataaaaagctccaactgactgacaggtggggcccaagcgtggagggcgacgtaggtgtgtggttaccccttcgaatgacaggtggggtcgggttaaggtggggcccacctgtcggtgggggttgaggcgcgaggtgggagtggatggcggtggggaaaagtggagtgacctcgtggggcccacggttggacgctcgaggcggccacgtgagcttggtctatacacccacgaccggggggagtgggggtttagggaatgagacggagaaaatttggagaaaaaaaagggtgttgacgaattttgcacggcggcttgaacagtgaatttgaaagtggaaaagtcgattcgtacaattttcttcaagaaaaaaaaatcttacaaacgctgaagtggcatggtacaagtaaatttagatttttgtataactcctgctcctcatatagttcgatttaacgattaagaacttttttgtgattgtttttaaatatcccttcttctagatgtggtttttaaaaaggtttttccaaatccttattgaaaacagggaggtaaaagcttccaatcatttgcctcacagtttataagccgttgttaaaatttaaattataaaactttggttttgagttaaatttaggattttttttattcaacactaacttttaaaccgcagaaaacacaaacagaaaagtttggtccataatttatgacttggtttcttatataccgtttttggttagtagtagtacaccagacgatatatatagtaataatagaaaaaaaaacagagaatctagttcaaatagaggatacgtttgaaaaaccattcaggcatcaatccatttatgttcaacttctgttgatgtacacttgagaaatcatctgcaaaacatacctatttgtggacatttctttcgtcttgattgaataccaaggctcctacctataattaattaataagaatacgactttgtgcaccacatgccgtagttggaaaaaattgtttgtagtctattccaaatttctactactccgtatggtccaggtgcacagagcggttgaacttggacggcgagaagaaggttggtgcggtgttacggtcatttgtcactctcgtaatcggtggttatgaacttgtttgagagcgcaaactgccggattataaaaaaatatcctacttgtcgtcgtgtagcctcctctccattcatgattagtgcatgtattagcgaaagatttcgctattattaattcgaatgattagattgagtggttgcaaaacagctgttacgtcatccccattcaccggccggtgtaactttgtaagtccccagttttcaaactaaataaagcgtagtaagtccatctgttagagtacctgaattgaagtaaagcattttttatttttgtcgatgggtgattttgtgttatcttttgcagtgatgaagagatagaaaaaggaagagtgcagtggtggtgcgaactcccggttcctctaggcccatgcaattatattccatgggccttccttccatttatagcctgtttatccggcacgtatataatgggccgcattttcgtctctgtacagtttcagcccagataaaatgggcctgaagtgactggctaacgttctggcccaaaaagtggccagcagccagttgcggcccaaaacttgttgcattcttcacccactctggtgtcagttagcattgatcaatgtttgttttgcgtgcaggatccacagttatctcaaagactctcaaccctaccaattttttggtattaccaaaatttagtagggtaacaaactaaacaaactcttaccattatcactttaccaaattttagtattaccaactttgcaagcccttcacactactaaattttaataaggttaatttcgataacaaaccctactggtttgctttctagactctgaattgtgatgagtactactactagctagctagcgtccattttgaggggacacgactcgtggaaaagaaagaagagaatgatcgagagtgtggcgaccctttttattgctgtttgttaccgggtcgattaaagtacatttgtcttctttaattatgatgagtaggcataaaggtcactcaaggtgagaactgaacctgccgatcgaatttgggccagctagtttagtgacggtccttttcaggtagtttcactggacttggaggtgaacatccgtttcactaccaatgaatactcgcacatttcgaatcgaaaaacgggtactatggccatgtttagttcctctccaccaactacaaacttctaacttttcatcacatcaaaaactttcctacacacataaacttctaacttttttttcaaac

SEQ ID NO: 68423 - DNA, 7333 bp, Oryza sativa
agattaagcttttacaactttgaccattaataactttaaaaatatttagtttaaagaaactagaaaaacatatatagatttgtctttcaacacattataataaaagtaaacatgcatttatttattgtatatattataatagaaaattaaggtcaaatgtatatcttgtagagcgtgtcattgtccaaagcgtcaattaaaatgaaaccgaagggagtataatacagattgtactacctccgtttctaaggatcgttcattttactaccatttttaaccttatctttttagataaagttataaaaaatagctacatttaatttattgtcaaagtttagtaagtacatataaagtcttaccaaaatttagcaaccttgctaaaattttggtaaccttaccaaaatttggcaatgccaaaacttgataaggttgaaatggtagcaaagtgaacaaaccctaaatatttgataccgttgaatttttagcacatatttgattgttcgttttatttaaaaacttttgtgaaatatataaaattgtatgtatacatataagtatatttaacaatgaatcaaatgataggaaagaattaataatttcttaaatttttttaataaaacgaacggtcaaacatatttaaaaaagtcaacaacgtcaaatatttagaaacggagggagtatatgacaaccacgccctctagctggtgatcagttaaattcatatatagtgtgagaaagaaataggagaaaaaacaaagctaatcttatatttaatttattatacatgttagctaaaatataaaatggttaagtatactattataaacatgcttattataaacatgctgtcatatgcaatctgtatattcctacaaccaaattgtaaaaaaaaaagacgcaaatattatagaatgatctaatatcaaataattagaattggtgagacttcgaatctatatcatttagcccattaacttatgagggcattcccaacccaatgactagaatggtgtccatagcattaaatgagttgccacctagaaaaaaaatgatgtgacaagtgaataaatgaggaaagagaaggaaaccatgtcttgcatgagacatggttcctacacaatatccaatacatcatgtgagataagtagcattaaattgaagttatggaatagtggtgtttgcattgaaagagtagtgtctagtactattttcttaatgatgtggagtttatagaaatcatgtctagtgttatgggttggtactgtcctgaagctgatacgaaacctttagacgtttcaatccaattgtacagactacaaaaaatacacagctagcccaatttgtctttcgttggacgcactggcaaggtaagcaactaaagtagtaagcacccaccacgtatatatgtatgtgaagcatatggattatgaagtttattattcaaattcatgcacttgccacgtgcaatcccaactatactgttttgacatgctgacgatgatgtaaagttataaacagcagatcgattaagcttagtcgtactaattaattcctcgcaaaaaaaggctaattaattaattaattaatagtcgtaattaaacaaactaattattatcggtctcacgctagcacgtcattactgtttctcaccgatcacaagggaaccgggcgatgcgtatcgttgccacgtccaagtaggctagctacttcttcagcttaacaacgcaacagacgtgtctacgaatgacgccgacgtctcgaccgtttaagcatacataaccgcttctgttgatcggctcaatcaacgaaatccccgaaaacgagcgggtgcactccacttattactattatgctaccaatattattaagaataaaatagttatttactaataaaataattaggagttattttgcatttatattttttccgggtaaattgattatgatcatccattgtgtgctagcacaattcgtatttcatacaaaagccgaaaaagagagaaaaaaataaagtttattcactatgacaagacaattatatccctctatacttattttataataatactttttaatattggtggtagtataaataaatccaaacaattcaatcatttatgagataaacggttgttttctactactgaaccgtttgggcgaagaaaacgctggtagagatttaactcgatgatgatgtcgccacgacgccttgtatatatttagcgccgctcgcatatctcagactccagtcctcaccagctacagatgattcttgcgcttttgattttccctacgcttttttgactaaaaccctcgattcctcctccaagatcctggagagactagcagcagccgtcgctgtacgtgtgtatcgttgcatggtgctgcaatctcacgatgtatcggatctctgcatcggcaagccgccggtgaggtggctgccgccgtcctccaccgtcgccgatgccatcgccgagatcgaggccggcggcggccggggtccggacgctgccgtcgccgtgtgggacgggacgaagggggaagtggatggcagggtgtgcatggccgacgtgcacctcttcctctgcggcggcgacggcgaggcggccagcctggcttccccggccgccgcgcttcaggccacgctctccgacctcctcgccgccggcgcgccgcccgtccgccgcatcgagccccacgcgaggtcgcgcgcacgccacgtgtatcgatcttgaccgccggcgccacatgcgtttcgtctgacgaaatttgttggttacagtgtggtggaagcggtggacgccttcttggacggcgcgcactgcctcgtcgtgccgatccgggagcggtggcggcgcgcggcggcggcgggggagatgtgcatgtgctggctcacggtggaggacgtcgtgcgcttcttcgtcggctgcatcggcctcttcgccccgacggcctcgctctcggtttctcagctcggcatcgtccgcgaggccacgctcgccgtcgccgccggcgacagggcgctctccgccgtgccgctcctcagcgccgcgctggcgacgcactcctccgtcgccgtcatcacgggcgcaggcatcgccccccgcctcgccggcgaggtgtcgccgtcggcgctctgctcctgcgacgtatccgtcgcggcggccatcgccgcgctctcggctggcgacctcacggccttcctccaccgcagcgacctccggtgccgccgcaacctccccggcatggtcgacctcctgtacgccggcgacccttcgtcgtggcccccctccccctcctcctcttcctcctcctcgtcgtcatcgtcgtcgttatcctccttctcgtcttcctccgacgacgaggcggaggacgggtacaaacactatgcgccagcgccgtgcgcgcggcgagacaacaacaggcagatcatcgcgtgccacccggggagctcgctggtggcggtgatggcgcaggcggtcgcgcaccgcgtgacgcaggtgtgggtggtggacttcgacgacggcgagctggtcggcgtcgtccgcttcctcgacgtgctctgggttcttcgcgaacacctcaaccaaccaccccctgatctacccatcgaatttctcatcaattaatcccagtactaagcttcgttgatgtacatacgaggacaaaaattgcgaccatgaactgaaccttttgttcatcttaaatttacgccatgtgtttcgtcggcggatgaacttgaaacgaaggaagagtcaaaagattgatggaggacagaaaccacctgtcccgacaaattttgcaaagtttgttggtcgatatgtgacgtctggattggatgatgcatacatatggtttcagcgagagtaaattcgggttggtggccaggcgagctacataccagattagtccaaggtggattctaatatatcgaatagacattcacccgtttcttccgtattaactatataattataaaaaatattaaaaaatatacacagtagattaatatgtataaataaatcactagtatacgtatatataaaaattattatttttattataagttgtagaagtcgaattttaatatgtatatttgtaaaataatatattacatagtattaatctactttgtcaatttttttaaataaaaactgtttagtttcccagcttagtcagagagattttttggcgatcgcaacgagtttgatcagatgagagcccgtacacgaatgacatttcccgatgttcttttgtatccatactggagtaggagcatatgaaagagggttttgtgttttggcggtagcaaactctgcatattgctccagcatatgcatggctggcaccaacataatcttgttttatctgccttctcggcaactcaacgttttgtctcgacgcgccacaaaaacgcacgaggccaactgaactgatgcatatgctgttgtggcatttgcatctagcaacacgtcactaggctctggatgtttgtgaatcgtgtgagacgcaactggatctccttgcctatgggctatggcccgtgaggcatggcccatatcagcgacaactccggtttcactcttcaatgggccttacttgattgtcaccagacgtgggccacctatcaggcctgattccaactggcaagttaatttaggaataggccgctatccacagaacaaattaggcatgggctttgggtcgttgggtgtcctgatagataaaaaaaggaaaatgtccactatagatacctcaagtatgagtcttagttacattcggatatcttgactgcaaaaccggatacagtgttggaattaatagatgggctaaggcccattcgaagattaattctttggaaaatctcaaaagcccacctcatgggatggcatgcatgtggagtttagtaccaccttgcttattctaggagagggggacctccttaaaaaggaggatgccctccttgctacttgaaacatgtgtggtggagagaagaggggaaacacgcgcgctcacttgcctcgccacgtagggacccttgcgcagatgcagcctccttttgcagttttgttttgctgcgggattcggatgtgttttgttttggaaacattccgaaatgcagttttgttttgctgcgggattcggatgtgttttgttttggaaacattccgaaaatccggtgcgtgaaaatggcatggagtccggataggttacgcgcgacttatccggttcggtttacgcgggcgccctgatcaggcgatctatctctatataaaccgagccgccaccttcacgcaacacacgcgaaatcaatctagggtttgcctcctactctgtactgcgccgtcgctcgtagactactccatcccgctcgccggcgtgcaccggcgatcgggagagcaggtctccagaacctctgccttcgacgtcctgtaccgggagaaggcggcaataaggtttttgggaagcgcttcgcgcgactgctccctgttcgttcgcgacggctcgccttcctcttcgctcgcgtgctttgcgccttcgttgacgctcgcaactgcgagtagttcatgccgagcaaccggactttccgccacctcggtacgtattcgacatattgcgcatatttgatttgttcatgttttattgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttactatggctggttttgccgaagcactgaggccggataaattcaccggtgtgcactttaagagatggcagatcagggtcactctgtggctgacgtctatgaaatgcttctaggtgagtactggcaaacctgaaggaattcttactgctgatcagcagaagcaattcgaggaagccactactctctttgtgggatgcattcttagcgttcttggcgatcgtccggtcgaggtgtatatgcaaatgaccgacgctaaggagttgtgggatgcactgaatactaaattcggtgctactgatgttagcaatgatctgtatatcatggagcagtttcatgactacaagatggctggcaaccgttctatagtcgaacaggctcatgagatacaaaccatggctaaggaactcgaactccttaagtgtgtcttacccgacaaatttgtggccgggtgtattattgcgaaactacctccatcatggagaagtttcggtactgcactcaaacacaagagacaggaatactccgttgaggggttgatagcgtctcttgatgttgaggagaaagctcgggaaaaagacgccgcgtctaagggcgatggtgggcagtcctgtgccaatgttgtgcacaaggcccagaacaagagtaaggggaaatacaaagctcaacaaaccaccaatttcaagaagcagaagaagaagaagaagaagaacaacaacaatcctaactaggatgagaggacttgctttgtgtgtgggcaacctggtcatctggctaggaagtgtccacagcgcaaggggatgaaggcacctgcagcgcagacttctaagtctgctaatgtgaccattggcaacactggagatggaagtgggtatggtaatttacctactgttttttcagttaatcagtctactaattggtgggttgatattggggccaatgtacatgtttgtgctgacatctcattgttttcttcttatcaggtcgcacggggttccaccgtcctaatggggaatgggtcacatgcttctgttcatggtgttggcacggtagttctgaagtttacttcgggaaagatcgtgcagctgaagaacatgcagcatgtcccttctatcgacaggaatcttgttagtggctcccgtctgggtagagatggatttaagttggtttttgagtctaataaagtagtcgtgtctaaacatggatattttatggtaaaggatatgagtgcggaggcctgttccgcttttccctttctgatttctgcaataattctgtgaaccatatttgtggcagtgtggatgatgaggctaatgtttggcactcacgtttatgtcatattaattttggcttgatgtctcggctttccagcatgtggttaattcctaagttttccattgtcaaaggttctaagtgccatagttgtgtgcaattgaagcaacctcgcaagcctcacaaggctgccgaggagagaaacttggcaccactagaactcctacattcagatatttgtgaaatgaatggggtgttgacgaagggtggaaaacgat

SEQ ID NO: 68424 - DNA, 7676 bp, Oryza sativa
actcttgcagtcccattatgtggagaagatcttgaatcgctttggctacattgatagtaagccttctccaacaccttatgatcctagcttgttgcttctcaagaacaaaagaattgctaagaatcaactggaatactcccaaatcattggctcgctgatgtacctggctagtacaactaggcctgatatctcctttgctgtgagcaagttgagccggtttacctctaatccaagagatgatcactggcgtgcgctcgagcgagtaatgcgctatctaaaacgtactatggaattggggcttcactatactgggtatcctgcgatactggaggaatatagtgattctaactggatctctgatgtggatgagatcaaagccactagtggatatgtcttcacactaggtggtggtgctgtttcgtggaggtcttgcaaacaaaccattttgacgaggtcaaccatggaagcagaactgacgggactggatacttctactgttgaggcagaatggctacgcgatctattaatggatctgcctattgttgaaaaaccagtgccggctatccttatgaactgtgacaatcaaacggtaattgtcaaagtgaatagttctaaggataatatgaaatcgtctagacatgtgaaaagacgattgaagtctgtcaaaaaattgagaaactccggagttataacgttggattacatccaaacagctagaaacctggcagatccattcacgaaagggattatcacgaaatgtgatagataatgcatcgaaggagatgggtttgagacccatatgagttatactatggtggtaacccagtctatgtgatcggagatcccgtgaattagaacctgggaagaacaaaccattagtaaactagaggagagtaccaatctataccctctctaagtgaagatgcatgtactcttgtgagttgcaaggcaggttggctatgccttaatgagttctgttggctttaattagtgaagatgttgtcctgcagagcagtcttgaaagaactcacctttgtaagcttgactgttggtcgcagtctatggagattttgggtgaatcttctaggaagcttactaaagacctaggagtatgacttatacgctccacccgaggggtagtctacagacggtctagtaccagataagactctgagtgaaacttgcttgcacaagacttgcaattcaaggcgtagtccattgttcaagttgtgagtaagtgtagcttggagttctaggtggatattcaatcttaatcggtctccatcgaaccgctggtatataaacagtacattggaaaaggcaaatctcagtgggattttgagatttggttggggattgttggaattaatagatgggctaaggcccattcgaagattaattctttggaaaatcacaaaagcccacctcatgggatggcatgcatgtggaatttagtaccacattgcttattctaggagagggggacctccttaaaagggagaatgccctactagccacttgaagcatgtgtggtggagagaataggggaaacacgcgcgcgcgcgctcgctcgcctcgccgggcagggcaggcggcgcgcgtgcacgacgtacgcgtcgaatggtccgcaaaattggctcctcacccttgcgcagatgcagcctccttttgcagttttgttttgctgcggaaaatcaatatagggtttgcctcctactctgtactgggccatcgctcgtaaactactccatcccgctcgccggcgtgcaccggcgatcgggaaaacaagtcttccgaacctttgacttcgacgttctgcgccgggagaaggccgcaataagggttttgggaagcgcttcgcgcgactgcttcttgttcgttcacgatggctcgccttcctcttcgctcgcgtgcttcgcgccttcgtcgacgctcgcaaccacgagtagttcctgccgaacaaccgttttttccgccacctcggtacatgttcgacatgttacgcatatttgatctgttcatgttttactgcttagtttacatgtgtagatctaatgatgcgttcaatctagtttatatctgcaatgtcatgatttatttatggaataaattaaatcattatgtgcttataatttcaacatacagagcatccgctgaccatcaaaaccagtataaattgagtatcttgcttaactgcaagatagtttatcttacgtaacatattaactttgtcttcatatcctgtaacgtctacataacacttagtacatggcaaatcgaaccgtatcttgtcaagatcaacgtcgaggaacgcaaatgaaaatcatctcgtctaaaattttccaccaaaaaggcccaaactacaaaagcattgggttctttacttgttagggcatgcgcaatgtatcttacccaactagtaaataagatgggcccatgaccaggaggtagtaagctgcaactcttctcacaatgcttatatgagtgtagtggtaaacaaggtggggtccacctgaaaaaatccatccatcccaaccctccattacctggatcctgtcagaatcttcatattttatttggttgttaccggcaatagcacaaatatcaggtattaactactacctcttcccacaatgcttactactgggtagtaggcttgaaataaatgcttgttacctggttttttgccacattgtggttgctcttagccgctccacatgtttgaggtggtcccacatggaaggggagagatcccgtggatgttgggacgtttggtgcagattgaacatgatatacgcacagtacgctaatgaattttgtaagtacgcactagtaagtactctagctaggtgtttatcatgcagggtacgtaccgatgcttaccgttaactgtaagaagcggtacgccgttgaataaaccagtcgacgtggcgatgtggcagctgaacacgcagcggtccacgcgcccgccgatggacgagtctcaccacaccttacgcgccgctagatctggccaagccgtgtgcaccaccgctccagtgaaaagtgacagttaatataaaagttaatcttgatcaagttttcaaacaaaaagttaatcttcatcagtgcgactctgtcccacacactccttaaaccctcatcgatttttttttagttttaacttaactagtggtggattattggtgctatatatgtaaataaaggtaattaatctgctgagtcacatctccgtcagctgctcggaccaatcagagcttgtgaaacgcacgtctccgtcgagtaaagcagaacggaaagttggcaagtatcaagaatccaacggcgtaggatagaaacatgccaaagaaatgtactcctggagcaaaattaaaatggcataattacaaagtatgacgacgaaagcgaccgtttctgacttactagctagtattcctggagctgtcgagcatgagatgagcgtgtggcagtagtaagcgtgcaaaaggctatagatatagaatttctacaataccatcggataacaataaatatgtttttaattcctaactattacaactggcaacctgcatgcactcgatcccttagcagtactccctctgtttcaagtcataagatttttttttaatttgatcaaagtcaaaatactttaaatttaattaaatttatagaaataataataatattttcaagccaagacaaatttattatgaaaatatattaaattattgacttaaatcagtttgattttggctaaagtcaaaatgccttataacatgaaacacagagggagtaacttacactagtacaacaatttcatgcgagttgttccttggctccttgcgatgcagcatctgttgacatcttccatactgcttatgtaaacacacagtttggactgtcatgatccggtagaggatactagatctcatcagcaggattctgtcagccgtaagctacatctaagtagcaatatagagattattaacaactctggcctggataagcgtctggccaatctactggccatccaagatcagcgctaccgacctggcgacctgtactctagtcacgcctcctgatccaatgcatgtgctcaactgctcatcgctcgccgctcgatcgacctgaccagtttttaatcaccataattaacacgcgtaacagcgaccacaaacttgggattactactagtataaacacgttcgttgccgccctgacaagagagagaaaagagagaaaaaaaaaaggtgactcgctgccgagtcggacacgtgacaacacgttggtgccgcgtccggctcaaccgcttgctcgcgcggaccttatcgctccggtccgacgcgcgggtgacgtgtaccgagcgaccataccgtgccagccttatccccaatccgggcccacacttttgtcgtcgctcggtgtgggccccaccctgtcagtgtacggctcggcgctcaccggcgtttacctccccagcccacgggaaggaggcggcgcgcacgtggcagttgcggtgggtgaggctgtgagggcggtgcgcgagcctacgtggcacgccgcgtccacggaggccgtagagaggtggcccccgtgagcacgcagttcgagtaggcgatgacgtgtccgacaggtggttcagcgagcaataattacggggtaatataataaaccgctcccgccaaactaacggcggcagcccacggaaaaggcgtccctcgctgctgtttcctccgtttttcgctcacctccggtcatcctactcggctaccccggcggcaaaaacatgaagttctacagatctacgacatcagtttactagtttgtcttttgttctactttgctctttctttcttgcgaatttctttttaatcacgttttgtgtagaccatgtacagcatcctcacttgtgcagggtaggaatttcacaagaaaacagtgctcgtgcagcgactcgatagaaacggaagaaaaccgtatcaacaaccaacacgaggaggtgtgtaatactcctttcgccttgtaatataaaagatttatatagatggataaattttaatactataaatttaaacaaattttctatgtagattagtagtatgtgttatatctatttaattttttttatattttaaaacggaagtagtaaacaattacttatgtaggctttgggtgcagggtaccgtagggggtgagggcaccgcacgtcacggttaaggtggccggttactactactggtgtcacatcggcagcggcaactggtattacgtgatgatcttatcctcgtcgtctcgccgtctttatcccgttcgctgcttgctttggcttctcacatcagcactgactccaataacacgctcatcaaacagcgcgcgcgagcgagggatggataggatattttcgttcgcgttcgtgccatcctaaatcccgtctataaagccgtgcacatctctatcctcacctccattccattccactcgccaacccgacacgtctctcatcttcacgcaacgaacagcagcagcagctcaagctaagctaagctaaagtactacgtgttctttcgtcttcgtcggcgccggagtttgattcgtcggagctagctagcaagaggaagaagaaaatgttggccatattccagaagcaggtggcgcacgcgccggcggagctgaacagcccgcggagcagcgcggcgaagcccaagaaccccgacgagatcctcagggacttccacgccctccaccccatcgaggccttctccacctccttcggcggcggcgccgccctcgcctgcgtcgccggccacgcccgcaatggcctctctggctacgagaggtaaattaaatcaatttaatcgatgaggcaatgaatccgaataattaaggtgattaaaacgtaggggatcgataataatggtaaatgggtgtgtacacaggatgttctgtgggctggatgacatctactgcgtgttcatggggaggctggacaacctgagcagcctgatccggcagtacgggctgtgcagccgctccaccaacgaggcgctgctcgtcatcgaggcctaccgcaccctccgcgaccgcggcccctaccccgccgaccaggtcgtcaaggatctctccggctccttcgccttcgtcgtcttcgacaacaagtccggcgccgtcttcgccgccctggtaatttaaaccactactagactggttttctgaatcgaattgatgaatttgtgcttcaaattgaacttcctgtgagtgtagcgtggccctgtccccttcccgctgttaggagttgtgtttagccgccgtagtagttcctaagcttcagtttctgattgttctgcttttctttttcttatatattgacgttcattcgctttgcgcgatgcagagtacggatggggaggtgccgttgtattgggggatcgcggcggatgggtcggtggtgatctgcgacgagagggagatcgtgaagggagggtgcggcaagtcgtacgcgccgttcccggtggggtgcatgttccacagcgagggggggctcaagagcttcgagcacccgatgaaccggctgaaggcgatgccgcgggtggacagcgagggcgtcatgtgcggcgccaccttcaaggtcgacaccttcaccaagatcaactccatgccccgcgtcggcagcgccaccaactgggccgccacctgggacgacgctgccgcctgatgatggcgctccgtacgccgtcgtctcgtcgccgtgcgcctgccctcgccgccggcctcctcgccgtttgccgccgccgctcatctcttcctcctcttcttcctcctctctatatccgatgtgcttctccgtccgaagcatgcagattattagagcgatatttgcagctagcgtggaagcgcgccaatctatttttctgcggtgtttttacttaattttcacctcttctttttaaatttttatgtccatctttgggctctcgcctctcggcaatgtatattctcggtcgcgggtggcatgtcatggtacatactatgaatgatgaataagaaagagtttgcttcactcaatccagttcggtctcttttttgggttgcttataattgcccatgatagtaaatggtgtttggctatgcacatctcatttttgggttggttcgttttggcttatttgctaattgctgtgtttagatctaaagtttggatttaaatttcagtctttttccatcgcatcaacctgtcatacacacataacttttcagttacatcatctataattttaattaaaatttaaactttgtgctgaactaaacacaacctaaaacggttggagtgaacactgatgagctcgcgagttacatcatctctaatttcaatcaaaatttaaactttgtgctaaactaaacacaacctaaaacggttggagtgaacactgatgagctcgctttgtactactccctctgtttcgaaatgtttgacgtcgttgactttttatcacatatttgaccattcgtctaagtaattattaattatttttatatcatttgattcattgttaaatatatttttatgtaggcatataattttatatatctcacaaaagtttttaaataagacgaacggttaaacatgtgctaaaaatcaagtgtcaaacatttcgaaacggagggagtatctccgtcca

SEQ ID NO: 68425 - DNA, 2034 bp, Oryza sativa
aagggaaatagcttaaaaaaacttatccagatatataaaatttattatgcttgtgacaagtacttcattcgtcccaaaaaaaaatggtggaggggatatgatttcttctaaaacaatgaatctgtactacccttttatccagattcatgtagctggggatgtgattttttctaagacaataaatctgtactaccttttatccagattcatgtagctggatgtgacttcttcctatgtagtagcagtacgtcagatttagcagcagtgcatagagatagggcaagatactgtacggagtatttatttgtgagaatcgtaaaaatggaagccacccgaatcggcacttatcccatagcttgaccctgacgatgcgactttacctacggtttgcagatctgatcgtgcagaagcgcagtgccgggcccattgcacacctgtgagctgtggcggctttcggccttagatgctcggtgggccataggccgagatgagaagctgcgaaggcccatcaaggaacatcccccgccccgcgtactaggccgttatcccaggctcccttgcgccgctgggctattctcgcacgcgggccgtcaggccgtgtggactgaacaagttgggccacccgcgtacacatcatttctgggccagtacaagaatcgaagatgatctctcgcgtttgtctgggatttttggggttctaattttgtacatctgttgaagatgctcttaagaaatcttctttttatctctctctctctctctctgaagaaatcaacagcagctgcaagattttatctaccttatcagggtaaactaacaaaagaaagagacaaagattcttctccattccagagtcaaagagagaaaatggaactattcaaagaggagaaatgggatgattttgacaatgtatcggttgaaaactctccaaataattgtcatctctcccagccttttgaccctagacttttgtgcgcagccgcccacactaaaacagccacaaaagctacatggatttttcagatcaaatgcagacaagccaagtaatcctcatcagagattttactttgaaagcgtgtgcttccattcatacgtttaagtatttccatcagagactgcttctccagatgagaaatggtcgctaatactttatccaacttgtcctgcatttaaatatttgaatcccaaacaacattccaagaagcatcttttccgcacgtatcggtctatttaaaactactaaatatctaactaatttataagatgcgttgagtgcgaccatggattggatggtagggtcacagctcaccaaatatgcaacgactcgatcgacacttcgacgatgccatatagtagtatattttttttgtctgaataattctatgctcaggttcaataattcgccagtatttttggcttatagtagcactaattcttcacctgcccagttctagattttttaatttacaggtgattcgcccatgttttcagcttcaatatgttttgtcggaataatgctcaggtccaataatagttcaccagtatttttggcctgtagtagcatttcttcacctgaccagttctatataaatatatttttattttttttgaagaagaacaattccattaagcaggtagtccagctgaatcactagctaccaaattgcaaacatcatccgggaatccttcaagccaaacaaattggcttcgtggacccagagaagcaccaattttagcaagctcatgcgcagcacgattacattctctaggacaatacatgacttgatggacattaaaattcattgcaagcaaaaatttggcctctctaatgataacagcgtttacacttctatcatgtgtttcatccaacaaagccgctttcagagcttgagcatcagtttcaacaataatgtggcccattcccatatcattagctaatttcaaagcttggatgcatgctaaagcttctgcatccaagctttcctcacatgttctatataaagattaaaaatatatttatatgggctgcaggaa

SEQ ID NO: 68426 - DNA, 849 bp, Oryza sativa
atttgttaacaatttaaataatgatcaaagttgtttttttagagaccatgtccttgtccaaaacgacaaggtattatcaatccggagggagtatgagttacaaatcgcttaggagcgtattattagagacgtaacggaacaactttcagcaagcaaaaagaaagcagacaaacgataggaggtagactgcaatagagaaagaaagaaagcagtagagcagacttcatcaaggaggctgaaaaacaaactcattttcttgaatgtcttccccgatctgctgggccgcttgttgtgcatatggctcttgttgcttgaagaccttagcatttatttgtagccaaacgtgtcaccaggttttgatcagaattcccactcttcgttttgattcagccttattggttccatgagctaaagccatcatccattcagcggtggagtttgaatttatcgcagtttgcatgccctgagctaccgccactaggctccaagtggttctaatgaaatcacactccctaaaaagatggtcagtgtcttcacaggcgcttctacaaaggggatatatccaatcacattcccaatggtggattagcagattttcagctgttagagctcttttgtgcaggatgagccagccgaagaacctttgcttgggtaatgcctgggctctccagttggctttgaaggtctgatcatgttgacaggtaatgaattggaattgatatgcactttgggctgaatatatacctttgctatttctcttctagattatgtagtcttcattttctgacgttagttgtgtttgagtaagaaggctgccgagatgcacaagctcttggattacttcaccat

SEQ ID NO: 68427 - DNA, 730 bp, Oryza sativa
tcctgcagccccgaattgtggtcaatctagcaacaggtgagtaattgtcaaagaaatcttcgccttctttctgagtatagcccttagcaacaagccgagcattgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttctagtagtctgcatcaggagatgcatatgcttctgaaattgacttaggagtgtcatccacgaggtacacagtgaaatcatcactaatggacttagccgtcctttatctcttactccttcaaggagcttcaccgacatcctcctcaggtgtatgttcagtttgttctggtggtgtgattgaactgggaattatttcagagggttggctcgaaccactatgtgtatccttcattgggaaaaaggctctcaaagaaggtagcatcacgagactccataattgtaccaacatgcatgtcaggtacctcgcatttaactattaaaaatctataggcaatgctatgatgagcatatcccagaaagacacagtccacagtcttaggtccaagtttgcgcttcttcgttattggtacattgactttcgccaagcaccccccatgtgcgcaaataagaaagtgatggttttctcccaatccatatctcatat

SEQ ID NO: 68428 - DNA, 734 bp, Oryza sativa
gatatgacttaattagaggaaaaaaagagagagataatttggaccatagattaatcatttaagaactaagtgagaatgaactatataagtatataggatatcataaaacataataaagatatacattgaaacattatgtaattatgttggatgataatttaacatgtttgtatttgaaaagctcttaaattataaaaactgtaaagatatatcatgtttgtatgatgtttaaatgtgatgattgttagtggatgatgatgtaacatcttgttaattagtgaatgatgatgtggcatcttgttagtggatgatgatgtggcatctttgcatgttaagcttaagaagttagtgggggataactttatagtaagataggataaactcttgtgcttatgcttatttgtaacatcccggtctagggcttaataggattaatagaatactcatatcaacaagttgcaacttcttttacagaagccaatctccaaagaactccagggttaagcgtgcttggcctggagcaatttgggatgggtgaccgaccgggaaattcttcccgggtgcacatgagtgaggataaagtgtgcagaaaagatatgtgttggtctgtgaggacagtctatgacctatgaaagctatcagatgtaagcgggccccggcctgggggaggcgggacgttacaaaatggtatcagagccaactctcgcggtttcacgggtgcgacaggcctgggg

SEQ ID NO: 68429 - DNA, 2562 bp, Oryza sativa
tgtattcaactattagtgatctttacctgctgtacaggacatattcaagcatgaaggaacttattgctgattatgaaagtggcgatcttgactcttttgatgtcaagtggcacctgggaaaagcaataaatgacatattagaggtagctcttgtttattgaggcataaggttttataatctgtaatgactgtctttctttacaatcagatggtggggacaaggacaatatgaaaaaaaaaagaagtcagcccttaaaaaaacttaatttattcctttttatttattgtttttatcacttgtaaagttcaatcaattaattcttgtgatattatttgcatccttagtgactttttttactttctgtttcctgttataaatgtgcctaatcaattaagttaatttgccaaccaccttaattatgacaattacttttggacagtagtgtcattttgtaccacctaccttaattcttgtactgaatccaaatggacttatatttgaaattgaagggattttgtttgggcatcgaagttttccacccgtttctttaaaatccttcatattatgtttacattctattctgtggataattgtttaccacttggtctttcttcaagcttgtcagcgagtttttccgtagcaacgaggaagctcaagctcaaattgttccccacagggtacagttcttaacccatgactattattatttaccacaattatgtattccgatataacatacctatgatgactttgctcctgaattgactcattgtattttaaggtgaatttttctgtatatatataatcaagagaaatattcttttacacagtcatgtttaattaatgtgataaaattttgatcaagtttgcgaaatttatgccaatccactagtatccatgctagctaaatccgcatgatcacctaatgatgttgtttttgtgcgatgatgttacatttttgcctaggtctaacaagtgtcctagtgtgttctgctctgctgtccatggaacatatggctaaacgcagggtccgggatcttttattataactatatcacattagagaacatgcacagacaggagaacaataacttgcttctactataatcttcaactactctaccccaatgtgtccctaaaagattaaccaatgcagcatctataaatgcaccagataaaatcttcccaaaatgtgactagtttcatagagcctgaattcctggcactaagattgatttttcttgaataaataaacaatatatggaagtacttcaatgactcctctagtgtaggatctgaaaggaaaatagagtggtcaaccaaagataattttttagtgaagtgttctactgatcaggttgtgctattaggctgtgagatgcaacggccaggatgttatcccatttgactaaaaggcaccgaaattatccttttcacctgcataataactcttaccataaacaacagatcaggcaagtataatttaaaaaatttcgtgcacttgatatgagaattaccatacaagttgatcgaggtacacaaataaatagggtgtttggtttgtggatccggttgccgctagcaccatactacattagtaacataaattttaaaaatttatgtccgatgttcaattccttttcgactttcttttaactggatgtttccttttgacttcagttacaggatgaaattggggcagatatccagaagatccaattgcagaacgaggagatgtctggtcatgtaagtttacttagacatgtatttagacacctgcggcagaccagatttaactacgcagctaactaccggaatcgttttttttttttgcaagacatttattttctcattagttccttattttccagtgatgccacagctgaacgaggaagaaaaatacaatatatgtgttgccgatagaggagaaatctgggtttctttggacaaacttgtatatattgccgctagaggaggaaatgaataagataaacttgtttaaatgtttctgtaactgtaccaaacatacatcgatgtgacggaagttttcaaatatatgtaaattattattatttatatactagggtgaatttgtgagccgtgtataccatgtgcgcacgatcgagttggatttacatatatgcgcgtgcacgcagccagctaaccacgggccacggcattgtcgcatttaatttcctctcaggcagcagcggcaaaccggtagaccaaacaaacaagggggttaattaaatccgtaccactatgaatttataggttttaaaatataccattataatttataaaattaaaactatgtcattataacttaacattattttaatatgtcaccacttactcattcactacatttttctaatattttaaaccaaattggccttgtttttttcatccatcctcttctttcttcgcctctccttttcacctctcaccgatgagttcatgtagccgtccacggcacaggaaggttgtagtaggacaccccgatgagctcgtgcagcaggtggccatggtgtaggaagagctcgtgagtatagttatgt

SEQ ID NO: 68430 - DNA, 4506 bp, Oryza sativa
  unsure (1)..(4506): unsure at all n locations
agtggtgacgagcggggcggcagacgagaaaggagcagcgcacgtgcgcgggcgccggccgatgggaggagaggagcggtgcgcgtacacgggcggcggccggagaggataggagcggcgcgggcgtgcggggggaggtgtcgctgaccacgctcggggaggggtcgctgactgcggccacgtgtgcgggggaaggcgtcggccatggagcgcgcgagttcggcggcggagatgaagccgttgccgccgccggcctacccacccccttgccagcctcgccggccggccgccccgctccgacacgccagtcgcccgcttcggtcgccggccgcccgtcccactcaaccggccgaagagagaggatagagaggaggggagagtagtgaggccctgataggctgtcaatgtcatcgtccacgtggcatgctatgtaggtaagaccacagtcaaatgaggctttggaccgggatgatacattaaaccaagtttagagatctcgatgctcgttttgcaagtttgtggatttaagtaaaaccttgttacaagtttaagtactactagtgtaatttactcttgatttttcaaggtaaaattctctcctcgttgatcaatcaatccatccatcttcaggagtagattcagatcagattttgagtgagaacccagatcccagattatactacttagtatcattttatttgattgtatgatatgttattgttttaagccaatttcattgacacaagaactaaaacggctggcaatactggggcaaagcaaacctagcaagacagcaataacactggtatgccgtttgcccacccgactagccgaaccgagcaatagctcaggctaaccagcaaataaagcatttctaacatcacgcgtttattattccagttcatctacataaacagctgataaagtaactgaattacacttccacgtaaactagattacaggagtatctgaataatataaaaaatacaatcactatacgctgtccacatgaagtacaatgtagcacaatcgaatggagagtggtatataacaatggaagagccgggctaaattatacacacagggacattgccatttgcagttttgccgcaaatcaaaatgtgtagcgcatacgatcatatacactacaaatcaacaactgtaagcactggatccacctgaaagacaagaacaggagcaatatgtattaacataaatattttcgatacttgtgtgcagtgagctaaacagaagcatctcactactacacctgaattttatttggcgaggattggagcaccacatgcagcctttgcatgtttgtcttcagcgaacacaagattcccacccacaaaggtggacagtatcttccctgaaagctgctttcccaaatatgccgaaatattctgcaaaaatgtgaaataaactttacacatagaatccagacttcacatataaaatgtgatcttcaatttgtagcattttctagctgattgttgaggaagaggtcaaaagttccacatggtccgacattttatatggaaacaagtggaattctaacgggttcgagttagaaagcaaacccgatgcttatggtagacaggatggctgtcatcaagatggaattgagcctcaggtttccataccacaatatcagcacggtatcccggcagaacagcaccctacaaattgagtttaatttctttttagcaatatcagcatgtactgtatcgagtgagacaacagatgatgatataacaaagatgaaaacattaatcataaccattagctggttttaagnnttacacaagtgtcatccagtaagaacagtagtatggcacaatgatgccatgcattttgctaaaaaagatgacattagcccattacctttttctttaaccctgcaagcatagcaggcctttcgctccaccatgatgccagttgattcaaactgataccgtattttttcccatgcgaccatgttacagggagaacaaactgcaaatgttcataccaaactaattactactatgcaagcacaatctggaggccttcacacttcaccattatgattttactcaaaatgtttttcacgggccagcggtggaacgttgaccaatttgtattaagattaggggaaaataaaatcgttacttggcactcttggcacggtacatttattcatatgcactaaaaaacttacctgcaaagatgatatgcctccccatgcccttaagaagttaccttcctccatgagtttgagatcaggagctgatggtgaatggtctgagctcaacatgtctatgtgtccatcctaatgttagccatataatagttggccagttacgctataacagtttagtaaagttcaacaaaccaatcataataagaagaatggcgtcaagcagagcttcccagagattatctctgttggttgaatcgcgtataggaggagcacatttaaagcgagtatctccatcaggaacttcttcagctgaaaacgccaggtaatgaggacaggtttctacactaacccttgcaccattttgttttgcatcctacaaccatataaaaaattggagtaataaatggaccaagaaaaccataagtcatttgaataaatcgtactccactgtgcataagctttttcatcaacaataaataatcagtttagataagcaatgtaaaatgttctcggcgattgtgaatataatattcttttgtttggttgagacagaactttctttcatgacttcacaaaaacagatgaatcattaatacgttctggtctgtccatttgataatgacatcataccttaagaagcccaagagaagtttttgcatctgagagatgaactatgtgaatatgagctccttctgaccgaccccctatctccgtgtctttcatcgcacgttgcagatctttgatcgctgcttcctccctagatataaatggcaatagaattagtgaagtttgaagttgtgatcagctcaaaaggaaaaaaaaaaggtgttaagttgtgagtacttcggttcttttcagtgatggctattggttaagctttttttacacgattgcatactatgtactaaaacagcataatgccatggtattctcattgatttgttgtacatatgctttccagacagccatatagtttaaaatcagaattgtgcattctgattaacacacagactagactatgattcactcaggcaatttttttttcgcgaacgcgcaaaaggattgcacgtcaatatattagaagaatagagtttttgttacacgacgcactcagccagaccggcctatgccaaggactgagtgcaataactcaggcaataactgactcaaattaccatgctggtggtctagatttaagatatgtcgtataggctttaggatctagttcaccatcgatcccatcttcattctgaacatcgggtatgcgttctgcatggataagtaacggccttttgtactttgccaatgtaaccaggccctcctacagtacaaaaacaggaatatgaactcttcagggagttgataagctgaattatggaactcttgtggtcgcaaggtaataaataacagaattgtcaaagcagcgcacctcaatatgagttgaatttgtcatggggaagtcatttatacctgaggggcacataaatgactaaatcaagaaaaaaaagatcaatcagtgtatcattctatcatttgcttatttaaagtaaaatagaataaacagagtgacatgatggcatgataaggacgttacaatgacatgaaaaggacgtgaataaacctgtgggatcctagtactaaccaaacttactttggagctttgcatgcctgaaactaaggcttctttaacaagttgagaagatgaataaacatgtagaacaacagaagttgagtgattactcttgtaagtatgaacaaaccttgagccctaagacgcctgcatttaataggctctctagtgcacttggattgagggcattctctggaacgaggcctccccagaaccctgtttgagaacagcagacaagtcaaaaaaggtcggaccatgaaacaagtttagatgcagaattactgttattatggtggatgagctgtttttacctcccttggttctctacttgctaatgtgcaatgatactgaaacgtgtaactattgcattgcaacttacctacatcaacatgtagtttatccttagctgcatccaactgataatcaagcacgtaatgtcagtgttgactaaagagaaagcaggtagtagcaatttgatgctttatatactgatattggtacgataaagaaacactgaccttcagcttgagagtttcttcagaaacagttgacgggtagctattaagaggcatgtccactaatgttgtaatgccacctgaaatgaacaaaccgtgaaactttgagcaaaaagtctgatctctttctgttattgaaaagaaaaagaaaattgattactccctactaactcggt

SEQ ID NO: 68431 - DNA, 2323 bp, Oryza sativa
cattcaactgctctatcatcatcagagtaataatcaatcagtccacttgtcgtcgatcgaggtcatcacctgcgtcgggatcgacccgtccgagcgtgacgacgcgctcgctggcgatccagaagtggtcgtgggggagaaggctgcacccctcaccgcccaggctctgcaaagacaaagggattctcctcagctttctcgtacgagagaagagatcgcagattcgaataccgggggaaagggaatctcccggagaccttggaaaagggcgcgcggtagaggagcgccgccgcgagcgccgccgccaccgccagcagcggcaggaccctgcccttcgccgccgccatcgccatcgtcgtcctcctcctcctcctcctcgcgctcgtgacgagacctcctgtccttttctgcgtctgcttccttccttcctcgcgtgcgcgtgggctgcgcctccactggctctgggctgacgtggattcgggtatctgagtcgggtgggagtggatctgtacacctggtccagtggactggtgggtacgaggattcctgtggggcccacctgtctgtggcgtggtctagtggaccgcgacctggatgatccgattctggttttgttgcgttgtgtgagggcatccaagtggctggaacctttggagggatctcttgccttttagtctttcttttcgtttttttataagaaaatcgagattcttttttatttttttattaataaattagagaatctcgtgtgttgttttaaggaattagagaatctcgttgtagcggtgagggggtgggtgtgacgcggccgcggagatggacggcgtggattgcctgctcggggtttgaaacgtcactggataggaactgaaattaagatttaaataaaacaaatcaaattattcaattattagagcaagtttataatagtatagctcactactggctccaattcatctatagccgatctaatagacaatttatacaatagttgcttactatactattaatatatggtctcacatgtcatacacacattacatcttggaatccgtgctgcagctggctatagatctgtagcccgttgctcatctctttcatcttttatcttattaaaatatgtttacagctggcttatagcctgctattgtacctgctcttatagcggcctgcgctataggtggaaaattctacgtggggtaggacataaaattctttccagctgtataagaggaaaccagcggctaatttgacaagtagtcaacatttggtactccctccttccctaaatgtttgacaccgttgactttttaaaacatgtttgaccgttcgttttattcaaaaacttttgtgatatgtgtaaaactatatgtatatataaaagtatatttaacaataaatcaaatgatagaaaaagatttaacaattacttaaattttttgaataagacgaacggtcaaacattttttaaaaagccaacagcgtcaaacattttgggatggaggtagtatttgttagtggcttatcatacattttctttttataatttggtgggataccgttttattttgtaatttactctcatctttatatagcgcatacagacgtgtgtacatagagctgaaaatcattttatatttccatgcctccagtaaactccagctttgaatattgtgatgggactgtagtattatggtgcttatccgagtctcgtatgtactatctccatcacaaaatatgttgattttttatataacgttcgattatttgttttattcaaaattttagtaataactcctcggttgattaaaaattacaacaaaataaatgatatgcatataacatttttcaactaagatatatgatcaaacattatgcgaagagtcaatgatgtcatatatttcaaaacggagagagtagcaatttattattagtatcaccatggctttaagaaatgacatcagccaccagtagataaatttaagccacgttgaaagcacaattgcacataatagtagcaacgtgactagcatgaactctcaaactatgttagaagtgggataccagaaccatggaaatttatttttttctgaaatggaatggctttgagctttccaatagtatacagtaccatttccttatttaccctgaaaaattaccaaattctgcaagggcctttgcgagaaattaccatagcatttccgtccccgttcccgttcccgttcccgtttgggtccccccgttggaaaagaagaaacggagcgcaagccgaagaaaacgccgccgccgccgctccacctcctcttccctcccctctcctccc

SEQ ID NO: 68432 - DNA, 2739 bp, Oryza sativa
cccccttcattcagtggaatatagttaaaatttttaattggtaacttgcagtgctgtttgtgtcaatgctagctgcaatgagtcatgtactcgtgtttacagtggatcgttggtgcattccttgctcagaagtttgtgttgtttctgttggtgccctaggagcattttattcttctgttgataccaatctgtgtgatttagggctaagattcattccgattttgattgcacatgaaaaaattttggcttaaaattgctgatcactttgttttctagcatagcttagcttacttgccataaaaattctcaggcataagtaaatgtacggaaatatgctacaaagatcctgttttggaagatcaccagtggagtgcatatatcgatcggtctccaggacaggatagctactccttggtgagtttgtgatctgtttgtacaattcttataatttccatattccttttactgaaagtactttggtaagtgataacccattcgatggcatatgtttgtactgtatactgctgtcacagcgaaagattaggttgcattttgctgaccgaaattataatcaccctcacatgattacttgatcataaacaggaagttatagttgtcatatcttctataagaaagtgcatatatttaccatctgttgcatgatggaatagaattaactgcactagttgattttgagtaagagttgtttgttcaagattttgtatacctttcacatgattatcacagtaaagatcagtacatcagactgctgttgtatggtccgtagtcatcatactacaagtttattgggttgcagtaacataatactgcattttgctaatgctttggtctgatgtagataactagatactgttccatacactaaccagaatgcatgggtggtttttgttatagatagtttgctgttagtatgaacttgttggttagctgtaggaaattgggaacggtcattgacagtcagtttattgaatagtctactgctaatatgcagagtaatttatggtaagttcgtcggaacattctcattgcaatcctttttactgaaaacacggagtattcagtagtctattaagctccctaggcaaatcatctggcaaaacaaggaattgctcatgatgttttttgtaacatattgacgtttcttgtcttcaggagtgcttcaatgcttgtgtttctggatgtggatatagggtatgtaataaaactctcaagaatggcatataatttgctggtcataattcaatccttgtttccatattcaccactatttctcttttgctgtatgatagtttgacataccagcggagaaagtggagcaaatcaaaccaaacaggccatccaagccaccaccaccaccacctcctgcagtagagcgggccacgaattcagaacctgctgtgaagggtgaagacgtgccttgcacatcagcataatagtaatctatgcagccccaaattttgtgtaacttttggtgcttctttccctcatactgcctccttttttttctcttttctgggctgtttctttgcaccatgtgcttgaaattcgcagtccaccttaggctgggctagatgctaacaagatcttaacgataaatcccaaaatcttatttatattttcatatgcttgttcatccacattgtatgttagtatgctccctccgttcctttgtggatggcgccgttgttaataatacttatagatggtttatcatatcataaacgaaagctttgtgattatatttaggatgcaacacacttggataatatagaatcatttgaagtgtaaatgatctttttattaaaaaaaagacaagctctaaagttttactatgaatagtgcccggtgccatgtgactaataacttactccctctgtcccaaattagatgtcgttttgattttttttttgcaatgtttgacaattcgccttatttaaaaaatagtgcaaatataaaaaaagataagccatacttaaaatacttttgataataaaacaagtcatatacaaaataaataataacttcataatcttttaaataagaaaatggtcaaacgttaaaaaaatgataagtattttggaacggatgtagtattaatttgctgtcatcagaagataattacacaagctaaaatcgccacgaacaggaggtatacagggtagataaaaccagtagtgcagcatttgccatagatgctactatcccctgacgatttgctctccagcagcagcatggcatgtcttctcctgcgacgccgagacctccacttttcgagggcgtcggggaggggcatgaccaagagaggggacatgaggcggaacacgagcaacttccgcagggggcggaggtggaagaggccgagctcgacgcggcgctcgcggtaggctcggaggacggcggcgatggcggcggtggcggcggcgatgtccgggaggtggcgcgcgtaggcgtcccaggtgcggatgccgtcgacggcgtagatggtttggtcgaagatgagcaggtgccaccggagccacacctcccggcccagcggcgtcgtcttcaacctctcgccatcctgcatggacatcgtgccccccggggttcgcaccagcagcctgaatcgcttcctcggaatcttgaaccttaacgccgccattgttcttgctcttgctctgctagctaattcgtcgacgcgcgctctgtatgattttcttttcttttttttttttttta

SEQ ID NO: 68433 - DNA, 2078 bp, Oryza sativa
atatatccaaaaagaagaaaagaaagtaaaaaagatggttcaaaaaaaaaagaaacaagtgagaaagatcgaacatacggtcgaatccggaggccagcagggagatcagatggcagctcatggtggctgatggcactaatgcactagcatactcaaccaagccaaaaatgccaaaatattcgtcatttgatttcattgtaaccgaaaaagaaaatgccttgccaaattatgggtgagtttgaggagaaggagattgagaagattgaaaagatacgcaaaacgaggtgagtcattagcgcatgattaattgagtattaactattttaaactttaaaaatggattaatatgattttttaaagcaacttttctatagaaattttttacaaaaaacacaccgtttagtagtttaagaagcgtgcacgcggaatagaggtactttctcacctaaactcaccggaacgaacgcaccctatgtcaagatgcaactttggtacaaaaccccccaaaaaaatgactagccaatttctgccaaaaaaaaatcaacattgcagtttttttttttttggagaactgcatatgaatatcagtcaattagctagttagtgttagtgtaagagtaggcccgtgcgtgctacttgtgctaaatttgtggtctgcaagagatggtcataacgaacgcgaggaagcaaaaacctcttcaaatcaacatgcatgatcaaacgtactaatccaagcaaaatagaggctaggttattaaacccgcgtgcatcgatcatcacaccaagaaatgcatcaccacataggagtaacatatatccccagatcagcatatcacatatatatctttgttcaaatacgacgatcgagtgcaaaaccatacgtacacacagatatccatcgatcggcgatcgctactgatcctatcacagacaacatgcaagctacgtagtccaaactaaaatgcaacgaaaggtaatccagttctcaacgtaggccaacccgaccgcatgcagatagtatacctcagctcagacggcggcggtctcggtctcggtcgcctcgcctccggtggtggcagcagcacgtaggtcggtagttgccggcgccggctccacctcctcctcctcgtcccaaggaccaccagcagcagcaggagcgacgacggggtcggccgcggcggcggcggcggcggcgatgtcggggttggcgacgtcgatggggtcgccgtcgcaacgacccgtcacagtagcgacgacgaaggggtcgcgaggcgtggcgcgcatgaccgtcatgttgttgatggactgcagcattccgcgcgtgaaggagcggcggtcggagttgctgccgcggccgcgcgcctgaggagccgacgacttcttgttcttcttgttcttgttcttcttcttcttccccatgcccggcggccggcttttgctctgctcgtctactctcgtcggaggagtgggtggggtggggtgagaggcgtgagactccttatgtaacccgcgtttatatactcgagctggttacttgcgtggtttagccgtctcctctctctctctgacacctcttgtaacaagaaatgattcctcctagttatctctctctagctctctctctctctctctctctctctctgacaccttgtaacaagaaatgattcctcctagttaatgataacccgtctcctctctcacacggattgacacaggtgaaaacctgacacctgacacacaccctccccctcctctctgatcgctcgtctctccctctaatcgctcctctcttgcacggagtaatcatctagaataagtaaagaaaaatatctagaataaaatgtgatctatcctaaaacaactaatttggactggacggatggagcactccgtaataataaacagggtaacagcagttaactcaaaagttcagcgagttccaactccttaacatgatgcagccagtggatatattcatgtgtgacaatgggccaaattggtgcacaacagtcattgataaagttcttactgtgcaggaatataggagtacatagattgaataaattatgcaaactata

SEQ ID NO: 68434 - DNA, 1078 bp, Oryza sativa
tggatcatgcagaaattcatactccaagtgatacctgttcagcggtaatcccattctcaaaagcaccataaagactttcttttgtaatagatcccacaattaggtttggaagttgatactccactctgcaaaaatatccttattgaacattcaatgaagaatggaggatgacagtaatataaggtaaaatctacagtcgccactattactgtcattttaataaaaccttaagcaagtgtcctgtaaaattaataagcaatattacttacaacacagttattaatacagtcatcttcactgtattgtgtttcctactaccttgatttagtactggattccagtgaaacagttggcattcctgagtcaattcagtcaagatgaaggcatctactcaaccaagataaacggtatcagtcactgaaacagcagtgaccaatcaccattctactagagcatagccaaaaatcaagattatggcatatactcgcatgacaattggcagagttacgctggttaactaaagaaaatgtgatgaagggtatagagcccttagctccctgccgtcgctcttttgcatgccaaacatatggcaaaatgttaataataaatagaggaaagtcgttcaaggatgcaacagaagctatggatcagtaattcagtagttaaaaaaccagtacatagttgagctaagttatgccaatcatctagcaccacacgtaccttgaaaaaaggcgcagaatttcacaatgtaatctggaagttgagtacgcatacatccggaaatttgtctccacaactacaaaaccctacagcaccaacatcatacaatgtaattattaacagaaagtattttcatcttcatttgttgttgcttaggtgacgagtagattgaggttatgaaagatttggacgtcatgaataactgtaatagcaaggatataaaatgttctgaaacctctttgttagacgatgaatctgacaagcttgctgagagatttgtagccagttttgtaggtatgaaccagctgtcctttcgaccctgccatggcttaactcttgacatttgggctgcaggaat

SEQ ID NO: 68435 - DNA, 2510 bp, Oryza sativa
cagcatgcaagggtaaattatctgggcagcaggaagtattcctggcccatatggttccacatacttacaataactgcagaaaataatagcgcggcaacttttgtgtaagaaaacactgatagatatttagacaaaggtgaacaagtcttgcaagtgaaagaatgcctcgaatatatatgtaaacagtagagataccttgccattcttttcatggtgtattttctggaaacatccatagcaaatggccagtagtcgacagcgtgatgattcaattcatcagaaaaccatatgatctctactttgtcaaggtgcatgccaactgccttccacatcatgatattgtagcggataatagcctgtattttgtttaggttacaggtgaatctagggttccgctgcggaaaccaatctgctatcaatattttaactgtacagccagctctaaccattttgttgacatagattgtcttcataataccctgaaaatgataacagaccatgacctagttatctgtgagcagtgtttgaaatgcaaccagagaattggatttgcataggagcacataaaaattagagatccacgtctgaaccatggcatagaaatcaagcttcttgtactactacaaatatactactggtattatattagtaccaccattatgtttttatgatatttcttggttcatacccctcttgatgagtttcatcctagcctgcccaacttgtccttaatatcaggggctaatggcagaaccaccaccaccactattatcttttatactgtactctctccgtttcataatgtaaaactttttagcattgtccacattcatataaatgttaattaatctatacacacatatatgtctagattcattaacatctatatgaatgtgggtaatgctagaaagttttacattatgaaacggaggaagtagtatagatatatattttctaagaccgacataaccttttttcttattgttgttgctatacctgctctatgcccatcatggaggttggctcaaaccaaacacagcagatgggattaggcttcttcttcagtaatacgcgtagctcatcctcgcatatgcactcctccgcaatgctcctcagaagtgcaaatttctcatcaaatcccatctccatggtatccctataaaacaaagaccaaattcacatgtgatgtcattactacaacttgaggggaaacattacgatttgtaaattttccctgatcggtcgtcaatcaatatcgtggcctgggacagttgaactctagaatataataagtggggaatttgagtatttgcccgcccctaaattcgtcgcatgtttaggtttaaaccccaaaaaggatgaaactgatgatttgccatattttgaagaaaaaaaaaatctttttaccaaaacccttttccaatgcgaaaagaccatgttcctgctgaaaggagaggatagagggcgtaccgacggagagggagacagcgtcgtgaaggggataggaaagcggctccaccgttgtgtagggagaagacggcggcagcagcagcgtacggacagatggcgttggcggcgtaggaagaaattacgaggaagaaatttggttaggtcgacggctggttggaccggcttgctttagacttggagtttttcttttagtgggctccatgccattataatttattagttttttaaaaaatatcattactactcgctccatcctaaaatataagcattttaaaaagttgagactgaatgatgtctgttttatggtttaagatggtaatttacaccgctgctatagtttaggggtgtaattcggattatttcctattttcaacttgtaaagcaaacattcctcggttgtgtgggacatcgataccagtgcatggtgtagttttttttttctttttaactttttactactatattcaatgaaacttcacgctatctaactggcggttcgttaaaaaaataaagctaacataatggcattaaatattgacagattttataaggtcaaaaattgttgcccgtgcaatagcaggctgctatatacgtgccaactttgatggattgatcgaccatcaatcaaccaaactaataatatatattctcaacccaccatatatatttattcatagacatgtataactatacatatgaggccatatgttgatgctgcgtatagtgtatcttgatacgttattcatacaatgtatgagtcggtttttaaatccgtttgattttaaaaatacaaatctatatttgagccaggttttaggttcgcttttggaaatacggaaggagtcgtataagatatatttttaaaaaactcgcatgctaacttgagatgatcaggctcttaattgcagcttatgattttctaaaaagtatatacccaagtgaatttccacattgaatttcatcttaactaaattatataacaataataagattataataacattcacccgttacaatgcataaatatttttttatagtat

SEQ ID NO: 68436 - DNA, 3638 bp, Oryza sativa
taataatagggaggcagcaacatgaaagcgtaagaagaatacgtcaagtccacacgaaagcggtattcgatggggacaaaccaggataaggcgaactttccggcgggaagccaagccgagctctcccgcctctcccacggccacagccatggcggccgccgccgccgccgccgccgcgaaacccaaccttcttcttccagtctccgtggctatcccctcttctagggtttctcttcccaccggcctcgtatgcagcgcacggtccccgccgccacgcctcagggccgccgccgccgccgccgccgcctcccaggccctaacgtcgcctgtcgcggcggagactccggaggcgaagcagatgcgggtagagacggaggccgccctggaatggggcggcgtgtgcgcgcggctggccgggttcgcctccaccgccgcggggcgcgccgcctgcggagaggggcgggtgcccgtcgggcggagccgggaggagagcgagcggctgctcgaacagacggcggcggccgcgctgctgcctgctccgctggatttcggcggcgtggaggacgtgtccgccgccatcgccgcggcggctggggcccggctgcttgcggtgagggagatatgtggagtcgggcgcagcatccgtgccgcacgcagggtgttcgaccaattgaagacgctctcagaggagacaccagatggaaggaggtgaggaagttgcttcctcgaactgaatttcgtagcactgagctaaactgaatgcataatttcgagttaatgattgtaactgtaagtgtaactttgattagcactcctgtcctgcagctacactcctcttctggatataatgcaagactgtgacttcttgacagaacttgtgcaacggatagagttttgccttgattatactctttctgtggtccttgatcgggccagcgataaactagcaacaatccgcaaggagaggaggaagaacattgatatgttagaatctctgttgagagatacatccacaaagatcttccagggtggtgggattgatagccctgttgtcactaagcgccgttctaggatgtgtgtcggtgttaaagcttcacacaagcatctggttcctggtggaattgttttgagttccagtggctctggcgcaacatattttatggagccaagggacgccatcaggctgaacaacatggaagtaaagctctcaggtgatgaaagagctgaagaattagcaatattgggtctacttacttcaagcatagctgactccgaaatgaagatcaggcatttgatggggaaaatattggaacttgacctggcttgtgccagaggttcatacgctttatggataaatgctgtgaggccagcctttactgacagggatagtgatactcaactgaatccaaatagtgaatgctcagtttttatcgagggcattcagcatcctttacttcttgaacagtctcttagtatggtaaaagaatcaaccagagtagggaaaggacagctttctgatgaacatcttgtctctccaatgcctattcctctggacatgcaggtgagaaacgatactaggataattgtgatctctggacccaacactggaggcaaaactgccaccatgaagacgttggggttggcctctctgatgtcaaaggctggaatgttcttcccagccaaaggaacccctaggcttccatggttcgatcaagttcttgcagatatcggagatcaccaggtagtctctgtcttttgaagagaatttctctaatcaattggggatgcttattgatgcaaactcttttctggattgaagtcgctggagcatagcctctctaccttcagtgggcacatatcacgtcttcgcaagattgtacaagttgtgtcaaaagattctctggttcttattgatgagatcggcagtggtacggatccgtcagacggtgtagccctttcaacaagcatcttgaagtatcttgctagtaggcttaatctggccattgtgacaactcattatgctgatctaagtcgtctgaaagctgttgacgatcgatttgagaatgctgcaatggaattttgtttggaaactctgcaaccaacatatcagatcttatggggcagtactggtaattcaaatgcattgagtattgccaagtccattggttttgatcagaaagtgcttgctcgtgcacaagaatgggttgagaaacttttgcctgacaaacagaaggaacgccaaggtttactctatggttctttgctagatgaaagaaaactactggagtctcaggcaaatgaagcagcatctgttctttcagacgttgagagactgtacaatgaggttcatctcttttactctattgatctgcttttgacttgtccacagtatttatgtagaaggatcctctttgatgattttacttgaaatcttacttaataatattttgatatgaagattcgctctgaagctgatgacctggatagtcgagtagcagctttaagggcaacagagtctgaaacggtgcaacaagagttaaagtttgtgaagtctcagatggaccaaataatcaagaactttgaatctcaactcaagaattcagaacttgaacagtacaattcactaatgagaaaagcagaagctgccactgcttcattggctgctactcaccagccaactgattttaccttcggtgatgaagaaaatgagagctcatatgttcctgaaatcggagataaagtgtacgttgaggggctgggaggaggaagtatggctagtgttgtcgagacacttggggaggatggtagctgtatggttcagtatggaaaaataaaggtccgtgtcaaaggaaacaagataaagctggtccaaagaggcacgaaggacacgtcagcctcctctcctgtaaaaggaaaggtgtgctttgcatcatccctgtattagtgataattatatatattagcattcaccataatctgttttgaatgttagaggtcaattagaggtgatattgttcgcaaattgaaatttatttcatgagataaatgtgataaaaagaactaaattgcaacaaatggtgtctcataacagttgtcatgattatcatagaatacattaggtcctcagaacttatcaagtaaatgtatgtattaaattatgtctcataacagttgtcatgattatcatagaatacaatggtcctcaaaacttatcaagtaaatgtatgtctaaaattgaacaatggatgcttgtttagcactcaccagttacacagcgtgcacgtgcagcatagacaaagattttgttcttaactcggtaaatctggtctacagattgctggcaagtgtagtgtatccagtttgtatgacatagtaggtagactctgggctggcatatgagtcttaactcttaattgagttgggcttcgtgtcacaatagattgatgtgttatttttctgaaatacttttgcgtgtattcgttctgtcggtcacgttgcatattaatatgtcaattcaaggaaaccaagttagcttgcggcctacagtgtgcattgaatctgacttgctagtattgatggtctccactttagtctgggcagatgcaacagatcgatagtaagctagctggacagtcaat

SEQ ID NO: 68437 - DNA, 4188 bp, Oryza sativa
cgaataagcacattatacggcttcatcgaaaacttatggcaaagatcgtcttatgcacacttgcacgatactagctggattatacaggattgtatgccacgtgagatgaaattttgaagccgtatggttgccatgtgacaactgatttggacaaggtggcccaggaactaatggagcttggagctgatctgtgcgctgatacaatgcacaatggtggcattcaagattagcctgtgagtacgaattcttgcatgtgttacctttgacttcttaatccatggcagatatatgcatagttttgtacaggtgaaagtcacacggtacttgagacagatctccgtacatataaactacacatgcgtgcagttcgttctgcagttgaaaaagattgtccggtttgttcagatcacgcatatcatattacaacttccatcctaaaatataataatttttagcatttaaaatttatactaacatatgacaatttcttcacctacaatttgttatcaaccagttaaaatcttccatcttttaatttctatatctaccttctcttcctaatcaattataacactctttatttaattttatctagtttttttaatactcatgtctagtcttaaaacttcttttatattttaagatggatattgtatcatggaatggatcagctagctatttggtgaggctctcttaaatgatgctgctgggtggcagctgattgctgggttggtgcgttgggatcggataaatggccttggcaaatgtgatcaacactgtgtcctacaaaatcgcaaaggaagagcctggatgcatgcatatgcatatgcacatgcgctagctctcttttcagcaatgggcaccgggattttgtacggtgagttcttcctcctaccaattgctcacaagccatagccatagttgtgcaatgctttctgtttggcaacctaattgactaaggagtagtacacataacctttgggtgtttcaaaatggatcctgtttcccaacccaagttgtgtgcacggaaaacggaacggtctattagcgcatgattaattaagtttttactactttttttaaaaaatagatcaatatgatttttaagcaactttcatatagaaacttttttgcaaaaaacacaccgtttagtagtttgaaaagcgtgctcgcggaaaataaaatgggaaagttgggaacaaagagttccgaacacaagccgcttacaggtcagatgctatgccattgaaactgattgagacccataacaatgcttaagatcagtactagtacatgcaaagctgaacatgaaatgtactagatctggtgccactaggaaaaaataaaaatgattagtgttcaagaataacttagccgcatcaaatcccggccggattccagggcacatccggtgccgaggcacgcaagcgaaacacacgaattggaatttcaggaaaaaaaacacacgaattctacccaaatcaagttcatttttctaaacaatacatacaaacttcaaacagagctttaattgcgcgcaacgcatcactcttgccaactgccacgccggacagttgaagcacacatgcacatatcgccgcacatgcatcgacgccgacctgctggtcccgcctccgctgggccccgctgggccccacctgccagccaaaggggggccgtgacgtcagcgtctacctagctcatggcccctcgtgctggtgtcagagaccccccctgtacttgccaagcagataggaggagcgaggagaggagcccccctcgaatcttcttcttgccttgtgctgttatcatagtacagtgctgtagtatttgtttagtttagcgggcgccatcagcaacagcgaatcatgggatggaaaataacaaaatgacagttctaagcagcagcagcagtagcagttatactagtctattcaagatccccttttggctggcaatttggacagttctttccagtggcattttccttcttcttctcgctctctgctcgcagctggagctggtgaagcactagctcagctgatcgttgctgctgcttctgcagcaaaacgtccttttcttgcctcctcttgagtcttgatctcctatgccacaagctcccaaagaggaacccacaagtttgggagcttcttctcctttcagttttttgctcttcctctcaaggagttttgttcttgcattttgtctcttcactcttcatctcctagctagctagctagctagctctgctcatcttgccagttgcaaggcttaatagtaagttctttgatgtaacgaggaaggagtgttgttgttgttggcgacaaggtgttgccttcaccattccctcctctccccacaaggtccaaaagcctaaacttagcaaaggcgccataaagtaatcaaagctgaagaaaaatattggtgctcctttctcctcctcctcctccaagatccctagtttttctttcccatggtccaggttttgctctgcctgatgctaatggcaatgtaatgtagcggacagctgcatcccatgccaagaaactggggaaagaacgggtctttttaatccaacccctgcacattgctgcggtttcttggtctgttcttgatccttgagctcctctcgtggcggcaattgcaatgtggtgcctgcattagaggcagaggcggttagtggagaagaataggaggagttgctcatcaggaggaagaagaagaaaaggagcaaaaggtgtctccttggtgtgcgtcttgaggggaaaaaaaacaagatggccggaggcgagggcggcggggctgccgccgtccctgaggaggggcggtcattggcgctgacgccgacgtggtcggtgcatcgtgctcactctcctcgtcgccggctcgctgctcatcgagcgctccattcatcgcctcagctatgtgagtaccctgaatattacactgataaatgtagtatctctttctgttaatccgttcgtcacttgcttagtgaggctcaatattatctgtgtgtgttcttttttctgtttggagaaaataaaaagtgtgttgatggtttaatagtagcttggccctgtctgggactctcctttatttttttcttttgttcatctttcagagttttggaacaataagcaatgaaggataagcttttcttttctgtggaagttattctacattatatgaaagcctctcttccttttcttttaatcgattattcagtcacgcgttatgttgaaatagaactcatagtaatcttgtacatgttcagtggttgaagaaaacccaccgaaatccactccacaaagcaatggagaagatgaaagaaggtaggccatccgttatttatttctctttgctagcttgttttcttggactgctgtgcaacgtggactaatgatttgctctgactttgctgtagaaatgatgttgcttggtttcatatctctgcttctggcagctacatcaagaatcatctcaggtatatgcattgattcaaagtactacaacagcaatttctccccatgcaccagagaagaggttgaagaatctataaagattaagcatgccgtatctagtgcacgcaagcacctaattgaagtcattctgcaccatgcggccaggaggaaccttaaagctcgttaccatcataatcaaagttgcgctgaggtgtgtttgttaactttctgactgctggacttattgggttggatgacaaatgttgtagtaaatgtcatgtgcagggatatgagtcatttgtttcacatgaaggtctggagcagctgcaccgctttatatttgtcatggcagtaacccatgtgacatacagttgcttgacgatgctgcttgctatactcaaggttttttctagttgttataaatttccatttcagttacaagttacacctcttataaacttttctaaacatttgcaactttcaatgttattaagatgtactgttgattttcattggtatattttttaacttgggatctttggatgtcatcaaaacacttataaaaaatacagtaactatatgtaggttacgcaacatatcgatgtatgaattcaatggatggctaaaaagctaatggcattgcctgctaggcttccatgaagcttttgttgctggttaacatttttcaagcttactaatttgtgcatgtctttactactaaagc

SEQ ID NO: 68438 - DNA, 3021 bp, Oryza sativa
agagatttaatatactcttgatattaactgtaattagagattcaattcaatataattttggatcatgcatgtaatcgtggaaaatgaaacctccgtccaagtttttctttccaagtcccgcggaccaattgacggaaccgatcccaagccctacatatgcagttgcaagctatgactaattaattattacctgagatcaacataatagcaatagattccccgcgactttggaatagatggcattatattacctgtctatcagtttgacgaccttgtcaaaaatcttctcctctttattcattgagtcatacacagtgactttgcatgcgtccaagtcgaagaataacaggacccagtggaatctggaatatgcttgagatgagatatatatgaaaatgtacatgctatatatatcggaacgaaatttgttcgaacgacaataaaaactcactctgtgttgtacggcagtagtatgtacgtcctgaaatgctgctgcgttaggagatggacgagattgtcctctgtgtctttctcgtacttgtcgatcatttcggtgttgattttccgagggtcgatgaacccagtatcgtagaccctcgtcatcgggtcctttgaatctccatttctacaacgatgaaaggaaagtattattgcttatatatatgccaggagctaattattgaacgaaacaaatcgaactcaaagatactcacaaaatccatgagctcagaagagagacgtcgagggcgtccagctggtacagatcgaagagatccttgaaatggatccagagaacatcttctccttgcaagaagtcggggtttttgatcctcgctccgaacatctatctacccttggcgctcatttccatgtaccgttcatggaatttgtacatctatgtcggtagggactgcagctgttcaggtttgacaagcggtttaccgagttcaaacttgtatgccacttccgccttcgggattggtgcacctcgaatcagctgatccacagtagaccggtgtctgaaatgaattccgttatgccaaaatcttcgccggtcacgaaaggctcgacctcttggtttggttgttctataagctgagggactggtttggacttcttgtgataggctctctgaactgttcggtcatagtccgatatctgtaacgcctccttgtttgttgtggacattcccttgaagaagttcttcacgctcggtatctctcttgctcctcatccgactcctgtacgtgtggatgtcctccttaaatccaatcttccagggaatcacgcctttccctcgtgttcgtcctggatgctcgggagtttgtagggcgagtgacagctcatccttctctctatcgggtcggaatgtgccctgagaagagactaccactgcgtccgttagtcgactggcagcctcgcgtatctgatcgttgaagacaagggagccatcaactgggttaagcgttccaccgtgagcatagtaccagaacttcgatcgatccggccatttagcggtggccggttcgatacccctctcaatcaaacttgcctccatctcctcccacttcggcattgcgacgctatatccgcctaaccccaagtggtgatggtacttcttcttggcggcattttctttgtttctggccatcatcgcttccccttgttgccctgtcttgtaagcaacgaactcgtcccaatgatcccttagctttgggaatgtgtcgaagttcggtgtttgtcccttcaggatgtatttcttgtagagatctcccttgaagctctagaactgttttgccattttcttcagagtccactatttcactatgttctccgtacccgcaggtagcgtgaacgtctcgagcattgtggtccacagcatctctttctctgagtccgggacaaagctgtcattatccccgcgtgcccttgttctacgccagtacaccgtgctgacaggcacgttgtccctcacaacccaacccaaccgctgtggcgtacaaaattcttggctgcttctgccagggcactaggtcggccgtcttcgtccacctcagttatgatgtgccgaccctctatcttcttcgcggcacttcgttgtccgcgtgccctcttctgtccagcggagggatgacttccactagcctcctcctcatcgttcccctcctcgttcccctccgcatccctctccacgttcccctcctcgttcaagtactggtttggatcctcgttccccttttcttcgttccagtactggctgcttccctctgcgattgtatcgtatagtatctgttcctcatcgcgatcagccatctgtgcatacaaaaaatatttgttaggtatataggatgtatttgctaaccgtaatattaaaattctactaatcttatattaaatctctaacaatcttatattaaatcgctactaatctcatattaaaattgtaataatcatatatatatatgctaagtataacaatcttatattaaatcgatactaatcttatattaaatctctactaatctcatattaaatcactactaatcttatattaaaattgtaataatcatttatatatgctaagtctaacaatcttatattaaatctctaacaatcatatatgctaagtctaacaaacttatattaaatcgctacaaatcttatattaaaattgtaataatcatatatgctaagtctaacaatcttatattaaatctctaacaatcacttctttacatcacttgcctgcgcgaattccttcgatggctagctaccacttcggcttgagggacgacgacgacgtcttctctacaatattaccaggaaaatgtattagtctaaacgggccaagttacatatataatcatatatgtattacgagtaaaatgtattagtctaaacgcgtttcattcacgttcgtaagcgtttcattcacgttcgttcgtaaccgtttcgttcacgttcgtaagcgtttcattcacgttcgtaagcgtttcgttcacgctcgttcgcgttcgttaa

SEQ ID NO: 68439 - DNA, 1250 bp, Oryza sativa
ctgagctggtcactgtcagtaaaatctatagcatatctatatagatttttgaaaagaaaagagaaactacttgtgaaccaccagagggacgagttaacaagcatgtgaccattgtacccagtggggcactgggcggcgctgctgcacctacaagggaaatgtcaaggagtgtcgtgccacggcgagggttcacagatatataaaatctagtgttctcatcattccactcagcagcttctggcatctgcactaataaaatggattatattctgcactttaacatcatatagtcatgatgtaccatttgtgtcagcaagaagcagtagaactcaacacgaaaacaaagattgaatccatacactatgtttcagcttttcaggtttctccctgaatgacaaaaacaagaaattgaaggagatggaaggtcttcctaggccacattttcaaacctgtacactcttggaaccaaaggaaagaagaaccaaacaactgtaactaaaaaatgcaggtatttcctgttcagatcaattgagaacaactatcagaacttcattccttttacaccataatctgatctctatcgacaaaggtaattgagccaactacgacactatcatataagcaagaaagaaaacacatgagaaatgtaaatgttaaactaaatccaaaaggaaaatcctgaaagtaatcagcatttactctttgaaactgaatccaaaaggcatggactgtgataattctaacctactagcatcgctacatgcaagcaacatcaagcacatagacgaagcatccagtacataggcgaatcttttcttttgttagaaacaaagttgtactagcacaaaaattatcttccagttatgctagaaatttagggtgtgactcaaaacgaggggaatttaggtgtgggatgaatagatggataccttccgttcttggtgatgaggaggtatcgcgcactgcagatcgaggcggcagccgaggagccggtgcagcgctgcgaagggggaggtcgtcatggtggcggccggcggcgctaggtcaggaggagcgatggacacctgcagcggcaataggtcgagacctagcaggtgttgggctttttcactttgttactattttcaaccttaccttttttttggcaaagttaccaaaaaaataactacatttagtttgttgccaaattttagtaagtacatatgaaatcttgccaaaattttggtaaccttaccaaaatttggcactgc

SEQ ID NO: 68440 - DNA, 9105 bp, Oryza sativa
aggacctttgttgctctgcgtagttttgccgcttaaatcccaggtatagcagcccatgatttcagcctgtccttttagaactcggtaaccatataactccagaacatcctcagcctgataagtataagtagcatctgttatttccaatgtttgtttccttattagcttgtaatatcccatctttgtgtctcacttcttggattgtcagtagactctccttaaggcatctcagtttgttctttgcgtcttctcggtggtattcatgctcatctcctgcataagagcgtatcctgtcaactagatttggctatccatccccgtattttttatgctgccatttttagctcgatggagttcgtcagtgctggttccaagttgctgcataaagaggaaggattgttatttttgataatgaaagtggaagggttgctgatttagagaaaacttgtattttagagatagttaaagaaagagtcattatgatttaaactaaaaagctatattctccgagcagcttcatttgtcagtacagtggaaaaatcattaattgattctttttaatttgatttggttgcctagttttcttggatttttcacattttttatccttttagaaaacttattttagaaatgatcattttcatggagccaattcattggcgccgtggtccaacatgacggtgccaatgacgtttgcgtcatccccatatccccttggtggatgccccttggtggaagctaagtcactaatataaaagggacggcaccgatattgttggcgctgatgaccaatttgtattttttttaaaaaggctctagttgtaataaaaaaatatttacaaataggtcttcggtgctagcgtcattagcgttgagaatctatttgttaatacaaataggtccttttgtgctaaaagtaggttattttatcttttacaaataggtactcggctccaacgatattggcgctgtcctccttcacattaatgatgcgagggggacggcgtaaacatcattggcgccgttatgttgtaccacggtgctaaggtgctaaggacttaggctgtgatcgtttgggtgggttgggaacaaatgttttgtgcacgaaaaacggagtagtccatcagcgcatgattaattaagtatttatcaaattatttttgaaaaaggatcaatatgattttttaaagcaacttccgtatagaaaatttttgcaaaaaaacacaccgtttaatagtttgaaaaacgtgcgcgcgaaaaagcgcatgattaattaagtatttatcaaattatttttgaaaaagtatcaatatgattttttaaagcaactttcgtatagaattttttttaaaaatacaccgtttaatagtttgaaaagcgtgcgcgcgaaaaacgagggatgtgagttggaaaagttagggaaagaactcagcctcaaaggttaaaatccagcctagttttccatgcctgatcactgcacgtctgcgcggttttcagcttgttcttcaaagatattaacatcttaaaaattgtattcagctgcccacaaaggtattaattttaaacatagttgtaacatctaagacatagtttctggcgacccattccaggcagatcatttttattatgctctggtgaatcagcttatgtgaaaacctatgcctttctggatgctactgctcaggttggttctaggcagaattgcagataccctctgaaccaattatagctcgccgaggaaattacttggaacatgcctaatttaatggcaggtattgtcttctagaccaagaagggtcattcatgagtaatgatgcaagattatatttttccttgtagtttagttgtactgcttactatattccacagcaaaggtagaagcaaaatggtgtcttacatcttcttgtttattgctacatgttttccaggacgaccttccttgctctgcgtgtttttgccgcttaaataccatgacagtataattcatgtttgctagctcaatacgctagctgtgtcctttcattaaacctggattgtagcgttcgttttctgtacaataagagcatgtttagttcgcgaaataaaaatttttatgtcacatcgaatgtttgaccggatatcggaaggagttttcggacacgaatcaaaaaactaatttcataactcgtctggaaaccgcgagacgaatcttttgagtttaattattccgtcattagcaaatattggttactggttaattatggactaattagtcttaaaagattcgtctcgcgatttccctccttaactgtgcaattagtttttcttttaatttatatttaatgctccatgcatgtgtccaaagattcgatgtgatgtttttggaaaaacttttggggaactaaaacagggcctaaacattgccaggtaatggtctaattgtttgctcaaaatggagttttcatgcatatatctgctaatgatagaaaaaggtagaaaagtatatgtcaagtagcgcaagatcctatataaacgtattaacagtttttagccagttaggaataacaaaatattcgatcggccagtcgatcgacccagtcaagctatcttaatcagcctgtgaataaggctgagttataagcttcaactctaaacaacttcctcgttttctattaacactcatccctaactactaaacggtgtattatgtgcaaaaaaaaatatatattaaagctttataaaagcccatattaatctagtttttcagtttataataattaatacttaatcatgtggtaatgacttctctcttttctggtatcgcttaaactgcttctggtagcgcttaaactgctagccgaagtgctagctcgaacgcagccgtacgagacagctgggactgatgagccgattctagcatatacatatcaatgatggattattagtatataattaattgagtattaaccattataaacttaaaaaaatgatttgtttgagtttctttaaagaaatttctatagttatttttgtcataaaacatcccattttttgtcataacagtgagctctagcacggcctcgtactcccatcacccgaaggccgccgcaacaacgttgtccgcgtcgccccttcctccatcaagccgaagcccttgcagccatcaggctttgtcgtcatcatcgccagcttcacgtcatcaagccctacgcgtcgctaacattgcttcgtctgcttcgtcttcacccaaaagtcaccaccgaagttgtctcccaattaccgacccatttgtctatgtcccccaagccatcctctccatgtcaagttcgtcaccgctctcttctagccatgctagttcctctcctctcgtcgtggcttctctctttgtggcattgctattcaccaccgttttctagagggctttgatccccgtgctgctggcatcggttgccacccgtgttgtcatggtgtgcacgtgtggaggccacgtcagtgccacgtggttgcgcgcattgcatctagtggggcccgcttgtgggcaactggcttcggttgacacgcgggtccacttccatagacccgtgagcagtttctgtgcacttggtcctccatggtctcgaggttgacattctaggagcaataaacatgttttatattgcaaaattaattcaataatttgtagatctccattaaacaacaaataagctttggatgaccatattttggtcatacaaactctgaatctatctgttcaagcctcttaattataacctaaagaatccatggttgtgcttcttatgtactgatctttgctttttgaatagggttttatctttttttttgtgtgcttcatgtagttcatgtcattccgaaggatcctgaagtgcggttcgtttctgcgctgaagtttcagaagatcgtttctttgagcaaaggcatgtcgcatgggaatttgcaaaactgttttaatttaaagtattgcattacactttattaaattctcgcatataattgttttacttaggcatgcctatcattccttgctatggtcttactatttgttattgcttcattagacctcaacaattgtaggtaacaaatacaagctagtgagaactgatgcttacttgaccttttaggataatgcttacccatgcttagtgagaaacttatatatgttttacaatattagatttcgggaattatttcacatctcacatagtaacttcggactgttggcgggttcgcttggacatgatgagcttctccctttaaaattcccaaaaccattttttcgatagggctcgaggtgtggtttttttacaggaaatagtaggagaggctcctactgcaaaatatcatagagatagagtaatatttacagaagactataaaaaaacgaagggggaagtgaaatttacaaattgtcaatccatgattgccaaaagagtctatcttgctcctttaccctaaacaaaagtagagtaaaatcctcccagaaacgacatttacacaggttgaagcccggtgcaatgctgttgaagatcaaatcatttctgatttactaaatgttccagattgagattgcaaagacttcaatgaagaacgggaacccaaagctctgttttgctgaaatcaccatgttcataaattccatatctgtatccccacataactccagcattgtgtggcaaatgaatatgtgaagaataggtgcaacatatcttctgtatagatgtaatattacatgcagcagagttggagcagagttggagcttgaaatggtttgaaagtatttcattttctcagtccttctcgtacaggcggaccggccgtccgactagaaagaccgattttgtccgcctagaaaaatgtttttttctattagtgaccactgctgttcaacctgaaccactgttgccgaaaggtcgctggaacaccgttgttctctacggtggcacttgggagagggtttgactggttcgatcaattaccttatttaattacctcagatcagtacagcagtacagctgacctactaagccctggaatattcactacgctagatcggcccacctgtgatggcccaccagtgacatgctgaagtgcacatcacatatggtccatcagaaggtcataacaggtgaggccatcggctgaggcccatcacaggtatttggtcacgtgtgatgggttggaatttgcactcgacataggtctacctttgtcgggtgcaaattttggcccgtcacaggtggcaaaatatctgtgatggtccttattgttccagcccaacatagatgcgaggtatctcacctgtgacatgtgtaaaatttgtgtgcccatcaaagatgacaaaaaaaatcgctttttttccattctcttcccggctccgaagcttctccttatcctcttcttctttctcactcctctactcctctctctctctttctattcttccacccagacgtgcctccctcttcgaccaactgcggccggatgtggtaatggttgctggacactgcctccccctccaaccgatgagcgtcgggcgcttcctcccccttcgactgactgtggccagatgcagcaacgattgttgggcatcgtcccctcctccgaccgacgagcacctggcgactcctccaaccgctgggcgctgtcttccccgggtcccttgcctttatccctgtcggatgcgcctccgactaacgggcaccgcatcctacgagccctccttccctctcggcctagttagatgcgccttcgaccgatgggtgccacctcccgtgagtcctccttccccttcggcccaaccggatgctactctaatcgctggtcgccatagccgctctctctcgactgcaggtcatcatggcctctttcccatgaccgctagccgtcggaattggcctccatgaggtcgggggacatggatctgaactctaggcaccgcctccttgatcctcgtgtggcgactgaggctatcccttgaccgccagtcccagatccatcgtccacgtggttgggcgacacgaatctaaccaccggacactacatcctctatccctaggtgctgcgatatccaccccgaccgtcgtattcttcatccctgactgtcgggtattgtctcctccgaacctaagcaccggccacctcctcatggacaagcatggcatggtgccatggtgatgaagatgaagggctttgtcggccggcaactccaggcgtcgtcaagtattaccccccctcccccctccttctattgcgctgagatgatattgctgtctattgattgacaaaatcttatcatccccttctgtgaatgtaacagtttttctgatctaaaatttcatctgtttgaatgttgaagttcttgtgatctaaaatttcatcctttttttgtttttgcaatttcatcagtgttgacagcgagcaccacaatggcactggttgccattttttctcgttttttcacaccgggttgtaagctgtttttcttaatttatttttctgggttatagataccactgacgggtacatcaccaacctatggaccgtttgagatgtggtcatttgcgacgggttctgtaagcagcccatcataggggttggtcaccagcgacgggccttcacccgtcagatgtgaggtggagtcatcactggtcactgatctctgacgagagccaaacccgttagaggtgatagtatgagtccgtcagttagcgtagtgattaaaagttcatttcctctagataaaatatttcctagttcttgaaagacaaccgagccactcgttgtgtcattatctgcatagcaagtttgcccacaaaatgctaattctcatactttagagcaatataattaatactttattagtttaatattataagatgctttgttaaactttcttaaatttaactaaatttatagagaaacatagcaactcttataacacctaacttgttccattgagactaacattgaatatagtttgatagtatatgtttggtgttaaaaatgttactatatttctctataaatttgtaacttataaaagtttgacttaaaaacgtcaaagcgtcttataatataaaagatgaagtacccagtttcatatcactggtggagaaaccatctttcgtcagtcggcctaattgcacaatagtcccggttgcaacaaaaacggggactaaagatcatctttgtcccgattcaaatgctgtcagctgtgccaggcgccccagagctcattcctgctgcccggtgatatcaaccggggctaaagatcccgacgatctttagccccggttcataacaccaaccgggactaaagtcccacccctatatatatatatgtcttcttcctcctctagcccgagcaagcttcaaaatttcttcaaaaaagaggggaggtcatgccaaaatttctagtgaatttattttggtgattatatacaaatcggaggtacctaaaaggttagcaacttcatcctccaatgttttttttgtcatattacatttggagctatgttttgcacacttttttgtctccaaaattttgttgttagttgatgagagagaaaatttgtgtggggaagaaagaatatatagaaatttagtttatttgctaaagaaggttttataaaatagttgagaaggaaaatatagtgaaagttaatcttgaataatagaaaacaaactaaaatgaaaaattaaaataagtacaacacattaatagtagtttaaaactttataaatagtaaataagaattatttggtgtaatatttcataatttttgtatgaataatgatatgtcattattgtgtgactgttgaaagagtttgtaattattttataattattgtattactgtcattattatacgaataattatttgtgtacgattttttttcatgtcatgtagatggatcggcaatggatgtacgctgaccggcagtccaaagagtttattgacggcgtgcattattttttgagagtggccgaagctaacatgcaaaagggttttatttgttgtccatgcgataagtgtaagaatcagaaggagtattctgcatccaggactattcatttccacttgtttaagtcggggttcatgccaagctataattgttggacatcccacggagagcaaggtgttaaaatggaagaagatgaagtggaagacgacaatattccgcactttgctcagtacgctggatttgaaggaaatcaaacaggcgaggaggaaagggatgctgatggtaacaacgttacggatgatcttggtcagatgttgcaggacgccaaggaggattgcgaaagtgaaaagggggcccataaattggacaagatgttagaggaccacagaacgtcgttgtacccaggttgcgagcaggggcacaaaaagttggataccactctggagttcttgcaatggaaggcacaaaatggtgttagtgacaaggcatttggcgatttattgaaactcgtcaagaacattcttccggagggaaacaaattgcccgagacaacgtacgaggctaagaagatagtctgccctctaggactggaagttcagaagattcacgcatgtccgaatgattgtatcctatatcgcggtgaggattacgagaacctagaagcatgccctgtttgcaaagcactacgatacaagattagacgagatgatccaggagaagttgacgggcagctaacgaagaagagaattcctgctaaggtgatgtggtatttccctataataccacggctaaggcgtttgttcaggaacaaggggaatgctagaatgatgcgatggcacgctgaagagcgtcaacaggacgggatgctgagacaccccaccgatggtttacagtggcgaaacatcgacagaaaatttaaagactttggaaaggacacacgaaacatacggtttggtttaagtacggatggcatgaatccttttggagagatgagcagcggccatagcacttggcccgttacgatgtgtatctataacctccccccgtggctatgcatgaagagaaagtacataatgatgccgattataattcaaggccccaagcaacctggtaacgacatcgatgtgtacctaagaccactgg

SEQ ID NO: 68441 - DNA, 6418 bp, Oryza sativa
caagctctcttccaacaatattgttccagatgagcagccaacatggcaatgatggtgagaaaaccctacatgtgcacatgttttgcagtatattttcattgatcaccctcatcagtaatgattcataaaatcagagtaatatcagttggtggtgatacactcatatgccacagttcaactgttataagtgactttataactaaattcgtaaccaacagttaaagatggcaagctctcatcgctaaccaatgaactatgttggttcaacgaatggggcaccctgtattgtagtgactatgaaattaatcttttgctttgttacaacatactaaaataaacaattttataatttgtaaaaaggtaggtcctagtttgaatgtcattttaccatcgagcttgtctgtacagaggcggtctgtgaactacaccctactggcgtattgcacatatgatttaacttatggaccacttgagcaatacaagggggacatttgcaaaaatagttttgtcattttgtttttaatttcctagcaccgttgcattcaacagttgaagctttcatgataaattgtctcattagagtactactagtggacatagacgaattagtatagagttaatatagaatacaatcaaaagctaccttgtacatcttgtccatgttgtctccaccagctctaatctcaaccagccagccctttggaagccattcatgtgtcctctgcataaatcatggtagaactcagacgtactaattctaaacaccaactaaaatcttgaatgatatggtcatatatataactcaccgtaaggttactgcctacagcatggttctttgattccaagaaacactgatccatctctgagaatagataatccaaaacctctgacttcgttgtgaaagtggttccggacaagggacatatgtaatactgtacaaaagcaaacaaaattagcattgcaacaaaaatcttttagaacaaacaataaaatttaagttccacgaaagaaatagattgccatctacatattttaatacccggtagatggtgccatcatcatcacaatagacctccattatccagccatctggaagccaacctggtcggccatccacatcatcgtcgtcactttgcaaattctttgttgcttcctcagaagatttgacttcatcacgatcatcgtcgtctaagatcccgacagatggtgacttgcccatggttaaaccaagatcaaagaactctctcccctctacctccctccctcgccctctctctctctctctctctctctctctctctctctctctctcaccctcctctgctccctccctctgtttctatacctctctcaactttgcactagcttgtgtatatgtagaacaggatgtttagctgcatattaatagctgcggtttttagtaaatagtgtgtttgtatacctttgagggacaacccacaaggcgtattggacagctaatgtttaatataatatgcatttaatgtgatgagttatacatgtttggttaagatatgttctagatagtatcatatctgatgccaaatcgaacatattttcgaaattaatttatactatttatcacattgtagctatccatcctactataaacgataaaatgtatcaaattaattaaatccgatgccacctccagaattgaataaacgtcgtcagtccttaaacttggaccagggtgtcatctaggtttataaacatgtaaaatgaacatataggtcccaaatctcggtttaatgtattggaccataatcattgtgctccacctcattgtgacttaagttgtgtgctttactcagttaactctatggaggacctgcttcatctcttctttcaatgctcctttgcaaagaactgttggaatgctcttggtttctcctgggatacttcactgagcatggatagtatgatggttcaggcaaacactctctatcagggtcggtgcttcatggaaaaattcttgtatggtgcttggaatatctggaagcagaggaatggtttcatttttgaacaaaaaactccttccctgtcttcatggagacaaatcttcaagggtgatctcctccttttgctgtttagaataagtgaaagagataaggatgtaatcctaaactggagcagtttgttgtaatttttctctttcttcctttatcaataaaagttttttaacagtgggggcctcctctgctgcattcctttcaataaaaaattcgtgaaaccacacgctatgataggttgatccactcgaccacacaaacaagtggatctattgcccccctcaattccttgcaaggaaatgcaagaaattcccaatctatggcataacaaggaaatgcaagaacaatctatggcagaaattcagagttcctctctctaatttaggagcggctgcacgacacctaggagatgaaaaaaaaagcaattttcgctgcgtaatttcaatagaataaatttggtctaccctcttatgaagaatacgggtactagctgatacacaaacaacctacatatccgactagagatacacgcgtaaccctgcaaaacaaggattactttgaatggtcaattctgaaaaatggacaatttttagttagctctatgtatatcgcaaccatgaactctagtgttaggattggcaagtggattatatgagatttaaaggtatattaaaactaatgtggttccttaataacaaagtaatcctaacaaaggataaactggctaaaaacactgggggtagacaaacactattgtttctttccattatgcaccagagacaatccaacatcttttctttgggtgtcttgttccttgttttctttggagacatgtgttctttgcttttaatgtcccccacctcgtaatgccataaatatttttggtaatcgtttacggtcattgtagaccaatttcaaccatcaatacatcctaaaataatggggaactagcaatgcttgcatgcatatttatttaaaaataatttagttccacttgtacttagcaaagtatttgaatacaggagatcacaccataaatggaggagaaatgatggaaaatcacctttaaatcaatcagagaccgacatatggttgacatatggatcgatgggcccacaaccccattgaaacttctgcaactgggcccaaccaccaagccactgggctgaggatccatcaaacaatgcccaggaggaagcactgggctagggaagtctgctaaggttcagccaacaccggcctggctctgctggcccaggcccaagccaatgactagggatggcaatggggcggggcgggggcgggttgggctggaacggccccgaccccgacccccaaactctccacccggccccagccccgaatagacatgcgggtgcaaatcaatccctgccctcagcccctgcggggccccacagtgagtagcaactccaacaaatcagcaaatcttgttctaatgttctctatcatcggaatgtaaaactaccaaatatatgaaacaacatataaatatacacagaaatatagatcgagaaatagtgttatacctctcagactctcactgtcagtgcgtgaagcaggccgtcgtgcctgtcccctcaccggccccgctcctgtcccctcgaggccgccacgggcagccggacgccacatctatcccttcataggatgccgcgcctgtgcgccaaaccctcgccagccgctgcaccctcgctgcttgaccgcaccctcgccgcgcagcgcctgtgcgcctctacattctcgcctcatcggcagacatgagggagagccggagaggggtactggagagatggaacacgagaggccggagcccataggggaggggagagggtgaccggcgacgacgtgatctagagaagtgcgccgtgcatcctggcaccgcctccgcctagatggtgggtgatgcggacgggagtcgggaggggagatgccgagatggggagacactggagaggataaggctagggtttgtttttatccctcactattcttttgggttgggcccttttgggcattctatgggctacattttaagggttaatatacacccttggggcctcgcaggtcacccatgggtgaactgtctcccctggcccctccccacaaaaatgcggggccccggccccgcttcccccacaggtcagaaacggaacccgcctccggcccgtgggggaaatttccatccctaccaatgacggttgtaaccgacttcccaagggtggttgtactgaaattaacgcccacaaccgtcattctgaagctataaaaggacttctcatcctccattccaacaaacaccatgaaggaaatcaagtgaagaagctctctttagtttacatatttcgctctagtgctagtggatttagaattagaatggtcttccttagttcttcaagttttacggagaatttgggtatggttctagtagctcttcccttttttgtaagactttatccagtaatgaaatattcttctttataggtccttttctatatttgcataattattcaagtaccaacttaatttggtttacacttatctcgtattaattatatggttagcttgccagagatatgcaacggtattggcatagtgttcacttatttgattgttctatgtcatctgcagaggtgtagagtagtatttactaatgtaagcatggtgcttagattattaagtatcattaagtggtgctatatgccatggatctatagaggtaggccgctgatgctgacagttcagtacgagtaatcctccacgtgcgtatatagggctaagaaaggttcctgttcgtgtactcctccgtatgtaaaactggttggatagtcatgacggattgtcgtaaggtactcggcaattaggggtggtttctcgatgtaccacatagttgtacaatagcaagtgtatcgcaaaaggactatatactagaagtacataaatgatgcttttcttatttcttctctacttagcctagacttataatttagtgagagtattctaaactgaaccttctatgtgtcaaatctatccttatcctcaattgataaacccatgcgtaagactttgatttgcataagtgtaatatgaatttatagcacatcactctcttaccatatcttcccttgggattaaataaatacgataacttggaagtacttctaggtgaaacgctacagcagtatatccgtgcgcttgcagatttatttatgtaatccattatattaccatttaatatttctagcaacattgcttgggattaacttcctagtaaagaaatatcaacactaaatggtttagaagagtacctaggtccatgaaaaatatgatattaattggaacaagtgctttatgttggtcaatttggtggtgccgcaatgatagttctcaattgtaaacaattgtttaacccgatgcaagttatctttatgtcttcctattagctctccttttggtttactatgctatcatcaaaagagcatagtacaatgcacaatggtgctatatatactcttgaaattggtagccatggttctctgaatgcaatatgggtggcatagtttcattaaaatttgttggctaaactatgtggtttaacactagttaataataaggaggagttgggggctctgtcccatcaaattatatctcattttaatttgttgaatatgtgtaatcaaagtgtgtttggattattattttgtgatgattggtttttatgtttggtgataattggctgctagtgattttgtctttggacaggccggtttcactagggtgcgtgtaccagtcctcccttttatcaaattcaactgaaaattcaactgagtgattgtttctttgaacacgacctctgcttctaccatgacactactggagaattgattattaacgacccgaaatgtggtcgttaaaagcttaaatgtggtcgttaaagatcattaacaaccacaaaagtgtggtcgtcagtggtcgttaaaagctccgtcgtaatagtactaacgaccacgcaactttttttggtcactattttattaacgacggcattttttgtggacaccccgagtattatatcatccagtgtccaacacgaccaccacatactattgaaggaatgggatctatacacgcataaatagccactcgtcctcaatgtgtccatgatcgcggttgacaaccttctattataataaccggaatgtcgagtagtgagcgcaagagataaccgtaagacagcttgccagtacactccgtcatatgcccgtcaaccactcgaaggtggcgaccaaaagtataccccagtgactcgatccaaagcgctatccccgattatctcaagcgatcaaaacccgttactcatgcttagctag

SEQ ID NO: 68442 - DNA, 3338 bp, Oryza sativa
ataatagggttaaagtgcagcgaggtacatgacacataatagggtccgaggtcccaacatacaacacctaaatatagcagcggaagtctcaaatagagttcataagcaaaagataaaaccggtggtgccacaaccccactagggcaaaccaaccgggcaagagccaagctgcaagagatcactcattgccctcgccgtcctcggcagaccaatgaccacacaagaagcataactcataaccggaatcctctcctgaaattgcagacaccggattaagtacaagattgtactcgcaagtcttacccaaaattatatatacaaaagggagagagaagtatgcaagctttctagcctatagtgggtctctaggttcaacatttgcatcaagcaaattttattgagcaattaatgagtaaaataagcaaggacaagtaaatctagcatcattttaatttatggacagcaagtatataattctgaaatatataagcaaatgagcccaaacggcgctctcatcatcaaccatggactaccaaagtccataacaacatggcacaacatgccaacaccaccatcaaacataatcccatccataataatccacatttgatgctaacataactaacacatcaagcattgtctataaccgaggacgcgactattcgaatagattatactctgatcagaggtgtacaactggacccacacgaaatgaacaaggatcaaaagctacacaccccgtcgagtgcggtacacaagtgattcaagctcattacatgccctttcttagcctcaccccaaccacctataccacgctggggttcccgacaactcagtcacgtgcgtgcgtgatgtgaccaaggcgggcgcgccacgcgggaggcacccccggccaaacctaggcacccgaggccctccaaaggctacctgcctcacgactctccaacgtgatataaatgatcacagtagaactagtaagaacaagccggtcccaaataaggcatgtggtaagtacgtagggtgcttgattagatgtcaaaatgttcggtccttaacgacctagacggggctacttgcatcaggggaaaccaacctcccatcatcgccctatcacccgtccaagtctaacatatttcatcaaccattatttagtgtaagtgctcaagttttatgcccaataatgcaagttatttatataccacaattaatagcactgtccatccctatagttctattagcactaagcatggctaagcattaatgaataagacatcccaaataatcccaaccagtggtaataggatataaggacagcaataacacaagaactaaatgcataaataggttctacccatacaccataaaccgacaatattaatatctaggcaatgcatgcatatatatacgtatagattgcaaccaaatcatttttagagaaagtataggttctatatgcttaggtgcttgccttgctgctgtatggaaacacactcaacctcagagtctcgctccacgaactccgaattctccgaatctaccgataagaggcaaatatgcaaataagattcaaataaacatgcatatgcaacatgctctataaatcatggcctaattacagtaggtagagagtatgataaactggttttagaaacaagaatcatttcatttacatttgtggtttgagagatataaaaatgacaagccatatacactgaaaatggcatttctgtaattacatatgaactacccttggtcatatgaaatgctgacattttctagttagatttcacaagtgctatcatttttaattcaaaaatcataacccactggttctaaaaaaacttggcttactacatttggagttaaaatatttagttatgaattttacaactttaataaaaagaggattacttaatcgctttagacttactttaggaggtagttttgtcaaattattccttttcagataaaagattatatctttataaggtaaccaaaagtggtttcataattttaggatatagcataaagttcctagagattatacaactcctcggtgcaaaaataagtgtttttatgaaactcacaattttagtgactttttcagtactgaagttgtaatgttttaatttacaaacataaagactacaaaattatgaatacatagaaatttggttcactcgaaaatgagttaagatgaattagttatggatttttgaagttttcctagttctcatatatgttttcaattattcttttggactgtactttttcatgtcgaaccctgggatttgtaaaacttgcaaccaggtccaggttcttctacactcgagcaggaagcagcgacagccatggctgagctcgatctcaagctcgccggcacaaacggcggctctaatgggggcgaggtcaaaagataaaatgtagagcaacacattgtgattccattcctcaacttttccccagccaatggtgactggaacgacgcaggcggcggctgcaatcggaagcgctcgggacgccatgcatgcatcgatgcgtcacggtggacggctcgatctatttcatgcatgtcaagaacatcacatgcaggatgtagaacaccacctaaggttgctactactgcaagaaatcgacaaatggctcaccggttgaatgggaatcgacgacggaggcgctagatcggagttggagaagacggtggtcgatctccctcctcgctgcacggttctgagggattcttggggcgttttggagagcatggtgaggcgaagctggtggcgcagtagctcagccggattcgcctcgaggcgacgggaacagctgcgcgaacccgcggctgcgcgttgacgacggtgtggccgcgctccagagctcccgtggcgaggtcggcgttcccagagatcggctgcaagaaacggggcaagatcagatcagaggctatggcgtgcaagggtgaatcggaaacgaaagaaagatggcgacgacgatgacccgttgggcggcgtgatggcatcatcccggcggccggcaagaagatgatggcgaggagagcaagaaggagctctcccactctggtttcttggatctagggtggactacagagtgaggagggatggctgggaaagctagagagcaagggacgagtctagttcgcgagcattcgtccgtcacgaacacctccaacggatctcagccggtggcaacccaactgaattacagaattagcatgcatcccgccacctaattaacgtgtaattagtacctgtcagatattattatatagtaattagcattggacaacgcaacaaatataggcgatatttttccacgccgta

SEQ ID NO: 68443 - DNA, 7734 bp, Oryza sativa
tgagcgaagaccggtggctaccctcctctcatggagaggagtccagatgatgcccctgatgtgacaatacatacctaccttcacttcaccggggacaaaggagacgtggggcatggccgcgtgtcaatcggatgtgaccggtgacaggccggtcacagaccggttacgcccgatttgacgtgggccagtggtggggctccacacgtctgccccgatcgcactaaatgcttcgagggacggttggagcgccgcccattaatgaccgcccagcttggtttcctctcgctacatggcagctgggcaagggcctcgggtccaggcagggcgagggcccgaggggcctgacgtggcaccccgaggggctgacatagcaccccgaggggccttacacggcaccccgaggccccccgaacgtgtccgcgctttgcgcggtgcgaggagcgggggctgggccaggctgtacagccacgtatgaggaagtgaagggaacttccccttactttgcatacccctgggcccatatctctgacattcggcgttaagcatagccttagccatgcatagatgtgcaacaatcagattatgtgtcaacggccttggctgatcaatacaacagtggactccaaaattagcatggtgtaatccgtaattcatctttatcttgatcatttgtgtgtcaacctaagcaaaagtaaagtgcaagacttaggtagtatgtaatgctcgtcaatatcgagatattgttcacctaggagcaagttcacctctagttgtcatttcttggctctggtacgtgtaattggtcattggaatggtgtaactagtccttggtcctccttagcaaactcttgggtcagtgtaatcatttctgaattatgcctaacctcatcatttgatgatttgtttctgtagcatttgtgttggcttggtaatccataacacatgaagtaatcacaagtatccaaataaacaaccagaaaccaactccaaacaggagcaagctggtcagaccattaggttggccaatctgaccgtcaccactacttcggtctaataggtgcatacgactcggtctgaccggctccatcaagtcaaaacttgttcatcatcagaaacactattcaccacaaccaccaagtttgaccattacacgcatcccggtcagatcggccggtccaaagacaaaaccaacacttcaccaattatctccaaatatcaaaccaatcatcgcataagccaattgtttatcacaaaataataatcaaaacacactttgatttcacatgttcaacacatagaaaaaacataatgtgatggtacagacccccccccaactccatgttattattaactagtgttaaaccacataattcagccaacaatgttaatgaaactatgccacccatactgcattaagagaaccttggttaccaatttcaaaagtatagcaccattgtacatagtactttgctctttctatggtagcatcgtaaaccaaaaggagagatactaggaagacataaagataacttgcatagggttagacaattgtttacaattgaaaactatcattgcggcaccgtcaaattgactaacataaagctctagctcattttaaaatcatatttttcatggcctaggtacttttctaaaccaattaccaaaaatatttatggcattacgaggtgggggacaataaaagcaaacaacacatatctctaaatagaacgcgtaacaagacagctaaagaaaagatgttggattctttgttgtgcatagctgaaagaaacaatagtttttgtctacccccaatttttttagccaggttatccttcgtcagggttactttgctattaaggagccacataacttttagtaaatctttaaatctcatgtaatccacttgtggatgctaactctagagttcatgatcgcgatatacatagagctaactgaaaattgtgcattttctgaagcgatcatccaaattaatctttttaatttgcagggttacgtatggatctagcccaccttgtatttctagtcagatatgtaggctgtttgactatctaatacatgtattgttcacaagagggtagaccacatttattatattgaaattacacaacggaaattgctcttgttcttctcctagattttgtacagccattgccaaatgagagagagggattgggaatttctgtcgtagattgttcttgcatttccttgtttatgccatagtttgggaatttcttgcattcttttatttgtttgcaaggaattgagggggcaatagatctactcttttgtgtggttgagtggatcgcgtgtggtttcacgaattcatggtgctgcacgggcactgtgtttgtcatcgagtttatgggatttcatggtgtatccggatcctacatcgagaaggttgggcatcccagtatcaataatattactcttagatttgttaaattttggaggtgacattggatttaattaatttgattgttcatagtacgatgcatggttacaatgttatgataaattgtataaattaattttttatttaaattactaccaggtcaggcctagtagtagtataaattaatttggaaaatatatgacagttggcatcagatattattctatctagaacatatcttaaccaaacatatataactcaccacattaaatgcattgcattaaacattagctgtccaatacgcaatatgggctgtccctcaaaggcataaacacacactatttaattactaaaaaccgcagttattaaaataccagctgaacatcctttgctacatatatctaagcaagtgcgaagttcaaagagatagataaagagagggaggaagcgaaggagggtgagagagaaagggggagtggaggagggatacagagatagagggcaaggaggcagcgagggagggagggcgggagaggggagagagttcttcgatcttggcttaattatgggcaagtcaccatctgttggtgtcttacatgaagatgattgtgatgaagtcaaattctttgagaaaccaagaaagaatttgcaaagtgatgatgagaatgtggatgagcgaccaggttggcttccagatggatggataatggaggtctatcgtggtgatgatggcaccatctgccgggtataaaaatatgtagatggccatctatttcttttgttgaacttaaattttattgtttgttctaaaagatttttgttgcaatgttaattttctatgtgtttttacagtattacatatgtcccttttccggaatcactttcacaatgaagccagaggtgttgtattatcttttctcagagatggatcagcgcttcttggaatcaaagaactgtgttgtaggcaacaaccttacggtgagttatatatatatatatatatatatatatatatatatatatatatatatgaccatattatttaagattttagttgtgtttagaaatagtacatgtgagttctaccatgatttatgtagaggacacatgaatggcttccaaagggctagctggttgagattagagctggtggagacaacatggacaagatgtacaaggtagcttttgattgtattccatattaactctatgctaatttattatgaaagcttcgactgttgaatgcaacggtactaggaaatcataaacactgggacataaaattgtttttgcaaatggcccccttgtactgcacaagtggtgtataaggtaaaccgccctatgcagtacgccagaagggcctagttcacgaaccgcctccgcactgataagctcaatgctaaaatgacattggcaaaatttactacaggacactcaaaatttgtggcatttgctgtgagacatccaaagaacgtgaatcttctcgtggatactgtaaaaatatggtaattagctattggacactcgcggaattattttattattttccatgaaaacggagagagaaatattggttaaagacaagtttgcccatgggcccactcccatactctcttgttctttctcccatcctcttcttcctctttctttcgttgccgctgaaggcatcgtcggtgagctcccacagcgaagatggagtcgacgcacggggtgtgcgtgcgcaccgctctagcgtctcctgctctgcctgcctcggcgttggcatgttgttctccttctcctgccgctgtcactgtggctcgtgccggtggtgtgggtttgcagcggcgccatctccggccgccaccaccgtccatgtcactccaacgtggcctggacaatacacggagcagcggcgaccatcaccggctcggacgcgccaccgacattgtccgcgatgccgccgaagcccaccgcccgcttgatgcggtcgcgggcgtggtgaccatgctcaccgacctgcggagcagcttggtcagcggcaaggacatggccggctgcagcaacggcccggtccgcgaggtcagcacgacagacggggcaggtgacatgcgcggcgagccacacgtcgatgcaggcggtgtggaacacatggcagcacccggggaggaggcagagcttctcgccgtcgtccacaaactcggcgaggcagaccgcgcactcgagcgccccatgcccggccttcaccgccctcgctgtcgcgtacgtcgagccccacgtgcctcctccgatgttccccaccgacgacgcgaacggccgcgctggcgtgcacagcaccgcccccacggcaacgatgcgcggcagtggtggcctcggagcagcgtgggcaatggagaggaggaggatgacgtgggcgacgaatgcgtagtgacgccccatcggaggcgccacactccgtctgcctcgcattgaacaaatagcagagagaggaagagaaaaaagaacaagagagagaaaagaataaggaagaataaagaaaaaaatattcgaagggtagaaccgtacttacacagctgtttctctctccaattccttcggatataataaaataatcccgccagtgtccagcagttaattaccacatttttgcagtatctacgagaaaattcacgttctttggctgtctcacagcaaaggtcataaatattgagtgtcatgtagcaaattttgccaatgacatttgaactagcacctaccgcttacatgttattaatttgtttattccaacatattgtaacaaagcaaaagattaattttatagtcactgcagccatctttaactattggttaacaatttattcattaagtcacttatagcggcgaaccgtgacataatatgagtgtgtcacaatcaactgattactctaatcttatgaatcattaccattgggaatgttcagcgaaaatataccgcaaaacatttgcatatgaaggatttgctcaccattgttgccatgttggctgctcatttccaaacattgttggaagagagcttgaggctgctcctccatgtgagtgaatttgatcattcattttgctatttcacagttctatgtgtacccaccagatagagttcgactgttctcaaaagatgatgtactactctacattaaagaaatgaagatttctgaatttgatacagatggacaatgcaacacaagtatatgtttcttgttggaactatttctcttatttgaatagtaataattattccctccgtcttaaaatgtatcaacaaagtaccagattagatatattgtattactataaatctagtcatagagtctgtccagatttatattactagaatatgtctaattaagtactaggttgctatatattaggatagaaggagtgtcgactagatgatttctcactttgcagtactaatgtttggatagtttcctaaatgaaattatagttgatttatttttagattcttgctattcttgaatttaatcctgaagggctgccacaaggatgggtaaaagaagtggtctttagaaagacaaataccagcagaattagaagagaccaggtatgtgattgcaattaattattcttattcactttgaatgcacttgggttttaaacattgtcttttgcagcactacaccgatcccattaaaaattatgtattccgtactatgaggtcagcagcactataccttgaaacagggaaagtaataatacgtgcctttgttcaaaagacaagtgtccatgaggtgtactcttttgaaaagttcacacatttggtaattgttcttcacaatttcttacacttcatgcttgttttactttcgataaaaaaatcacacaattgagtgtaattatatggaattaccatgttttatatctttagatattctgaaaaacgtataagttctaagccatctactttaaaaaggtatatccaggacactcctaactatagttggtctctatcatgatattacgaccaatattcttaatagaatccttctacaatatactgcttccatgtgttattacaatatgcttttcaatgagttgagaagtaaaactataacttaagagggacgaaccagctgtgcacacagtcgtcaaaactccaaaagctttcactgaaagaagagattcttagtgatgagcaaggttcatctagcggtaaatttgttcctgaggaacaaaagttcatcaggtttcttgtgttaaatcaatttttagacatatttgcttcttataatgctctcttcaggtgtgctatccagtataattttactacaataatatgcttcaaattctatgttataaaaaatgataataattaatatagcccaaaaaataagacatattgatcctagctagaaggccaatatcattttaggtgacaattttgctataagctctgataactgattaaatagtgcacctaagaagcaaatccgtatgaccccaatcatacaccattagtttaattaattttcacatcctaacttccacgcaactaaactatacattttggctaatattttcatttttttattataaagtagtactattataactaggtccaatttatttacaattagatctagcattccaaatatttgcaaaaaggagagtcttgggggtgttatggttgtctatatcatcgtactgaaataatttaaaaattgtcatgtaacattagtttctcaatcttttgacttcgttaaacattgcgcaaaataaaaatacgatatatattttacgaccttaatcgttgtgcaaagtgacagttattagaagctatgaccggaagaaaaaggagacaatgactagttgtctgtagacatggtcacatgggttatgtttcctatgactgatactggtggctcggtgacacctcttttttttgaggcatgggtttatttagagttttactatcagcatctttggcaataattgatattatattttgtaaaagaaaacgagactcaaacatctggagagctcgataggctataaggtagcactacagtaaaccctccctctcgacccctcttcccccctttattctggcatatcattgctaatgatggctagaaggggtttgggtgtcctcctctatctagtaatgttgtgtactttagcttcaggtttagtgttgtactgtgtcgggcgcctagtcctattttggatctgctggtgtcatctccatggtgtggaggggtggtggtggtgctggaggtggcgattgctggtggtcgtctgggcagttgtggctttggtggcagtgctagtgacggcatttgtgg

SEQ ID NO: 68444 - DNA, 3158 bp, Oryza sativa
ctgcctctagcatcttttgcgattcctaatatacttttatttcttttcataggtgaagatagcgactctgattgttcagataaactgcatgagccaggacaaaacaaggtcaatcatgtgaagactactctaaaaggcaaagaagtaatggcctcaaccactgtcaagcgccctagagggaggcccccaaaacgaggaaaggctagaaagtgaacaagctgcattgcataaaacaaatcaaactatgagaccaaagtggccaagagggagggtgccaaaaattataactagctcaaactaaagaaatcatcaaaggaagtatgttgtgtctttacaaaacattttccattaaatggtgaactcgttaatcattctccaagaaaatattttctagtagacatattttgaactagctaatacattgtcgattctcgtaacccaaaagtttgatggttaatgtgtgcttattttattctgtggtccaaattatcgatatctattttttgaactggaattgactatgctggttatttttgaaaaactttatgcctacatagattctagaatcagacggcgggtatgtagtcatcttcctttagtccaggttctctatatggtgtagaataaaataactggatgacttgcaggaaatcagagaagacggtggtagtgaccttaattggatgtttttacaattgatgtgcgggattggaaaagtggaaccaacctgttagattttactcaaaattcacagaactctagaataaatagcagggaatggggatagattccgagataggaagacagccgccagctagcttaattgtcatctcaaccgagcatttatgcatcccttcatgcataggcaccagtctcaggctttgagcccatgcactatccattctttttgtctttcctattgcaatttgtcttgtgatgttacaacaatcatgtcacacagtggcgtccgtccaccgtgtacttttgcatcccattttatcgccttgtatctttgaccgtgctacaccacatcccctgagtttggtcctagtctgccatctatcaaggttgacgtcaagtacttgcgtagtcatagacagacaattgtttccatgaacaaatgttacaaactaaaaaaaaagcatctaggccctcccttgatcaaggttttggtgactaaccgtatttactaagtctgaaaggagcaccatccatattaggaaatgcgctataatggctcatccataaaggatgttggtgaatgaatggcttcaacaattcatccataaagaagtatttcatcccagtgattaaacgtccataaaggtatttgtgtggtattcaacaaacaaagcaaagattagagggcccgtgttcactagtttaccacatcaaaggggttgaggtgatgtggagatagaatatgggaaggaattggactggaacttaccgaggtgagagttcccaaatcaaatgcacagaggcgttcggtcagcaccaagaaaagaagatcaggcagtgacaagttgtaccatggaggaggaggaaaacggattaaggtgggagagaaacacatggtgaagcttgttggataccgagatacttaccggggatagagtttagcgcttgttaggtcatggtggtgccaggtcagcgtgggagtacacgatggtgctgcggttgtgctcgctatcaactgagtgcaaaaatggaatcagtgggtaaagggacacgaggtgacatggctgggacgagaagatagacaacggtggtgttggaacggcggaggcatgctagccggcgccgcaggtggcacctcttgttcctggcgaaccaaggggaaatcccttggtccttggctgcctgagaacaagggggagatagggagataggaggacaaggtctcggttaaggcggaagccagggaaggaaggggagagatggggccggtgcttgctctacaccctcggtctcgagatggtatgtgtgcgggcaagcatgcggcaaacaaatgggacagggcagggtgttgcagaggctcgtagagggaatctcgcgaggtcctgaggcaggaggcctctctctcgtgcacactcgagtaaatgaggaggtgctgttggcagcaataaattatggtggagaaggacagatcagccaatatcgcctagggcgagtgcaatgcgactgaagcagcgtggcgtgtggtctccagggcggtctggtgggacgtggcccagccgagacgcacagtcacgcacgagggctagcctggcttgcgcaaccctgcgcaggaggaaacagctcgtgtttggctgtgctgtggcgcccgaattggaggtggggaccaacaggtcaacgaaacaagagaaaacgagaagaagagagaaaggactccaatttcggctgagcgtttgactaaatggttagatgggcagacttgcttcaatctgaatgtaacttggagtcaaggttggtagtaaggtatggaagttttaggaatttaaccataacttttggagaagtttcaaaactgaaggttggttagggcagtgggaaccgtttagagcgatggtacaaacattaatctgctcagctatgatttttcatgcacgaaataaggcatgcggtgcaatgcacatgaaaaaagtttttatgcaacaaagaactaaagtgggttgttacagagtgcattgatcagccttttctgtgtaagttgtttatgaggggatgactgtaatgttctacctcacatttatttatgatttgttaggggacgactgtattgttccgcttgaggggacgcctcactgttccacctcacgtacaacgttcagcgccacatagaggtgttaacatgaaattcatcacgacacacgaaggcctgggagatccacttatctctagtgcaggccctattaatcaggttcagggcgtgccagttagtttgatcctgcaactaacaagatgaataaattgactgtacaagatcaatgagccaatcggacaataggccgatgtgatgcagcgaggccagccaatgtcgatagagttttgatcaatcggctataggttcgacgtagattcaaataatcaaataaaaaatgaagttcattgtcagggttacggataaggtataccctctacccttggatatatgt

SEQ ID NO: 68445 - DNA, 8192 bp, Oryza sativa
ctgcgcgcatacggatgtttcctgtacacgttaaggaaatccatcacgtaataggagcagtatccacatatgagagaagtcctactcggacaagactgggtcgtcactgtatcatgaagggtccgatatctccgagtcctacttggagatcaactgacccgtgatataaaagggaccccccaggaggtcctaaggcatcgaatctcaccgccaacacatccacctcagcctacgaagtcggagcctacaggagccaagtcgccgggtgatctagtcgaaccaactcgactacggtctcgtcggtatcatcgagttccgctattccctttgtaatctgtggtttccattatataatcccatatcaactggattagggctattacaggagccaagtcgccgggtgatctagtataatctttgtcttctgcttgtttgatgtcgtactacgtagatcctcataccagcgtaccccaataccctctatatccggtctgcgggtatccaccgtcgacagttgcgcgctaggtacggggacttggtgctcaaggttctactactatgccatcaagcctcatcaacaataacgtcaacaccagcatcaaccaaggagtttaaccttcaacaatgctggtgtggactcaagtcggtgaaatcgtcttcccagttttcaccacggtgccgatctcggctggtccatcaatgaccggaagcgagaacgtcgtggttacgaccccggacggctctatgtcgaaggatcctcccgcggacgtggagagcggaacatcgacgacgtttgagcccgataaggatcctaatgcagccaaatcttgtccttccgatgagaatcacgagccgacaaggagaacttccgaggcaacaaggtcctggtgtcctatctacaaaaccaggaaacacaccttgcaaacttgctgggtttttctcgatgtacaagctgagatccgtgcctgcaaagagcgtggaattcaacgtacttctccaacccgtgatgtctattgccctattcacaagacaaagaatcacgacctctcaagctgcaaggttcttctcagcgccatgaggacgtcacctcctaaggtccagcagtcacaaatctctcttaaagatgcgaacaaggaacgaggagcgacagttatctcagatcgatttgttggggtaatcgacatcgatccccacgagttgtcagttctacacttgcttgaagaccagggcacatcgtcgacgagtacaccacgcgatgtgtttgctatcgatgggaccagcacgtctgcgcgcgctaacacagaagcggaggatcaagtgattacaccggcccagcacatcagggccatcaacgcaatattgagggaaacctcttatgatcccgttctgaacaatgatctcgcacaatggacagaacgactacgagaataagtggctaacctcagcaacgcgttcgaggagaccgccgctggagtactgctagaacaaccgccaattggcggtgccaatggcgaactacctgagcagaatcacatcgtcaagccactccaccacctcgcggcaccaacgatctccgtgaccatttgaatggccgccgagaagcacgacgcgcgcgagacaacaaaaatcgttcccggcatcgcgtctcttcacgacatcgagagaacgaagagcgaggaggacacccgagcgagaaccaagaccgtgataaccgccacaaccaccacgaacgcgatgatcgcaaacaacggatgccaggcgataatggtcgaggacgccgccataacgatgacgacgacggagatcggcgtcgggacaacaacggtgggcgatgacaggattctcgagaacccagacgtcatcctcgtaatcgtaccccggaaccaagtgactcattgtcatcgtcatcatcctcatcatcctcgtcgtcatacagacatccacggaggacatacaatcgccgacaacccaccgcccccggtggtgggtgtagagctttcagtcgtgctctacgagatgtttgatggcctgagatattccgaccgggagcaatagagaagtacgatgggagcaccgaccctgaggagttccttcaggtctattccatagtactctacgctgccgaagcagacgacaacgcgttagcgaattatttgccggcggcgttgaaaggatctgcacgttcatggctagtccacctcccaccatacttgatttcttcatgggtagatttgtggcaacagttcgtcgctaacttccaaggaacatacaagcgccacgcgatcgaagacgacctacacgcgttgacacagaatccgggcgaatcattgagggactacattcggcgctttaatgagtgcagaaatacgatccccgagatcaccaacgcttccatgatccgcgcttttaagactggtgtcagagatcgctacaccacccaggagttggtgacaagacagatcacaactgctcgaaagctattcgagattgtcgatcgatgcgctcacgcggacgacgcactgagacgcaataacgacaagccaaagacggggggagagaaaaaaccagccaaggacacacctgagtcaagcaagaagaagagttgcaagagtgggaaaaggaaagctcaaatggaagtcctcgcagcagaatatgcggacccacccaagtacccagactcacaaggcgacgatacgaagaaaatatggtgccctatacacaagtcggacaagcactccctagaagcttgtttcgttttcaaaaagtcactcgcaaagcaacttgcattggagaagggcaagcgagtacatgtagtcgagaaggccgctgaagcagctactcaggactcggactcagcatacccaaattccgatctccatgtttcgcacatcttcggaggttccacggcatactcctcgaagcgagagtacaagaaagtggagcgcgaagtttgttcgacatggcaaggggctgagtccaagatgaagtggtctgagcagaagatcgaattctcagaggaagaccaccccaagactgctgtcaccccaggtcgatatctgatcgtggtcgacccactattcggaatatcaaggtcgcacgagttctcatcgatggcggcagctccatcaacctactcttcgccagcaccttggacgtgatggggatcccacgaagtgacttgacgcccactgatcaacccttccatggaattactcctcagtcatcgtccaagccattgggcaagattacgttgcttgtgactttcggccaagcaaacaacttccgaacagagcagatcacctttgtcgctgaatttgatacagcatacaatgctatcatcgggagaactgcactcgcgaagttcatggccgcatctcattacgcgtaccaagtgctcaagatgcccgggccaaagggaacaatcactattcaggggaacgcaaagctggcggtgcagtgcgacatgcggagcctcgacatggtcgaacacacgcccaacccacctgccacagctgagccacccaagaaagtgagcaaaacaaacaagacgccgaagccagacagcgcaatcaagatcgttccactctccagcgccaacctcgacaagaccgtcaagatcggggcgtcactagacgagaaataggaactcgcgcttatcaccttcctccgcgacaatgtagacatgttcgcttggcagccgtccgacatacccggggtccctagggaggtgattgagcacaaactcatggtgcgacccgatgccaagccagtaaaacaaaaactgcgcagatttgcaccaaaccggaaacaagccatacgagaagaactcgacaagcttctcaaagctagcttcatcagagaggttatccatccagagtagctagccaatccagtcatggtgcacaaggctaacgggaagtggaggatgtgtgtcgacttcaccgacctcaacaaggcgtgtcccaaggatcacttccctcttcctcgaatagaccaattggtggactcaacagctggttgtgagttgttaagctttcttgatgtctactctggctaccaccagatcagcatggcaaaagaggacgaggagaagacagcattcatcatgccgttcagtgtattctgttacgttaagatgctgtttggactgataaccgcaggaaatactttccaacgcacggtccaagcggcacttaacgatcagcctgggaacaatgtcgaggcctacgtcgatgacattgttgtcaagaccaagacaagcgactcattgattgatgatctccgggaaacgttcgacaacctccgacgatatcgcctcatgctcaatccagagaagtgcacattcggagtaccatcgggcaagctgctcaggttcctcgtctctggaagagggatcgaggcaaatccggagaagatcaaggcaaatcctaactggatgcatggcggcactgagcaggttcgtcgctaggatgggagagcgcggacaacctttcttcgctctgctgaagaaacaagacaaatttgtatggacacaggaagccaaagaggcattcatcgcactcaagcgctacttgtcaaatccccctgtacttgttgctccccaacctgataaagaattattcctctatattgccgccacaccatattctgtgagtaccgtcattgttgtcgagagagaaggtgcaaagaccagtttactacgtcagcaaagctctccatgacgcaaatacaagatacccacagatcgaaaagctgctttacacagtaatcatgacatcaagaaagctacaccactacttccaaacccacagggtcacagttgtttcctccttccctcttggtgaagtcgtgagaaacaaagatgctgtcggcctcatcgcgaaatgggtagtcgagctaagccagtttgatgtccactttgtgccacgaacagccatcaagtcccagctcctcgccgattttgtagctgactggactatgcctgaaaataggtcggacagtcaaaccgacagcgaaacatggacaatggcgttcgatggcgcactcaacagtcaaggagcaggggcagggttcatattgtcacgcccggaaattcactaataatttccgaactaatttgtgcataaaatcctcgtccaggaatcagccgaggtacacaaactgacaatttaatatacaaatccatcataataataacgttacatacttacaaaagaaaagaaaaacaacagcagcggaataacggtctagcgatggcttcagctccactcccacaggcaactcaactagggtataagccaaacgtcttctccttctggatcctttttcttcaactgagatttgattattgcaagaatgagcatatgacatactcaacaagccacacagcaaatatgcaagtgcacaaggataccaaaggatggcataatataagctcattcgaatagttttactctggccagaggtgtaccactgtacccacaagacacagcctcaacatcatgtctaccatgcgtcgcgatactggaaagtacccgaatagaggctatgacaataccctctgcacaacacaactcaccacagtgcaccatacctggatcataatcaccccctctataaatataaccagagacatggactccccagcgacccacacggacttctcgccgcttctcagtctagtgccccgcaatgaatcatgctatacaaaaggtaaagccgttgcccacgctggcttgtggttggcacggttaatgtttcacaacagtagctcgcgaaccggttcttaattgccatgagcacgaccttcacaaccatgtgctcacaacccaccattgacaaattttaattggcaataattaattaaccaatcacgattgaccatcgtgagctaccattaaatataaccataagtgatagtgtaatattagttatcccaatcatgtgctaatgtttctaagcatggctaagtaattatatatatatagcatttagctgaacccaaaccaatatataaggttctagctaatcaaattataacccataggaaaataaagtcatcttcggccattaattaattgggaaaggctcaccacccgatgacattcgaaaataatgcataagttgaaataaaacaatagctttaaatgggttcaacatgctcaaagggttgtttgggatctgtgtgacttgccttgagcttccgcaaacacttccgaaccttcctcaacgaaaacgctctcttcggaacttcggaaactaaaatgaaagaacaaaatcaacaaaacagtacaaaaacaagcaaaaacagtacatgtggatatttttaacatgtagatcttgattttagaaaaatttagcaacttgaaccactcgaatccgagttacgatgatttagttatgaatttccgaagtttaatcgattttcatctaatagagaaaactaagaaaaagggattaatgacgtcatcgctgacatcatcaatgtcgactcgacatcagcgacgacctcgccggcgctagaagactcggccggacttttggagggtacctacgcgtagaggagaacaacgcgaactcaccggtgcaaagaacaacgactgacgacgacgaacgacggccggcgacgaggttcgacggcggctcggctcgggtcaacaatggcgacggcgctccggcggtcttcggcggctgcgaaggggaggccggggttcccctcctccgtgcgcacccaacggcggcgacggctggcaacggacacggctaccgcggcggcgcgacgcggctggaaggtcaccgacgacggcggcggctagggcaacgtggcggcggcgctacgggcgacgagggagctcaggacttggggcaaacggaagaggacgactaggggatgctatttataggcttggattgaagagatcggactccaaccgagaggatttgagccggaaaaaccgagggttagttgcagagataaactcgaaaacgaattcgattccgcgttgatttcttcgggataaagtccgattcttggaggaaatgatagaggaggataagagaaatatttcccctcaactaattttgcaaacggagcacgggatgcggtggatttggtggaggaagcggcgtcggctacagggcacaggacggcagctcgggcttctgtccaagcttgaagacgacactgtagcagggacgcgtattagacttttcgtcttgggctggctgaaaacaaagcaaagaaagaaagagaaggaggagctcggctgggccgacttcggccgcacagcacgcgcgcgagggagagagatgttgggctgaaatcagcccaacggcttaggagaggatttaaaaactttttccaattaaaataatcactgaaatgatctttgaattgttaaaaatacttccaatcctcaactagtttcaagaaaaatcctgaaaatacttgtacactcaaagtacttaaaaaaataataatcagtccatttaatgattaatttaatatgtggataattactgaaatgttctttgtatggttaaaattaggaatggagctccgaaaaatccgagaaaattccagagagtataattaaccatggagaatttaataaaaaataaatccatccatgctttatatttaggaaattttatttcccacatttaacttctcttgtaaatgaatgaatatttaatataaattctaataataatttattaaataatttataaatcctaaaacgaaaatcaggatgtgacacatcttgatatcaccttcgggcgatcagtttaagcacgcaattcacctcaacttcagggcgaccaacaacacagctgagtacgaaggactactcgctgggataagagcagcagccgtacttggagtcaagcgattgattgtgaaaggggattccgaactagtcgcaaaccaggtgcacaaagactacaagtgctctagccctgagttatccaagtacctcgcagaagtcaggaagctggaaaaaaggtttcatggaatcaaggtccgacacgtataccgcaaggacaacatcaaaccagacgacctagcacggcgtgcgtccagacgagagccactcgaacccggcaccttcctagacgtcctgacaaagccattggtgaaagtggcaaacgacgaagatagcatggtcgtccccgacatcagctcaggggct

SEQ ID NO: 68446 - DNA, 7225 bp, Oryza sativa
tgatacagaagccgagaagttatccagacaagtcaagatctactgtatgatcggcaacgatcatacaaaaaggcgccaaacggggtacttctcaaatgtatctcgtccgacgacggcaaacatctcctcctggacatacacgaagggatctgcgggtcacacaccgctggccagaccttagtcgaaaaagctttccaacaggggttcttttggccgaccgccctcaaagactcttgcgacatggttcagcggtgtgaagcctgccaattccacagtaaaaacacaaggctatcagcacaagcgctcctgactatccctcttacttggccgttctcatgctgggggctcgacatactcggaccattcccacgaggacagggcggatataggttcctattcgtggcgatcgacaagttcaccaagtggatcgaagcgacgcccacgggggaaatcaaggccgacaacgccatcaaattcattaaagggatattctgcagatatggattgcctcaccgcatcataacagacaacatctcccagttcatcagtgccgacttccaggattattgcattgggctgggagtcaagatctgctttgcctcggtctcttaccctcagagtaatggacaggtcgaaagggctaacggcataatactacaaggaatcaagacccgtgtctatgacagactcatgtcacatgacaagaagtgggttgaagaactctcctctgtgctatgggccgtgtgtaccacaccgacgacatccaacaaggacacacccttcttccacatgtatggttcagaagccatgctctgacatcgagagaacactagtacaaaagtactctgacgaggatcaagaggagcagcaaagcgacaatgtgaatctactcgaggagcatcgagaaagagttgccgtcagagtagccagctaccaacaggcccttcgccaataccacgagaagcgcatcagagcacacacgctttcgatcggcgattacgtcctccgacgggttcaaagccaagcagggcgtaacgagctctcacctaagtgggaaggaccatacacgatcacgcaagtcttgcggccaggtgcattcaagattgcagacggcgatggttgtgagttagcaaattcctggaacattgatcaattacgtaaattttatgtataaatcaatagcatccatacttgcaagacatcttacagcttcaataaagttgattttcaggtaaagattacaatcaaagtgtttcttcccgacgatcccttaccacgacgacacctagcgttgaaacctaccctcatgtccctttacgccgtcttgacaaggcctctaaggaacctcagggaacttcggctggggacacccagagcagataaggccttgtcggatcatgtagagacaaacgaccatgtaagatcaggtcatgtaagagctctcgtcgtgcgtattaaccaacccgtgtaatcggaaaccgagtattccaacttcacggctgggggctagggtcaatgctttttcaaccgaggcaggtcaagggtcaaggagccttatcctccgagaacgtttctccgacaacaaggctgggggctagggagagtgtatgactcaagcgattgatcgaagtcgcgaaatgagaaaacactcacacacagcatatccagagtaagaaaacttagttagatagattccttgtctatttcacaagtacttcttacaattcataattgctccaaaatatattacatgtctccttgagataatttttacaggatacaaagactaccaggacggcaaacgccagtccatggactgaaagacattctcggcaagcggcacaatcgacttcgccagattctctatctctgcgggagtcctccgagaacgtgaaaacccttcgtggaggaactcgaggtgcagctacgggcggtgatctcagatacaggccagcacgtgccctctggcatatcggctcgaccgacgacactcctgcttcagcgcctcgttgatacgcttgccgatgccttcaagctgagcacaggccctattcaaccatgagatatatccagccaccgactcctcgggattcccgcgaggtactcggcgttccctacagactccagccatcgccatacaacagctcctgaggtacgagttaaactacacctcgcgacctcggagtgcttccacagcttggtcttttttcacttccaccatggtcctctcgagttcggccacctcgaacttcgtcctccagtattggatccgacgatctcggtcggccaacgcgctctcgaggtctgctcaaacacggaaatgactaagtcaagttgttcttctctctcaagaacacagcaaattaagtcaatccgaacaaaagagtgaaggaagtaaagcccaaggtgcaaacctaaagacgtcatcgccatgttcgcctccgcggacaggctctgatcgacgtcatcctgcggcacgtacggctcaagcgctagtgccgggatgaccaccggcgtctcaggctgcccgcgctgctggacatcctcaatgtcgacatctctacaacgacaacaaggtactcggaatcacatgctaagaaaacaaaggaaaacagctgcatacataaaagaggtccgggccaatagaagtttttatagtgtgttgattaaggggtacaagggaaacagaatcctactcttcaaaaagggggagaacagacctcctgatccagaaccctcttgatgtcgaggtcagggtatgccagcttcacgcatgcgaggacatggcacgccccggtgtagatcccgttacacgtctccacgccgattctggccgcatgcttggaggggatctcctccatcgccacagccaggtccgcgagcgaggacgtcagcgagaactcgtcaggggtcgccgggatagtggtcgtcacgccgcactccccgacgagttggtgtaggccggtgtaagacacccgcagcgagctgcggatctccgacaagttctcgagctctgacatccggtgctcgagcccttgtcgccgccattcattaccagccaccaactccctcatcttcaggaggtcctcgcgggcctccgccagaccacgcgccagctgctcggcgctgtggtttgccgacgaccccgccgccctggcttccttgatctcgcggcccacgcgcgagcaccagcctggaggatgcgctttatctcggcttggagctccccctaggtgagggcatcaacgggcgggccccgagcgggcacaaggccgccgacgggcccactcagcgtcgcctcccagtccctagtcacgaccacgacatctgtcaaggccgccacaggggacatgctggaggccgcaccggacccgtcttgcgtcacctttgcccgcaccgccctgcgaatgatttccacgattttcataaagtcaggcggccaaggttttgcgaattaaaggacctcaaaatcatctacttactttttgctgagcgtcaccagcctttgccgtcgctaaggcgggggagacgcgtccgaggcctaagtatgataagcatggtgtgaggtcaagatcttccgactacgtgttaaaggacaagagaggcttaccgatgggttaggcgccttccagtgggtcccgggcacggaggagaacttcctccccttcttcggaacgttgctgccactcgtcgtggcagcagcagcaacgtcggacgcctctttggcgacgccctctttcaatgacgccgccgcctgatggtccgcaagcggcccgatgacatccgtcagagggagagcctgcatacatgaagtcacgacgcgatcctaggatgacagaaataaaggagtcatcaagtatactcacgttgatcacagcctcgcattcggccacccccttctggcaaagggggacggggatgttgctcgctatcgtagggctgctgatcatcactttaccgacgcggcgctccacggtttcgctattcaaacctgtgagatcgagaaccagaactcaataagtcaggaggaacgtgcacataagaaatgaaatctgaaacacgagaaaaataccccgaggagaacccgggacgcgtcctttggcccagaatagtcaaaggccgggtgggctcgagcctggagcagttggatccgcctaccgatgaagtcggcagcaacttcataccccaacaaccctcgtactcagaggtcatcgatgatatcgatgaaagactgaagggagggagttagggcgggtttggcggtccattccggaatcttgtctggttgctcctcagggacaacaaagactggatccgagttttctatctgaagataaaaccacctcgcccgccatttgctacgagaagaggggcactagaaggggatgcccgccatcccgaagtcagaatccgacgcatccagatatcctattggattccatccagcgcaactcgtagtaaaaacgaaagaaatcaaggaatggctctaccccaatgtaggcctcacaaagataagagaagatactgaggaatgcgatggaattggggttcagatggagcaaggaaaggccataaaaattcaatacgagaagaagaaattcggagggcggaggaagaaaaccgcaagaaatataatcctcaaccgcaaccatgcggcccaggaggggttcaggttcaatacctcctgcttccctctccatggtcccgctaccagggagggcgccgtcgtcctgcagcttcttcaaggacgcggtagtggaggtagacttatcaagatccaacaccgctagagatcgccggagaacaaactgagatgagcaaactagggttttttctgtgggagcggagaagacgaggggcgcttgaaggctggagagttctgcggcaaacgaacttcaaaatagatccccaaaactcctttaaataagcgcattaccgacggtgcgtagtccaaggaaaggagagagatggccgccggaaatttctgggtccgttacgcgcagcagttttcagacttcaatttaaattcactcatgaccgttgaacttcgtacaatgttatcgataactctatgtctctaagggacccccgggaggtcctaaggcatcgaatctcaccgccaacacatccacctcagcctacaaagtcggagcccacaggagccaagtcatcgggtgatctagtcgaaccaactcgattacggtctcgtcggtatcatcgagttccgcaacctttgtaatctgtggtttccatcatataatcccatatctactggattagggctattacctatcaaggggcctgaaccagtataatcttggtcttctgcttgtttgatgtcatactacgtagatcctcataccagcgtaccccgataccctctatatctggtctacgggtatccaccgtcgacattcatgctatcatcggctagaaccaaaatatgtatgatcatcaatatgagcggatgcaacacttagaaatagtaacatgataactcatcagctaaaacttcgatgaaacatcgcataaaaacttattagcttaatagaaataaacttattagcagcaatatgatagatcaaacctaaccgagacactataagattgaagataataagaaaaacctatttagccgacagatctatatcgataaatctaaaacaacaatttaattagagaaatatcaacttactcagaatatcgaacctaaccatgaaagtcctaaccgtggaagatagactcgatatatcatataggcaagacttgcattaacttgaatagaatatcgaacctaaccgtggaagttctagccacgctgatacaggcgaactagatggaacttacctcttgccggagtcaaacttaaccgatgcaaccccgctcgaaactaacaactcgtcggaataaaaggtggcgatgcaccaaaagttgtatattgatcaagagatagtttacaaaaaccccgggtgtacatatttatacccttggattgatacaagtcctgattggacacgagataagactcctaacaagaaaacgaaaataactaatcttgcctatttaagatatatactaaaaatatgaaacagccttgtcacggtcttcacgattcttatttgaattcagcttgatctggataaagtttcatctaccaatcaatttccatcattaaccgaatccactagagaatcataccaaattttggcattaaaaaggggacaactgtaccagttcgcctacagcgttatgttggtaccctccccctccccccccccccaaacctaacggcattaagattctacatttagtgtggaataacactcgtcatgctcatgcaaggagtagataataaataatataaagacatcattgtgacctctaggtagcactcagtgtttacagtgtggtggtatcaacgggtaccggataaactagagcgattcatattatgtggatcaaactaaacgattagacatgcaggaaaatatacaaaatgaattcttcttgaaaggggagaattgtttcgattttaaaaaatagtcaattttgtgcttttattgcaaatatggggagatttttcttttttacttttttttatttttcagtctttgtgcttttttatttttcttttttcttttcaaaaacacaaattgcattttcaaaatatggccaatgtgttcatcaagggggcggttgtgaaatcaaggtggtaatttaatctatgtgattaacaaactgtcaaaggtcagtgtttattgaaaatacggtggatagtgttttcggtcggtgaacagtgcaatcggcactagatggccaatcagaccgagcaggtgccaccggtcataccagaggtatgtgggcgatctgaccaggtagctcgccggtcagaccggtagactattgacggtcgttatagaccaattttgaccttcaatataatcggaataatagagaactagctatgcttgcaatgcatatttgttttagaataatctatctccacttgtacttggattttatttgtttgtagagattaacacaaatagaggacaatcgatggaaattaacagaacaatcaatcaaaatccatcgagaggtagacttatggtagataggactctaaacccattaaaataatattaaagggcccaatcactacacaactagaccgaggaatcaacgaggagcgcactgaccaatttctaggccatttgggccaggc

SEQ ID NO: 68447 - DNA, 4045 bp, Oryza sativa
cacagtcatctcttttgcaaactaccatgtgagacattttttactgacataaatggagcatttatttggtagatggaatgttgctaatccccagtgtagaggcaaaacaactatggtgggtgtatgacattttttgctaacctccaatgtagaggtcaagcatatatggtgggtgcgcatgtgtgaccttgattaataaagtacgaaaacaatctcacaagggtcacaacaatttcaaaaaactcaatgcaataacatgtagcatatttgtaaaggttttttcattgtactcatcatatggttttggtaggaatttttcatcattgaggaacttacaaatttttcattcttttgaaaataaggactccggagttcaagtatcgcttggagaaatatcatagagtctctatttcaccatctcatatcccgtaacaatttagacatagatcatgcgtgtgcaacccacaagtttcaagttcaagacaaagattgttatccaacaaactcaaaaacttaagcaaagactaagttataaactaagcactggaggaaacaaaatagagaaactattcattatttcaactattagaactagagcattcttaggctgagttctttctcccgctttcccaactcacatctctcgtttttcgcgcgtatgcttttcaaattgataaacggtgcattttttgcaaacattctttatacgaatgttgctttaaaaaatcaaattaattcagttttgaaaaaaaattgctaatacttaattaatcacgcactaatgcaccgtttcgttttttgtgtggtagagatggttcccaacccgaaggagcaaacacagccttactgaatatggaaagcacatatttttggtatttttaacttttgcaaatttttataggtttttctttttaaatgcaatgcattgaaatatatatccaaattaccttagtgtggggatcctcctccaagctagggattgaatccctttgactggaaaggccaacatgttagcctgacttttctgtacggtggcgctgatgttcaccgactggccatcggtatgctgctgccatgtgtgggtctcatggacatgctgttcggtgggttctgcttctggtcggttcagagatcaagctgtatcagagctaatagtacagctcacttcttactattagcttattttaaagtcaacatatataatatattagctataaggttggctataatttttttctcttctttctatctctttcttatacatttaatgtaattgttttgaagtttatgataagctccaacactcttaatttttcactatctctcctccatctaaatttatagtaggcttatagctcactattatactcgctctcagctgttgggtgatgtccgcaaaccctcgattcaaggtcatgataacctctacctgagaaagagcagcatgcaccaaacgacgggggtattccattatagttagaggagtggtctgcactggtaatgttgtcctagcgtctgctaggctgctcccggtggccacgactcgcgctttgctaaggagagcctccttctttatatgtttgcggtggttggtcccaaacggttgtgtgcacagctactgcggctgctgctacgactgcttatcacaccttaatttttatttcggtgatttataaattatttatagaatttatattgaagtgtacattaatttgcattaatttgcttgtaaagtaaaacttcctaaacaaaacgtggctggatttaatttttattacattctccgaggttaattacactctagaatttgctcggatttttcatagctcaattcctaatttttaaaatacaatcatcaataaagcaaatatttaaaaggaaaagtaactaagagcatgctaagattgtagccaaaataaatcttaccaaattttggtaggatttcttatatattttccaaatttaacaataaataaaacatagactttgccaaaaaatagtatggttgaaaatgacatcaatctgaacagtccctaaaaatatccaccgaagctttgggccatttttggtcatcttcttttgtaataagttcactataggtccctcaatttgttgtcgagtatgaaatccgtccctaaccgtaatcctatatcgatagagtttattcccacttagtgtatttaatatgattttcctgcaatgtggttgttccacgtcaccttgattgcttttgaactgttgatttgaacttgtatggtaggattagatcgtttttattggtctgctgctggaaaatgaaccatggtcgaggcccaccaggcgaagcatcgaaatacttacctagtagtcaccgatcaggttccgattttcctggttttttgaaatttttttagtctcttccattgcttgccgcgtgtcctgctgatttttttttacagttttccactgatttggtgaccggttgatttcctattggggtgacgtatccggtgtatgttactggtggccaactttcttcacatggtgcccacgtacgtgtcggtgattttttccattttattttacgttgtgttttacttagccggtaacggccggttatatctaacgtgccccttcctgattcgttatttcttacagtacacgcagtattatgttcttgtcgtttgttttagcttgtgagctaaggattgtttctctctccttatcttcttacagtccatgcatggcaagctacaatgttgcacacatctagctagctgcttctgcttgcctcgtgccgacatgcgcgtgctgcgtgctctcatgctgctcatgtgtgttgtcatgtgttctcttctttccaatgtttatgctcctccttgctccttaagtatgtggtattttttctctcactttattggctctttcttttgctatttaagtccgaccatctcgttgttttcccatacattcttcacatcaatatatattctttctttatttcttcagtgctacttgagttgtttcctgtgtgttgtcatacctttttccgctgccatgcatatttcttgtttggttggtgtcttatgttttgttgtgttcgataggtgtacgtgagaaatgcgatggcgggatactggagtaatgtgagtgtgcgacccggacagtgaaggggacggaccgtaggtgtggtatgaggcgacgttggcgtaccgggtgcagtcacaggggtgacgatcgaggaaccagccacccggacatcatcatggtttccttctacgtacgtactcgacatggggtccgtccacccacaccatactgcccatgcctaccttctacggtgagcgtcacgcctaccttgccccctgcagcatcgatatcgttaaggttgatgtgcagaacatcattgagacattcggtgtcgggcatggacgcatggccgtgccgctgtgttcatttcagcccactctcttgtttttcgcgcgtacgcttttcaaactgttaaacggtacattttttgcaaaaaatttctatatgaaagttgcttaaaaattcaaattaatctatttttgaaaaaaaaattacttaatacttaattaatcatgtgctaatggaccactctgtttttcgtgtgggagagggttcctaaccccagtaaccgaacatagccatattgcaggcagcttcgccaagcatgagcggatgtgtgctatgctgccatagcaccaacgaggttcctacgaccacatttgaggatttaaatgaagcacattctgtaaggctcggaaatcaatagaagaatagagggtgtgtttagttcacgtcaaaattgaaagtttggttgaaattggaacgatgtgatagaaaagttggaagtttatgtgtgtagaaaagttttgatatgatggaaaagttgaaagtttgaagaaaaaaaattagaactaaacaaggccagaacaaggtagtaggtgcgtgagtcgggtcacatgcgaggaggagcagggacgtgaagcgtgagtggcaggaacagatggcgctggtgtcgaggtctccaacggtattactc

SEQ ID NO: 68448 - DNA, 901 bp, Oryza sativa
tacacttggcttgtactgctgtaatcatgacaagacgattgtaaatatctgggctctgcaggattacgagcaagaggtctggtccatcaagtaccaggttgaattgccggttacatgtatcaggggggaacttgacgtgggtgattcttggagtgtgatggtttcgtccgaggatggggatgaggttgtggttgtgctggttgattgcggacaatcggtgctttgctttgatactgacggcaagctgttggcgcgtctcgaacatgatggtaatgacatcatggttactcgtatgaagcttaaacaaagccttgttccacatgcattctttccgttgctaaaaagttatgtcgtgaatgatttgcctttcatctgatgtctgctaaatgaagtttgagcacacaaacttattattttctgaattgtgcttttatgtatgaaaacttcttagctgaacttattgtagatgaatgtgcaaccaggatacaataattgtatttggccacatgaatagttggttcattgtgacttataatgcaaaacctactacgtcttgattgaattacaaatacgacatgtcgatagtcttttggtccaaggtggaaacaactctcactgattaatgatgaacaatactgctcacatggttttatctaaaaaaaaatgaaacttacttggtgttgcactataaacattaacctggttttttgcttgtattttcctgaaccgggatgttgtgcacatttgatttgctatgttttttacactcaagggagtgctctaatgctctaaaaactcttaatgaaatggttacggtagagcccagtgttcaatgaaatgaacagttcgcggtagttactgacagagtccattgcatctgcaattgttgggcatgtttgtc

SEQ ID NO: 68449 - DNA, 1235 bp, Oryza sativa
aggtgaccctaaaaggatatcaaactcatggaacgtgtgtaatctacctaaggctaagactatccaaggaccactattggtagtctagctaggctaaagaggactttctatgtgttttaattatctaaagtaagtcgaaggtaatttcctatctattgcttcgggcatcgacccctgctagtctgctagcatggttccagctatagctctatgatgtacccgaacgtggaggattactaggacagggttcagggctgtcaccacctgccgtctacctctgacaaatccgtgggatacataacaaacaaaggtaatctctaacctagacatcatgcctaagttattaattactactctaatacttgtgcagtaacttccttgtttatccagagtcctattactggagcacttactatgaatactcaacaatgaacccgcaaagatagaaatatatcttacttgaactaagtaattaaataacataagaaaggatcccgaatgcttactttatagaaaaagtttctccgaaccttgagcagagtgtaccgacagctccactactcctccagaattcctcctagagagctacactcatcgaggtggaattcagagagagcgccaaactttcgggcactcctccagagcttcccctcaccctctacctatttctaatgtataaaatatacaatagagcctcttataattcagctcaaagttgagtgtgggtgtctgggtgaagtgggggagatgagctctatttataggtggaggtgccttgggagtgtggagatcctccatagcatccaaagagcatatttcttctcctcttgtcaagtgtctagctgatgacagtttccaccggtgaaaacggccataatcgtcattggggagtggtttgctaccgaactggacttgggcctgagctagcggcctctgtcagggttcggccgaactcatggacattgattttgaggctctcagtccattggcatggtggttaggcccatttgaaggtgtttaattgggtttttgggtccaaaactccataagtttggatatgagtttgattctcctccttcttcatgtatatttcctttcaactttggtagtcacctgcatccaaatatataccaacactagtagaaatgattagtaataaaccctaccactaagttgaatatcatattttattccattatatgcaggtattgacagtcagatattatgatttaagg

SEQ ID NO: 68450 - DNA, 2988 bp, Oryza sativa
  unsure (1)..(2988): unsure at all n locations
ctgagtactttgtagcattatgatattggcaccgataaggccggtgacatttagtggtgaggaagtgatccatctacattattcagcaataggcggtatcacaaagaaaaaaaaatgtaggcagtgggtaaagcagacttacatataggctatatatcttccctggtcgactaatccttttaagtaagaatttataattgtgccataaaaaaagaatttataattgtagtttcatattcactatgtatgaactataatggaatgcacagataagtatagaagatacatcaacatttaacaatctttatgctatttatgggatatcataataatctaaaacaaaatatgttctccacttgtcaataggcataaagatgtcaatcatatatattcataattgtagtttgatatgtactatgtaggaactatactggaatgcatacagatatatagaagatacatcaacatttaacaatctttatgttatttatgggatcgaccataatctaaaacaaaatgtgttctccacttgtcaataggcataaagatgtctatctgatagtgaaaatgaagcataccgacaagaacattttgtcctggttgccactgttacaaaatgcgatatattcttctcaattgatgaaattggttgtaaaacatgcatgcatgagatatattaattcgtactacattctaaaaaaagattcgatatatgtcattttgtatacttatagatgtttgaagttttttttttggtgaagaaagttttaggttggaaagagctagaaacattaatggttaatggccatggtgttacgcaatgactaaagttgatataaaaagttataacctaggactggaggacctattcacaggctgcgttggcagatcatgatttctatcatgcataatcagtggagtacaggcaaaacgtgattttaatttcttcagtaacatttaaatacatatagctaggttagctatagaaaagatcagaaaaagttagtcatatacatcaatgctttagaataagagtaacttattttgacataaatcaagctgataagtccataccctaatatcagcctctcctggaaaaaccggccatccaaagtggggtgtttggaacacgtgtcattcgtctttttcatgtctttggcgacacaattatttcattctccactttataacatgtcgggcgtgtcaagaaattattcgatatatgcgctttataattattattcctatcaaagtgcgcgtgccgaacatccactacgtacctagcttatgcgacatggttatcctcattgtgtggcaatggcaatgaatctttctctatatatactacctcctccgttggacatatatatacgacccagcttggatgtgtgcttacagaaggtaagtagatatcagtcataatattatttcttcccttgttgaaatggtacttatgtgtattagtattaccactatcgtgattattgaattttgctatccatgacatttatagacagtaattaagcccacaatgtatctaaattcttgtgagcatcattccagtaagatcatgtagcgacaaaggaaagagctttacaagtactacaattttgagtacagccataaaaggacataggtgttcatccaaaatacaagttttgttcaaaactattttgtagaagaggaatattacaacaattctcacataaagtttccagtaatactatacatgaccaggcatcaaaattattgggatataatgctatttgtagtgtccaaatacttgtttaattgaataattagtacagaaaactataattaatataagaatattttgcctgttattttggacaaaattgtagattttcattacgtttagtaccgagcatatattgataatagacaacgaaatatatgctcggtttaatgttcaacatgcatggtgtggtggaattgatttctaggaacagacatgattgatccctaaactatcactcttctatatatatctagtttgtccaatgagatgtattttgatagttcttttgtggtatctatcatatttgagttaattagtatatttttactacatattatataactcattgacgatactgcatataatcattcagtcatcagtgacaaaatggagaagcgatgttccattcttgcactacttggcttagtactgctgttctccaacgttattgctgagggagcaggcctgaacaaagcgatcttttctcgcaaaggtctgaaagaagaacgcaaactagctgtcactggaacagcctcatcccttggcggtttacaagggcaatcgtcaagcaccggtgttggaggtgttagcagcaacaatgctgaaagtacaaattctgaaactggagactcttcgtcagcctacacaccgatgagtactgccaccaccacagactcccaccatgacatgtccatggatcagtatcggaagatcatccacaacagccagatgaacaaaccgtaatgaccatggattgtcccgaaggacgtaccattggtgcagcatcgtccttatacttcatggggtatcaagttatgcaacgaagtataacaagagtcttttaattaatgtatatatataaactcgggtattattatatgctggacttggcttgtataaatctacctggtgccttcggctatataaacaaatatttatgcatgtgtttcgcatgcatagtaatgtatgcgctagattatgtgtcgaataaatcagatgggagatgcccatggtttatggttaatagccaaagcaatatttgtctaatttctcttgtttttaacgaaccagaggcgactagggatcaggtgcccgatgaattgcaaaaaaaaaaaaaaaaatcgggcgctcccctcctccctactactatcattgctacacgggctgggtgacatgcaaagttttgagnnnnnnnnnnnnnnnnnnnnnnnnnnnnnnnnnnnnnnnnn

SEQ ID NO: 68451 - DNA, 1170 bp, Oryza sativa
cttccaacaccaccttctcagctcggtagagcagaatccggtagtcgccggtggggctgtgctggtacaaccccaagaacatgaatccggagatcagcgggaggtcaccgaattggcgcgtggtcgggttacagatggagtattgcggggggccggtgttccgggagatgagaaggagtccatcgcaggacgaatccaggtagtcggcggtgctggcgtaccgggcgaccggatggagccgcgcggcggcgcccctgcggcggccgagggtgagggtgaggacgtcgatgaggtacataatatcggcgtagtcgcaggcggcgatgagggggagggagggctggtggcggtggtgggcgaggaggaagtcgcgggtggatgtgaggcggcgccatgcgcggcagaccaagcggcagcggaggaggggcttggggggtaggcgtaccaggatctcccagaccacgagctcctccgggagcgggaggccggggctcaccggcggcagccctcgcgttgccgcctccgccatggtcgccgtcgcggcagcggcggtggagccgtggaaggaggtgaggcgaggcgacctttttcccttttttgagaggggaaaggcgaggtgacttgggttgggtaggagctttgaatgagccttgggccttttcctttatgggccagcggagctatgtgactaattaaggaataagtttatctgaggtctcttaacttatcaacgaatccgattttcgtcctttaaccggaaaaccagatacaacgggtccctcaactgttaaaaccggtggtctcattttagatggcagtcgctgtgcaccacccctcctcactcacgcttggagagaggacaaaggagatgggagagagatgaatacatgggagttggggagagaggaggaagaagaggggtgagaatgacatgtcggatttgttgacagttaagggacctcatatgaacttattccactaattaaatggtgattttcgtgttgagggctagtttagcacagttctagctccatgtcaaatagtttcaactccaccaaaaatagaagcggagttgggtagagttctctcacaaaataaactagatgaatggagctgggtttaggctgctacacaactccacttcagacccaactcctgtagctaaattca

SEQ ID NO: 68452 - DNA, 984 bp, Oryza sativa
tacactcttagcaaggcagagaaggaaagtatgtttgaatgcttggagagcatcaaggtaccgtctagatactccacgaatataaagcgaataataagcacgaaggagaagaagttcgcaaatctaaagtctcatgactgtcacgtgttgatgacacagctgttaccagttgtaatctatcatcgatcctgatagattagaagccctgcagaatgatgtggtgcaatgtcttgtcagctttgagttgatatttccaccttcatttttcaatataatgacgcatctgctttgtcaccttgtcaaagagatcggtattctcggtactgtgtacctacacaacatgtttcctttcgagaggtacatgggcgttctgaagaggtatgttcgtaaccgtgctcgtccagaggcatgcatcgccaatgggtatggaacagaggaggtcattgaattctgcgtagaatttatcgaagaccttcgcccaatcggggtacctgaatcacgccatgaagggagactacggggaaaggggagtctcggaaggaaagcaataatgatggtagacaacaatttattctgtaaagcccatttcacggttctgcaacaatcttcattggtggctccctacatcgaggagcacttggctttagttcgcgccagaaacatcggtaagtccgatgcatgggtaacgagacgattaaccaacaactagccttcctggcgaggggaccatctggcttgatcgcggcattccagggatatgaaatcaatgggtacacattctacacgagggcccaagaaatgaagagcatgaaccagaacagtgctgttagtatcgatgccatgggacactgatggtacaactggcacgtattacggtgccatcgaggacatatgggaactgtgactatggaccttttaaggtccctctgttccggtgccaatgggttaggttgactggtggagacataacgattgatgacagtg

SEQ ID NO: 68453 - DNA, 1706 bp, Oryza sativa
  unsure (1)..(1706): unsure at all n locations
tcatctaaaaataccagcagtataccattcatacctcaagttgctggcggtagaatgaacagtgccgagatgagtaatatctctccatggtttgcttctgcacacccttatgctcctgtagctgcacagccatttttaccatctagaggagaacagcctcacccagttgagacagctgctggaagtggaacccagaggatcattacatccttggcagatggtgtccagcgtggaagtgatccctgccgtgctccagttatttctacttcaccaaccatggtttttcatcctcctgcgtatcaatatgcaggattcccttttactcctggtgtgcaccttcaagcaccggggttttcaattggctcgacatcttatgccaattcagcacctgcaggagttccatattttcctagcattgctccaacactgttagggccagcaggtgcattacctgctcaacatactaggcaatatgcaataaaccttcctgaaggaagcagcactgttggacacgacagtaatcggaaatggggaaggcagggccttgatcttaattctggccctggaagtgtagatgcagaaataaaggacgaacgagtatctttaccagttagacaaaatttaatcacgccaccacatgcctttggggaagagcatacaagaatgtaccaaatgccaagtgttggaataaagaggaaggaaccagaaggcagttgggatgcagaacgttcttcatacaagcaattatcatggcaatgagcttttaactgttatcatttctcatttcacagtgacttcagcttccagtgagcttgtatgtacttgtattccgtctccaacaacctgcttgtttctcacttgcagctccttttcttttgaaattaaggtacggtgcttttatttgcagaggcaactgcatgtggaacttgggctctggtgtgttgcacccttgctggaatatacagttcatacatgaccctgtgatgatgtgaattgtgagaggaatgatactttgctgtaaatgttcatcatatttcatactttcctggaaacatttttccttggcttcagcagttgcactgctagattttcgtagctgtcaggcatatgcttctaatttgctccgatatgactggagatggaatggtatagccgtataggtcctgagccacaacaaacatctgaagccgttgtaattagtccagcttgtttgtttaaagtttcttatgacaaaccattttcacattgttgggcaaatctgcagccttacatatgattttagatgtgacatgtatttttcgtgtaaccgttgcatcagtttgctcatgtaactttatggactatccagtagactgtctgcagttcccgaatgcttgcaaggggcattctggtgtaaccatctctgccttgcagtcataagaaatttagtagaccaagaaataatctatttctgtatctttcgttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68454 - DNA, 1118 bp, Oryza sativa
tgcagcccaccattttttacaattagagcaccaaggccagttggatagccaaatatctgcaggtttgccaaagatatcgatatcaattggtgacttctgtaggaccaagcatttcaaaacacaacaggtgcatgtggattaccttgtagaaggaacatacaacaaaatcagcaggatacacagttaaattcggtggttcagtggcacatccttttgcagcatctatcagaaccatccatttacccctatattaatgcatttaataagcatgctaaagacactagagtccaaggaaaacaaggcaatgatcctgcaagacaaattcaatgcatcttactgctgctgcaatgggatttttccttccttgatgagcttaaccaagctcagactgaacttttgtcctgaaaaattgcattctgacgggaatgcaaatatattccaattgttccctacagaagaaatgaatggggagtgagcataaatattaagcatcgcactggaattaatcttccaaatgagagcaaaccaaaagttttgctatcaatatttctagttatccatgttcattccacattgcatggtcatacaatatgaccatgtcaaaccaataaaccaaataaacaaacttcttaaggaaaaatccaggaatgataaatgtgttcccagttaactccctcataaagaataaaagaaagctagagaaaactgaaaacatcattaacagattggaaataagacaatcaaattctctgtgtaaattctacaatattgatcaataattgaacctgatcaagaatatgttattcagcaattgtaaaggacaaaaataaaaatcataagggactgacctgaaatatctgaaagacttccgttctgacaattgtgtgaaagcacatctttgcttcttctttggtttgtgcgtcttgaaatcttatacaaactataacttccattgtcttttgccagatcagcaccctcctcaacatcaacggccaacacagtagctcctttactcagagcatatctagaaatttgctaagggaagacaaaatttacaagatactatgtgccaatgtgaatttcatgatcctacacatagactgacaggaataaatgga

SEQ ID NO: 68455 - DNA, 1824 bp, Oryza sativa
gctctcgtctcaccgaggattaaaagaaattgtggcgcgcgtgtggcttcgacgacggcgagaggtgagcggcgcgaggtagacgacgtaatggctcacgcactcttcggttcggtttggttttcttcggttcttcgagattctggttttttttttattcacaggagaaaaatataagccggattaatttctgttggaaaaaacaaagaaaaaccacgcaggcgttgctgcagtgcagagggaaggggatggaagtaaaagatggaagttgggaacggccaaggtgaagtacgacaagtctacaacctgagtttatctagtttttttttcccttgagtactctctcctccatttcataggctgtgtttgcatccctatgttcccagcccatctccctcgttttccacacgcacgcttttcaaactactaaacgatacgttttttgcaaaaagtttctatacgaaagttgcttaaaaaatcaaattaatctatttttttaaaatagctaatcaaatttgcttaaaaaatcaaatttgcttaaaaaaatagctaatacttaattaatcacgcgctcccatcactagactccgaacacagcgtggagtactatacactttaattttttttctttaattaaattttaggcttgactaaaatttaggtcatcatcatcgattgctcatattctgtaataaatcaaaacggtttactagaaaataaaaataatttattaaaaattattaaaagtcaatacttaaaaagaaactacgttaaaaatatttaacatcttattcgttaaaaaaagttaagtgttttatagtattaattataaacgaagggagcacttaagaaagaaaactaaataaacgaaaaaaaatgttcaattattattccttatagtttttcggtttatttctgaccacctacaggacgcttccgtagattaatgacgttgaaactgtttcttaaacatgtaaaaggacatgcaaacacgtatgccacatgcgccacctacggcgtgctgcgtgcacggtctcacacatatgcttatcaagtgcgtcaaaattgatttgcaaattgcaacattcaaggacacgcacccccatttgtcccgttggcagtgacgtgatttcgcagcgttctatcgtaaatgccagaaaactagtaatttaattttgatctgattaatgtcaacgaaaaaaaatgtgtcttatgataaaaattttcttagcatatgtttggtttcgggactaagtgggatgggatgaaaccatccctgattttggagttgggatgattccactcacatgtttggtttgtaggatgggataattccaattttttgtttggttgaaaggatgaggaagagatgggatggacgccgtttgccatcaccgtcaacgaccgtcgcctgcgccacctgcatccacgcgtggaacaaccggatcaagcacagcggcagcagcaggacggccaccaccgccggagcacccaacccgctggcccaccgtcgtcgccgcggctggatcgggagatcccctgcgccggatccgccgccgccgctctccctacctccaagtttcgccgccgccgagtcccccttctctggatccgccgccgccgccctccctacctccaagcttcgccgccactcgagcccgccgcgtcgacatcaccgcagctgccgcaaccgctctcgtcgagcatcacgatgagcggcgggatggcgccgagcatctcgctcgcggcggcgaccggtgttaaggcaaggggtcgtggaggagcgcctgcggtcgcagaggtggtggcaggcagtcatggcgg

SEQ ID NO: 68456 - DNA, 5204 bp, Oryza sativa
cattaggaaaattaagaagtgtgcacacagtaggtgaattgcattgttatcatgacgtccagatgggcaagacacaccattcactgcatgtgcagaccaacataaccactacatcctcgccatacttatgtattaccattgaccagtaacacctttgaatacatattcatggatgtatttgcctggaaaaattgtagaatgcctaaaacagcatggtgttactcctctaaacgatagacaattgatatgttccaaaatagtaagagcaatctaggtcacttgttcacaactttgtgcacacctgatacatatggaacgcacattggtaaaacaaagatgcccacatgttccaatccaatcatgaaaaggaaccctattttatagggcagattaacgttagcatgttagcatccaagttaactcgaaccacccaatacaactctcacgtttacttaaactttcgtcgtgacatgtactagactaaatcttgaatgtcccaagcaggcaggcaatctaattactctgcatagatgaaattttccagatagaaactaataaagaacgaatcgacaacaccaacaaattacaaagtgtttccacaaagtaggcacctttacaaaggagtcgggtgacacgggccttggagaatcgacccagtcctggttatgagccgccgctggaggagtcgtgggtgccggcagacaaggagtcgtcaggggtggaggaacaggtaagcggggaggaggagaagctggtccctgtgccggtggtgtagctgcctctacacgagttgctggccacatgccccgaacgagaagccgcctgttgccgcacccctcaccaccgccttggcgtcgcccatgcatagccccgcatcttccccgccaacaatcccgcctcgccgactcccggcgccccgctgcaccatcaccagatcgccgccacaggcgacttcgcagccgccggccgtaaccctagctccgaaaccctagatccacggggccttcctccatgaccaagcgcaccgcccgaattcgcctcaatcccaatcaaaccccagacgaaacaacctccctcctcccggaggaggatgaaacagcgaaccggagtcccccacgaattcggccgaatcgacccccaattacggcaggattcggtcgggaaattgggggattcggcagccgcgcacacgggcgagctcggcgacggctctggtggcgatccgccgcgggggggagagagaattcggcgattcgggatgggaggggagagagagagagagagaggaggggagaggcggaggggatgggaggagagagagagagagagagatcgcggcagagacggcgcgcgagcgagcaagcgatgtctagagagagagagaggaggggatgcggtgcggtcgtggttggagaggaaagcagggggcatttccggggatcggctcggctcgcgcatggaaggcgtgggtgtggtgcggtgcgggtgggcgaggtcggttgcttggtgctgtcactgggggtggggtcggtgccggtttactgtgcgggggttgtgtttgtgtgctcttttcctcgggcgctgacatcgacgtgggagattgctggtaccataacagtactactacagtcgtatggcttatttggatttaagctgtattcttttcatattaaaaattcggtaacatagatagtgttacatgtagtacacgtttaaatttgttattaaattcagtctagtttaaattcaatattaccaaatttagcactgctaatattttaataggataaattgggttctaactcctaagcgaacaaaacaaacatgtttagttcccaaaacaaaaattttcatgttgttgcatcgaatgtttggatatatgtatggagtattaaatgtagataaaaaaaatcaattgcacatattgcatgtaaattgcgagacgaatcttttaagcctaattgcgtcatgattcgacaatgtggtgctacagtaaacatttgctaatgacaagttaattgggcttaataaattcgtctcgcggtttactagcggaatctataatttattttgttgttagactatgtttaatacttcaaatatgtgtcggtatatctgatatgataaaaaaaattacccatctaaacaaggcctaaatgaattttcttttgatagtacgacatcggtacatggctccaaagaggatagtacattgatagtacatgctgctttttcaagcgcaccatggtcatttattataatcgtggcatcatatgtacatgtatatacaattgtcaaaacaaatggcgggtgctcaagtggagatcgtgaggttgtgtggtgttgttcggatcgatgaaagtatcattccgaatgatgcaccaaaataggagtacagttgagaagcagtggcggatccaaaaaaaaatagtagtgagctctgagcaaattagatagagttacagttcattcccatctacatatggtaaaaaaaatttagcagagtcttcgtggagctcttatagtcttcacaccagtgtaggggctcgagactccgccgcccccatgctggatccacccctggctgaggttgcaaaggctttgtttcattttgtagatcatgttgatctcaagtattacagtgctcttttggtagttactaatactatgttgtcctcgttgaggagtttccgttgatattcatccggctgaggtctgttccaaaatataataacttttactaataaatttagataaatatatatatatgtatcttaatcatagcttataaagatggtgctcctccttatggtcatgtgggaatgggatcaaatggagagcactgagacagttccgacgtaactgaagtcacaggcctaccaaggatatatcacgagctgacaatatgacaagcagagccctgcggaggtgcggtggccgaggttcgttgttaccgccgccgttcgtacggagcagagtttggcccactatttccagcgtcgagttgaaatttccggcccgcgagtggtagttggagtcacgtagcccatccggccgtgccccacgccaaatcgccctatgatcacgggccacccccgttttcttggcccaccagctgcatgttgtcaaggcctgaaagtctacaaactactggaacaaaccatcgatgtcacgagccaccgcaaaggctcatggtatcacggtgcatttaccactttaaccagctgggaactgggaagtagtagtactgttccccgcattgcgagagaagcgacaggaggaaaatcatgttgtcactcacgctcgccgtggggagcagatggggccctgatcctaggacagcaacctcctccctccttttcagagtgtgcgcatactttctcctcctttccgctctctctttcttttatcacacagagagagaccaaaggggaccaaacattattcccccactagggggtagatctcccgtccctcccttccctcggccatgtggtggggtcacccgtagtagatctcgcttttctgcatggttgtggggcgcggaatcggatgggagcgaaacgatttcagtgggtgtgggtgcccgggcgtacttctccctccgtttcacgcgatacaagttattttagcatttctcacattcatattaaggattatctatacaacattcgattaaaaattagcctaaaaatctatcaaatgtaactgtaacataattacaatgtaattttcataattacactatatttatactataattacatatgtaaactcgcatgtaattatagtataaataagatgtaagttcaatctagatcataaaaatatagtagcccaatgggttagtcacgccttcatcccatgaggtcacatgatctatccctaaatatggttttgtttttcttcctaaaagcacatatcttgatgcgtattaaactgttagtatgaatttaggacacatccaacggtttagaaagtgaaagatttagccataaaaaatctgtcaacaaatatttagcaattccgtttatattaatgttaatgaatctatataaatatatatgtctagatttattagcatcaatataaatatgagaaatgttagaatgacttacattgtgaaacgaagggagtagtgtactggtgtactactactccaatgcggtgatcttctctagtgtgtttcggtttcggtggcgagccacgcgcgtcttccgccacctgctgcctgcctcgtcgcgtaaaggttcggtcaaacatgtgaccggggaacacatttggccattttcgtgccttgtgggtgaaatgattcagcttttgctattgtgaggctgtgtttagttctacgttaaaattgaaggtttgtgagactgtgtttagttccacgttaaaattgaaggtttaaaggaattagaacgatgtgatgttcgatgtgacgaaaaaattgaaagtttgaagaaaaaagttgcctgagtcgcaaacatggttgaccccggattagtatcactactattcaacacatgaagaagctcagagtctgctcagaatttccacttggttattcttattcagtgacgtggtgatcagttattaagccatacgcacaagttataaaagtcagtagtccgaagtgagatgtttccagggaacttttgggacagctggagtatgaatttcttgagtttacggtcacatcgcgagtacattagccacagccacgtaaagcaaagagctctatcacgttcacatgcatctcaaggctcaagctgcgttaataattcaagtgggaggagttttccccaccaaccataccgtaccaacaaacaaaccctcgctttctaactttgacaaggtaaagcttggggggccaacgcctctctctaccacaagactccacttaattatgcccatgagaaaaaaaaagaaagacatggagcacaatttcctcccctgaaaagaaacgcaattgtgcgcttgtgctatattggtaggtttaaagcaaatcctgttagtgagagaaaagtactgtctgcacagtacaagttctcctgtctattttttaaacaggctgaatttatgctaacaattcgaagtcaaacttttagctttaaactctcataacagattgctagaattatttattgcaagatccgagcccggtttagttagtgggggtcatgaatgtacaacttctttattat

SEQ ID NO: 68457 - DNA, 4007 bp, Oryza sativa
agcggttgccgctgttgcgtgattaaagggggcgtccagagctcgtcacatcactctcctgttgccttcgtggcttcgtgtcagctagcgagtgtgccccgcctgcccggggaccgcgacagcgaccgtccgtgtcctttggcttggcatttcccttccgtttcgtgcttcgttttctcttccccttcggctcgttcaattgctcataggagtataatctttctttggctttcctgatttcctcgccaggttagagaaatttgtacagtagtcagcagactattttagccaggttacagaaatttgtacggcaatcacgaatcagcagactatttgatcattctatggtcggaatggaagtaaacattccgttgagttgatttttattggtagtattaattagtagaggaatcaggttaattaagcttaccaagaactaaaagacacgccatacataatcgagccagccagcaaggagctagccacagcgagatgtcaggaaatatggacaacagcattctagtcatcaaacatctacacagtaggaagcgtcatggacgaggacgaccaacaactttggaggtaatcaggtagaggaaggcatgcagcaaataatataaccacctgcatattgaactatttcaaaaacaaaatatttttttgacatgaaaaacaaaataatttgcctcgcagaaagcgcctagaaaccatcagcgaacctcaatgactgaaaaatagcaacagatcattgcttatcggtccactaaatttcttaaccattgcaaggcaccgatggatacaccagaatgcgctttacaggcattcaggaactgcagatcgagtgtcatcccccaggatagtccactagagttacatgggcaaacagatgtaacgtttccacataaaatacatgttacatctaaatcatatgtaaggctgcagatgtgctccaaaaagagaaaattggtctgtcataagaaactaaaaacaaacaaactgaacctaattacagcggcttcagatgtttcttgaggcccaggacctataccgtttccatctccagtcataccctcccaagcaaattagaagcatgcctgagtccctgacagctaagaaaatctagcaaagcaactgccaatgccaaggaaaattgtttccaggaaagtatgaaatatgaacatttacagcaattacatcaaagcatcgttcctctcacattcacatcatcacaaggaaagtatccatgtatgaattgtatattccagcaagggtgcagtacacgaacccaagtaccacatgcagctgcctctgcaaatgaaaacacagcaccttaatatcaaaagaaaaagagctgcaggtgataaacaaagcaggtcgtttaaggcgagaagcaagcacatacaagctcattggatgccgaagtcgctgagaaatgataccagcaaaagctcattgccatgacaattgtttgtatgaagatcgttcggcatcccaactgccctctggttccttcctctttattccaacacctggaggcatttgatacattctcgtatgctcgtccacaaaggcatgtggtggcgcaataaaattttgtctaactggtaaagttactctatcgtccttcacttctacatccacacttccagggccagaattaagatcaagaccctgtcttccccatttccgattattgtcatgtccaacagtgctgcttccttcagggaggtttattgcatattgtcgagtatgctgagcaggtaatgcacctgctgggccaacaagcgtcggagcaattgtagggaaataaggaattcctccaggtgcagaattcgcatatgatgtagacccaattgaaaaccccggtgcttgaaggtggacactaggagtaaaagggaatcctgcatactgataagcaggagggtgaaacatcatagtcggtgaagttgaaataactggagtccggctgggatcacttccatgttggacaccatctgccatcgatgtgatgatcctctgggttccacttccagctgctgtctcgactgggtgaggctgttctcctctagaaggtaaaaacgactttatagctacaggagcacaagcattggcagaagcaaaccatggtgatatgttactcatttcagcactgttcattctcatgctagcgacttgaggtaggaatggtatgctactggtatttttagatgacagactccttggtgcatgttccgtaccagcttcatcaagagttggtccattattaagatcaaaatcccttgagctatttgcatcggaactagagaaactccaggtaatggtcttgataataatgggacttcaaccctgtggttagtgttagacacaatttgcccattctctgcaacttcatcggccctattcaagtcaagctcaaataccaacactacgtacaggaccattgcttcttctagtgttgccagattcagaaccagttgtctgaacagaactctgagagacgtcttcctcaagaaattgctcatctgcaacatttaagtcaatgtcaagtgctgggcggtgtttatctgcagcatcagaaactggaatgccaggtgcgctgagagtcatctcaaaaattttccttggttctgcaggacgaaatgcacttgtggctgctgaacctttccagccagtctcaggctgaaatcttagtaggttctcaggaggaacaaagggacctttagctgtagcagctacttttatcggagcaggtagcccacttgacataggtgatataaatggagaaagacaaggtaaattaattgcaaagaacacacagcaggagaggtttctgcctcagactgatgcacgtcgtctccaggtattccttcattcaagtcaaaatcaagcttggctgtagcacttggcctgatcttggcagcaaaagaagaaccatcatctgatgagacaaggtcctcgttcccacttgcatcatcactcgacttctttgagctgcgccttgcactacgttcagtatcctgtgagacagtagttccaggtcttgcatgactacttgattcactggaattgtcttttaattctttagaactaatcccattttctggaccaaatggtacacctgctggtacagctagttttgtagcatcagctgaagtggaagaaggttgttccttcttttcatcctctctcagcactgcgttaccaaccagcaaaccatcagccttattcacctccacggtcgaagatgaaaatgaaggctccacatccaatttaacagcagcactgtcaccagatcggtcatggcttctgaattatctggtagacactggcgattcttctgatctgttgactttaacaaaccatgagattgtttatctccaccacgtaattcacttgtagtagatggatatatattcaattttgcgtcaatcttgatatcaactggctgttttgtgaccgacttgtcaccatcaccacctttatctgtagtcctcacttcatgattttcagtcttagcaggagattcaacagccttaacatctattccaggtggagagggtagcccagaagatgtgaccttattgtcctttgcatcccctaggtgttgttcctcctttgcgaccaaacctgcaccaattttctcacccttatcagagatgattttctcagcatcatttgttggccctgcatgccgtgacaagcccatatcactttgtacttttagcttcccaatgttatctccttcacagccctcttcatttcctggtgaatttctaggtgaagcagatgaagaaatcaactcagatttagatatttctccagcaacactggcaagaagattcattgctgtatcatctccagcttgcaaggaatgactagcttcagagtacttgatttcaatcaaagcattcatagggttgaacgaatttctccccccattttcacttgagcaagccgcctttcattagcatctgagcaaacaactcgggaagcacatgcatctttgc

SEQ ID NO: 68458 - DNA, 860 bp, Oryza sativa
ctgaccatatcacagttatgcaaccgaatcagctctaatatcccagaatcatatagttacagaaacacttttgtcttctaaaatgagaatccaggcatcgtcgacaggtatgtgctaaagtcattcttaaattagaatttagaaatgcataataattgatggctgaacattcaatacaacagaagctatagcaaagggtaaaagagagagttagcacagtaatggttgtactaaatgttaaacagtgaaataaaatgagcattataacttagggataatatgctggattatcttagttcagtttattcagtagactggtttggtgttatgatgtgtccatccttggaaaacatgtttgtaataagtttgccttggaatttcaaaaaatagtcaatatctttaagcatcaacctttgatcatattcaagcacagtttcagatgttttcttgagttaagacaccacatatactaacagcccaggaaaactgaagggaagatccccctatccaaatactactgttagtataactaatccatgcaacacttacataagattaataatttggaagctttagtggatacgctgttaatttattttagtacatacctaaacatccatctccgatgacctactagatttgcaaaaaaaaattataagatgctcaggtaacatacttacccagaatagagaagaatatcatgaaaccagctgatatctgcaccactcttcggctaccaacacgtgtcaaagctagcaatccagcattttcactacaggtaaggaaaagaatggttgcatcaaatgaaattagatgtattctaatgagaatggaagctgtaccaagatgaacataaagat

SEQ ID NO: 68459 - DNA, 742 bp, Oryza sativa
attcctgcagcccctccgggtgattttttttcctttagtgggacccaccttaattacacacattgtggtggtttctaaaactatggactcccatgtgtgggtaccacatctatggactagtttgccaaatacattggtgttgccctaattgaaagaggaaaaaggtagtacaagggcatatataaatatatgatgtctaatcatcggtggatcgatcgatcgcccgtcgaattgatcatgcagctcgagagaattgcggacacgtttagactttggggacttgtaaaaattaaagcgcatgacagccgaaaagctagcaaacagctagcggccattgtcacactaaaaccatgtgaggttaattaatttattagttatatgcactcctcgcatctcatcttataagtcgtttgatttttctattagtaaaattattttaaattcgatcaaaattttatagaaaatatagtattattttaaaaaacatattattaaaatataataatattagatttaataaaactaattaaatattttaggtgattctaaatttttctataaatttagataaacttaataaagttaacgaagggagtatagtacaagcatgacaagctaactagctagttagggcacgtatagtctacagactgccctgatactggttaagttatctgattaacatatttatataacattctacctactttctttgtcttaattggatagattaacttatcta

SEQ ID NO: 68460 - DNA, 12892 bp, Oryza sativa
  unsure (1)..(12892): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagctctctcaaactaaatccaccacgcttgatgaattcaacttcctgaaaatacacataatgttaaggaattgcatttaatcttaacatgatgataaatgggcagtacatattgctttcaatatcttaataaaggatacataggaactgacagaatattgagatcccacaagtggttcaaatatcaagacacaaagatcatcttcattgtcatctccattgctcgttgtcttcttgtgagggttcaacgttatctgacgtgcagctacactggaacagacgcacttgattaaaacataataaatattaggaacttggcagacattggatctatgacgtggataaagatcattatgctatttgcagggagattgtatcagaaacactgatgataggaataactaggaaagtgggagcgggggctgcagggttaaggctttgaaattagaggaatccataaagacatggataaagaaacattactacttatagctacaactaagttacatctagacagatagaaatcatgggccagagatctaatttgtgcagcctagaagcagagaatgaacatacatacataacaaagatggccacaagaaaacgtacacaatacagatcaaagctgaaacagtactgtttgtggttgcgatgaataggacaagatcaccagataatggttatggtgaagtgaataacagccagtttcttttgctaacctgttccaagcacgcagtagcatctcagagccgccaccaccttgttctgcctcaagtccgatatgtgttacgagatcaacaataaggtctgataagctacaagttgatggtacattaaatttaacgaccacctatcagaaaaagaaacaagttgagtcagagaaaattaacaataattatcaaatgagcgactgaagattacacattgttgtagatgctttgccaatggcagagagataagctatgcaactgccagaactgtaatcagaataggcatgtcaaatccacaaccttcattgttgtgatctagaagcaaccacgcacaattacaattttttttaaaaaaaaaatcatacatcacattatccttgcactgatactcagacttaactaactcaaattttagtgtgtctacttcagtagtcacgacaatacatcccaaatccatatatcattaatcactgaatcaattgctccaatcacacaaagttccaaaccaactctaaagcctagtggcccaatttgatataaagtgtaaaattaactcagatttataaaaccgctgaaaaaaaaaagatattttccagcactaacaagcaacagtgatatggcctaaatgtttgggagaggaggacaaccttttggcccttcactgccacatcaaattgcgggtatgacccgtgtggcatccctcggctctgaatgagctctattatcctcttcctctccttatgggccagatcctcccccaccgccacatcagagctcacagccgcatcagggttcacaggtttcacagccgcatcagagcttacagccgagtctacaacgccctgtaacacaaaatcaaactcagcccgtgcaaaatctcacctccaaaatgccgccactaaaatttcaaacaggaaaaataaacaccacctcattggcatcggcgtaggccaccggcagagacgcgagagcggcggccgcgccggcggcgaggaagccggccgtagtgaacgccgaagcctcacgcgcccccggggcacctggtaccccattcaaaaaccctaaacgtgatcccagcgcgtgggaaggcgacgcggcggcgggacggttctggagaggcggcggtgaggaggtagtggaagccgccgcctcggcctgcagcggccggaggaggcgggccagcgggaggcggcggcggagaagcatggccatgccggcggcggaggcgtggctgggtttgcgatttcgaagctcgtgtcggctcgctcgagaggctaccggagagttcgcgccgcggcccgcggggttgttttggcgttgcgtttttgcccccccgcccacgaaagaacaaagcgtaacgcagaaatacgccttcatgtgattctccaatttgctcgctctcgctccgagttccaagcaggcccaaaatgggcttaaactatatgggccgaatcaacaggcccagaactataacgggccacaagcctgcagttcacgagcccttacaaaggcgcacacacatacactatctcaacgagcacctcagctagcgtatcttaaaattgacgaggtcaccaaagatattttagtggtacgtcgactacaactaaaagaataattaatcgtaaatgcgagcacatatgttaagtataagacttaaaatctaggtgaacagtattacagtacaccacaaaaaactcaactagttgagctatactcacttcgcaacctgatagtttattcaagagtttatttgcaggccatttggccttagtttgcaacttttacatgcctctaaaatgatgtgattcgtctattgtatctctatcactctcgttctaaaaagaatcaagagtgcaaatatttcttttcctcttatagctaactttagctgccggcatgcatcatcaatagtacgagtacgtgtatagtattgctacgatatatatcaagatgaattagcgtaatctgcatcaagaagaaacaagctgcttgaagttaatgggcgaggcgaagcccatctgcggcggcgcggagtagatggcggcggcgcccttcctggaggtggcctgcgtcccgtgcaccccgtcccagaacaggtacccgttgcggttgccgcagtaggtggagttgggcgccccgcacccgacctgcgcgttgagccggccgccgccgcagcacgcgctgttcaccaccttgaaccccgcggcggccgggttcgccgtgaggtaggacaccacgttgtacgagctgccgacggagtacctcatccccgggagagcaccggagccggcgagcctggccatcgccgacctgagcccggagttgaaccccctggcgaggtcgttggcggcgtcgacgcacctggtggcgcccgcctgcgaggtgacccgcaccgacggcacgcacccgatgggcggcacgtcgatgatgccgaaccgcctggcgcccaggctgtacagcgcctggacgtgccgcgtgtagttggacagcaggtcggcgtagaaggacggcacctggctcgccgtccggttgctctgcctcaggaacgcgaacaggtcgttgccgccgtcgctgatgaggaagagagacttggacagcagatcgtcgatcgccgacgccgacgccgacgagctgttgccatcgccgccgccgttcgacatcatctttgacttggtggccgcgaagtacacgatttgctttgtcagcgtgacgacggttgtcccctgatcgatcgacgagtacacgaagataatcagacacacatgtaccaagatcggtcgcattcattcaactatacactcactcaaatactatattaaccaattattgagtacaagaaaaggctaccagtagtaaattccttgcacagtttctacaagaagatgaaattttcttgctgtatccaagcatgtccttacagtggtatcgagaatgccggatcctccagaagcgtaattggcgccgcggtagcctcgcatgagctgacggctcgtctgcggcgtcagcgacaggtaagccggcgggctcctcttgaatcccaccagtttcgctgaaccaattgttcatccatgcacacacatcgtgagttccattattagcagaaattttacattgctccaaacaatttgaggcgaaatatgcacggaccgatgaagtcggcgacgttgtagccattgctgaaccttccggtgggcctcgagtgcgggaagtcgatgccgtaggggagctgcagcggcgagttccccggcaggtactggttgttcccgacgtccaccgtcgagtcgccgaacacgtacaccgccggcaccaggtgcacctcctccctctggccggcggccgccgccgccgccgagatatgcacgccggcgctgagaacaaatgctaccaccagtatcgtcactttcagcctcatcatagcgcctgcagaggtaggctgtagctatccaagcgagaacaagaatctactgtttatgtgtggattcagataggtgggattggttcctttgttcttcagcgagctgctacgtagcaactgggtaatattactaagaactttactgccaaaaggatgaattgcaactcaaggtagctagcagggtgcagggaatatgtgcttggaatggctgtggggcaaactgcaggtgaccacagtgaagaagaagagaggcacgctgctatcaatttatacacacacaaagtggtacacgtatcgtatccgttcataacaacggcaagcggccgctgcatgcgcttccgcttcccacgatttataaaacaacatctactttgaagaaactatggtaaaaattacgtattaaaattgatgtaccataaaaatatagatttagtatcaaatttgttatgaaactatagattcaacacaaattaaaacaacatactccctccgtttcacaatataagtcattttatcatttcctatattcatattaatgttaatgaatctatatatatatatatatatatatatatatatatatatatatatatatatatatatatatatatatatatatatatatatataaaatactagaatgacttacattgtgaaacggagagagtatttagtaaaaacaaattacggaactaaagatctagtgtaaatttaaccaggaaatataacattcaatataacagtggtgctaatgataaaattttagttatacgatatttggtcttaaatatataattatatgataacattttagttttgtgatacatggttttaaattttgtagttttataatagtttaaacaaagtaccatgattttttatactaggtggcgagaatataagatgaggccttgggactggagatttggtttcaagccccatcgcatagatttttcttcctcccattcgcatgcacaccatacccatatcgatcagtgagacatgtatgcatagcccggcctgtgcgaggctagcttgaccatcaagggatcgtcacttgttaattttttttcgtgatttattgtcaattagccacacttcccccacctgctagctcgctttgcaattgcaagtggttaactggtgacagcgacatatatcaaaaccatgaccatttgtctctgatcgaaagaggagtccttgatacttcctccgtattttaatatatgacgctgttaatttttttgacaaacgtttaacttttcgtcttattcaaaaaatttatgtaattataatttattttattgtgacttgatttatcatcaaatgttctttaagcatgacataagtatttttatatttgcataaaatttttgaataagacgagtggtcaaacgttggttaaaaagtcaacgatatcatatattaaaatatgaagggagtacttaataggaatttaatcggtgatcagttactagctactacagtactaccacatgagagcaagttcaatagtatagtcaactactagctccaattcatttatagccaatctaatagctcattcatacaatagttacatactactccctccgtttcataatgtaagtcattctagcatttcccacatctatatatctagattcactaatttccatataaatgtgagaaatgttagaatgacttatattatgaaacgaaggaagtacactattaatacctggtcccacctatcatacacacactgtctcttagagttcgtgctacagctggctataaatctgtagcccgctgcctttctctcttctaatttatgttcttaaaatatgtttacaactggcttatagtctgttattggacctgctctgaagaagaacaaacaagacaacctcgaaaaagcggaacatgagtactacattcggagttgatctttgcatggcatgcaagcaacagaggagctagtattggctacgtacatacgtacagtacttacctaacggcgtattgggctattgcctcctgaatgcgtgctaagcactccaaatacctgtacgtgtgtacatgtgtgaatatcataagatagtcgtatatatcctacagttccatgcatatggtcaatttttcgtgcaagtctggccgtcggagcaaacacagtcagaaatatatcgatcattgaattgtactctaaggcgcatctctcagagcatacgtaatttattctgtagcaatgcgtccacacgtgcttgcataacagcatatgtgtatcgatggtgactaaactataaagtgataaggcagtcgaattatatttgaccactactcataagtcataatcacaactcatggctaataactataacaagtattttaggaactactaagatagtactgtttgatggagtatccgcttggaacagatgatgatttcactagctaccgatgaagaatcacgcaacgagtgccatgagcgccaccggcccatgccatgcgcccatgcctcgatcgttgccgttactttctataaccaaccgatatgcaaatgcagtacagcaataatcgatcgatcgatcggaaaagggaaaaaggctagagcctttgggcaagtgcctaaatggactagtggtcatccatcgcacgatagataacatagaccaatctgttgcttgcgtgcttccgtattgtcgatagaataaggatcagatcaggatatatcacgattcacaatgtggtagaccggtagttggcgaggtgatcgagcgcccccacacgcaagaaggttttatggtcgtcaccggcgtgatggtgccatttggcggtgagcactaccggtcgcaacacacaatcacaaattcgcaatgccatggcgtgtacgtgtctcgttctcccataccgttgtccttccaggcccttgctgcacatgcacgcgcgcactgctgctctgctctctgccggcctcgcataaacggagagacacgcacctatgacgtcacgatgcgcggaacccttacgtgcgtgcggccttacgctgccttcatggaggattgggcgtttgggcatggtgcggtatgtagcgtgcggcggcggtggcggagctagaaaggctagaagcatcaagctagcatggcaagttcgttggggattgggggcttcgaccgcgcgcgcgctcgtgcgaaaggatggcaacttggcattttggcaagcgcggggctcgcgtgtgtcgggtgccgactgccgaggaagttgtgctcgcgcggcgcgcgggcgcgttggacgaggattcgaggaacggaggcgtagggcgagccggcgccgatccgtccgactgagtcgtcgtcatcgtcagcgttttcacaggtgggcctaaatgataaggccgacatggccatatggccgataaggccgtcgtgcctcgtgcgtgacaaccttgttgggcccgtttctcctcagtttggtcttcgaaagcccgcatcacttgggccaagtttgcactcggtcaggcgcaggagacgcccaacccactcgatcgtccggtgccccaccgccggcggcagcgacctccgtccaagtgccaccgccggcgccggtggcctcgcagatgcaaacgcacgggaacgggacagatcgccgttgtacaaagtacaaatggcgccgccgccattgcgagcgaagggaggaaaagggcggcccgcgagctacgtgcttacgttggctctgtcgattattccagactccaaacaattgtgttatctgactccccgaccactgcttccttcgtttagggcacccgcaatagttatctacaggttctttacaagagatccatatcagcatatttttctacttgaaaaaataggaaagagattaaataaagagagagagtaaaactatctactaacatggagatagtctataaagaaaaacgagtcaataaatgagagaactatagatatacatgtagacatactattgaggtggtttactattaatatagtatattgctgagatgtacatgttttatagagagcaccttactttatcattgcgggtgctcttaggctaacataaaccaatgttttcttctcgttcctacctgcgtcgacgtgtgacacccaaatcatcggattcagtaacggaaaccataaactttaccctaaaaaaccacgagttcacacatcccaagaggtaggcaaggcagcggccacacgaatcgcgcaaaagatggccacgctggtatgccttgcatgctctcacggttacgtgccgagattctcttctgccacgttgcaaaaagagacgcgacctgtcttccctcttcagagttcagtccccaacattttttatgggacagataccagcaggcagcagttgcagttcctcaccaaaacgccatccccatcctccctgccatcctccctgccgtgagtgccttcttgcgtcgagtttgagcaaagttgaatacagtatctgctgtgttttttaggacaagttgatactgtggaggagatgaagaggttacttgttcgtgggctgttttcttctccatccaggggtttgttgggcaaatctcctgtcaggcctgcactttgcaacgatgctcttctctccagggtgagttatcttgtcctcccgcttcctgatttactttttggatctcatgccttctccatcattgtattactgtcgccaaatactccataaaaaaatactgtgatttgttcataagagggcatatttctaagctactgctcaaagccgagaggccaaaatgttcagttaacaactcagatttacggttccagtctaattgatgagtactacaactcgatttgtagttgcagtcactacgcggttgaaaatttgcaatctaatttatgacgatgtcaatttttgtagtatcgactagtgtgtttataatgttccattttcttgtaatattgtcagttcctctcaacggggaaagatgagaacacagtgaccgaaatcggagagaaggcaagatcaacagcggaacaattcctcaaggtggccaaggagaagactgacgaggtaagcgagaaaacaaaggaaacgatgcacgaaacaaaggaagcagtggtcggggagtcagatgacgagaaggagaagttcaagcagagggttgaggaggggaggtaccatcagaattaagtggctagtgctcaattatactccatcttgtagcttcagacttcagtgatggcctctgtcaaaagtcctagaacctgcagattgtccagtactactaggcttggcatgtactaggtagtatatgttgtttgtttcctcctgttcaatgatctgttgtagaatgaataaggtcaactttgaacttcatagtgaacttttgatgccactacttgtcattttcgcagaataaataagatgaacctttgtgaagctagtgaatgctgaattggatgtgcagtttgcaagaatttaactggccatctagtaaccaaaagggtataggcaaaaagagaaaaggatcggatggggatgacctatggctgtgagcatcaaatggcgatggctcaagaatttggtctgaactttgttgaaacaacgtttcagaggagagctggcaacgtctgggacgctggatcttaaaatatttgtaatactaatatagatttgcaagtagtgcaataaaacaagttaggaactgcaatcagctcatcatgcaggaagtacatggaaaaaggaaaccccaatgcttacgctgggaaatgaagatgagtgaactccacatcagctagcacctagataatagccatatcagtgggaacagatgttgtcctgtttgcttgtcttttctgcaatatgaatttcactatcagttttttcagggaaatttaagtagttaaacacatcacatagacagatcgattagtagtacatggtttctcttttcataagatcagtacatgagttatggtggtgaaattttcagctggtatcgactggtaaggtaaccattgacactgaagaatgttcttcttttttttgtttttccagctccctttaggagttttcggtgagaaattagtgttgttgaggttaaacttatccagggatcaacttacctacctacctaccatatgtccttttcctgttagtttctccatcccaatagtgctattgccccattatgaactttgaaaagtaagcatatatatgttcgtctaattcgaaacattttagtgctgttgttgtacagtactgatttggtattcaaatcctaagtatatactatccatctaattcaaaactgtactaaagtgctgaactgctgatgttgtacagtactgatctggtattcaaagcagtactggaattctgatgcggtaccattcatagtttttccttgacaaaaatatgtcatgtcgatttcactcgttatctgctttctgtgttccaccggaaatccacatcaccggcgccgacccatcgacagtcgaccacaggtgaaggcgaccgaaggtcaggtactcagccactcaggtgggagcaggttaggccggatggtttagcctcaggcaaagattcagttttgaagtgtcctcgcaaatcatcaagctacatcttgcagaacagatgaaagtgaaaatgatcacgacgcatcctatcttttgggtgatactacggtgttgtaagttgtaaccgatcaacatcaaaatttatcatatcaaccgagagcgatgcgctaaaaaacaacgaatcaatcgatattgattcacatgtccatctacatgaaggtactccctccgttgcacaatataagttatttagcatttctcacatttatattgatgtaggtagacagtctagatttattaacatcaatataaatatgagaaatgctagaatgacttatattgtgaaacggagaaagttactgtacaaaatccagcaaataagctggcatgccccaactattattatacacacatgcataagcacaaccctacgaataaaactgcgtctacctaatcaaccaaccaaatcgttggtctgacagtaaaaacagcctagtacccagcgatccccgattcctcgtcagcctgctgcttcttgccgccgccggcgttcttcttctggcatttgtccttgatccactggaacccgtgcgccgtgccctccttcaccttcctcagccccgtcgccgccgccgccttggtcttctccacgccgccctgcttcttgccgccgccgtggccgtcccgccgcgccgccgcccgcgggctcgggtcgccgccatagtcccactggtcggcccacgacgtgccgaacgagctgctccgctccatccagaaactaaacgaagatcgatcgatcgatctaacgcggtatcgcctcgagtaatcgatcgatcagggaaagaaaactgtgttgctctcctctcctcgcgaaaaattgtgaggtcgcagtttttatagtataggtgtgcacccgcgcgcgtcccgtgtacaggtcatccgcgaagaattttcggtgcacgcgttgcgtttgtacgtgaggtggatggagagcagttgcgattctggatgtgtccggagattggcggttgggttctgtggtttctcgcgcggctgccggccgtatgacagttttgaccggaaagcttccagcaatggagagaccgactggtggggccagcagtatgcctggcccacatttctgtggcgtgcggatatctggcgttgcgttgaagagtctctggagtctagaatgcgttactactttgaggtgcgagaatcggtcgcacgacatttttttaggtggtcgtccgatttgatctgatcaatagaagggctgcctgtttgacaaatctggaacgaggaaaaactcaacaagtggaacgttttttgaatgtctgtgtttggaattgcttttgtgatttctttgtttaataaggtgcataccacttgaccaatctctaaaccactggataacgtcaacaaaagcaacatgtgaaagtttcatgtgtccagtcatgacggctgaaaattttaactggctcagggaagataaattgtatatctataaatatacatatgtttacattgcatgtaattataccaaatgggtacttatagaaaattattgtgttataagaataaatctaagccattcgggtgagaccgaattatgacggtttagatcaaacaatagtgcattgtagatgcaacatgataattattaattcttgaattttaaattcattagacaaagaatttttttaaagcgtagaaaaaactaaataatcttgaataaaaataactcgataattaattaaatcataaaaaagtgtaattgacaatctaggctaagtatacaatttattagttctaaatttcagagctattaatttaataaaaacaataaattgtgactcaaacgtgaatacgtttttaattcttaattcataatttactgtagcgcccgttccgtcgtggcgcctagcgggaaaatgtaatttctaaaaaaaccctaattgcgaaaattgtttcttcgcttgcgggctgcag

SEQ ID NO: 68461 - DNA, 1938 bp, Oryza sativa
ccgtgctccgtagcgcccgctcgtcgccggcctcgctcgcgtagctccgcccaatccgacgctaggaacgaattcccggagtcgcgtagatgctctagctcgcccgaatcggtctcccgtcgcgccgtcgccgtttcccccttctctcgccgccggttgccgccgccgcaatctgccgccgtcgagcatcccccggcgaatccgagccgttggctcgtttcccctcgtcccgtgcaacctcccggtgtgctcgctttcgcctgtatcgccgtggttcgctccgccgctcgccgccgccgtccgccgtccgttccggccgacgtcgtcgtctacctcccgccggcccgcgtggcagccatgtaggcgccacgtcggcgccacctcggccgcgaccgggtcaagctgaccccggtccgccgcttccctctgccctccccgtgcgcgtggtccacggtgagccgtgaggctgcgcgtgggcccgccgtacccgcatcctccgcgagccacgcacatgcaccgcgccccgctccacaccctagcgccgcgccgcgtgctccctccgcacggtgagccgagccgctgacaagcgggtcccactcgggaccacgcgagatggacccggtccaccggctccctctctgccccccccccccgcgccctattgggccgtgtcctctcgggccggccggcccatttagctcggccgagccgccccttttctctcgggccgcgccctagccgcccgagggaagtttaattcccctccctctttcttttcttttttccaaaatggtttaattaaatcttttttcctttagaccaaaaatccaataatcttagaaattcaatatcttctcaaccgtacatctgtttgactccgttcaacttccaaaatttctcaaatctcgagatctaccaaatggcacgcttagaggtcaataatagggctttattttcgccgttgttgagtcgtctcattcgtgtgtagcttcggagcccgaagaccctgagtgcgcagatttcgaggatcaagctcaagatctcgagcaaggcaagtcacctttgatcatcttgcacctatagtttaaatctaagtatttcttttttgcaagtattgcatgaataggtttaacacaagtatttcggccgcggcttgtgagatagcatgtcggtcccaatcctaattgctgcaattaccctccttgaattattgaacacttaaaccccctttgtcgactgatgtgcttcgatgcacgggccttcgagcacgggcatcggaacacctcccctcgaatttaaaatatccaacgatgggtaaaacttgaggttttacaaaagacttggaaaacccgacacatggatcggtgcttgcgaactaaatgaatttctaaaatcgcggaccggggaacataccgggcgtacggtttcccgctcttgcacctaaggaccgtttccttggaatttcatccgaacataaggcaagtgcgaccacatgggtgtaatgggacgcccctggctgagtaattagctaatcaggggagccatgatgccaagagacatgtggattcaacggggtggtgtcggggagaacccccgggcttcctggcacagtatggtctgggacctaacctggtgttggtctgggacccctctcattggcatatggtaaacctgtgtcggctttcgaaatgccttgtcatgaaagcctcaaggtctccagacgtggccgttctgcacgggctgggtgatccgggttagtaatgtcgtgtgggtaaagtgtaccccctctgcagaggttattaaactgttcgaacagtcgtgcccacggtagtgggcggatgtgaggtgattcctagcgtagttttgtttgactactgctttgtgaaattgatgtcgtgaaatgggatcgaggtttggaaaatctgccgctgatgtgat

SEQ ID NO: 68462 - DNA, 1016 bp, Oryza sativa
ctgcagcccaaaatcattcgagcatacctcggatcgaagctcctcatcgctgccacaatcatcagccaaatcctcatgagatcctcccctccctcccaatcctaaacaatgccacaaacacacagatggggacaacgtacgcgcttacccccacacgaaaccacacaacgaaatcgatcgaatcagacctagctcatcgtcgtccgagagcagctccccgagccgatccttgtgcgcgagcgaatcctgcatcggaacgccagagaacaatcaccacctcaatccaaatcccctcccaaaaccaaacgatccaacacgaggtcccgcaacgaagcgggagggatatgtgtacgggaggctagggtttaggggggttcccttacgcggcggccggagccggggctgtcgtcgcggtcgcggtcgcgggggtgggggccgaagaaggagaggaagaagccgacgaggacggcgtcgaggaactccaccaccgccctcgcgatcgccgccgcgcaccggcacatcgtcgtcgcgtcgcggcccttcccgccgacgaggagagaggcggaggggaggaggcgaggagaggggatatggtttgaaatgggaagcgaagctgcgaagaggagggaagcattattattattattttattatttttttattattttggggaagcgagaaggatagttgatgggccaggccttcgcgacttcagcccaactattaatagtttgggcctcttctgttttagtcagatttgtcaacgcaccgggccgtagaaaaaaatatgtttgggcttcagccttgctgctctctctgcttctttctcttttttttttctgggaacatatatgctgtttggactttccagcagattgtaaaaaacaaaaaaaaaaagatttctgggttccttttctgtaaatagaagatcaatatctaaggaaactatttaaaaaatattttctcgatttatgtctctgtacacgtacttacctcctgaatattcctactaaaac

SEQ ID NO: 68463 - DNA, 1345 bp, Oryza sativa
ggttaattagcaaataagtttacataatgatattaggagataaacccagaaaatgaatggtactaattaatttgaatgccaactttaatttctggaaaaacatttaaaaaaaaggcatctatcgagtcacttaaacacttctggtcattctctatagcaaaacgtactaaaaatatctctgaattccagacaaaaaaattacatctagatctatcagggttcacataaattgatctatatctatcaacacgtaatcctctatactacatgggaaatgaagcttgttgttgttgctgttgctactaccactataggatctaataggtaatcctgggaccaccaaaaaaaaatcctatcccaatgtatatttacatatgtgaaatatatttttgcaaaaagaaaaaaacactgtcttattaatatattatgatgcaatcaatttatatttctaaccttattatatttagggtattttaaaaaatatataagttggatcacccatataaaaattctagatacgccaactactattatgggagtgaacattatttgtttgctcacctaaaatagttgatttctctccatgtctagaataaatataagtcaaagttgaaaagttacattttggtttagaattggaaaaatcttacagatatgaaagaatatcgaaattgaatatatactagaaaaaaaactccaaagaaaattaatccaatcgatataccaataattaatttaatattacttctagtcaatgtagtgtgcatttctaaaataaaaaatagccgcgcctagtttttgtaacaaaccaagtaccaaaatattacacgagtgcaaaagcaccttattcacacgtacggcatatgtacacgtgtatcacacgatcgattgaaaaccgaatgtgattaatcaagcatcattttaagtttttaacgcatgcacgcacacggaaaatatgcacactgcatgcgtaatacggcgccgaataagcttaaacttaattggagtttagctaagcttaattggagtagtcatcgttcgtgcaagatgccggtacggcactacgacctttttggcttagctatagactatagtctctaggtagctagctgccacttttgccttttagaccctgcaattgcacgcttgcactattccctatagtttatccgtactcgtaaaataagtcgtttaaaataatatttaagttaaatcttaaaaatataaattataaataattctcaagttgttaagtttgaaaatgtaaaaattatatgaatagatttgtcttgaaaactattttttaaaagtatacatatatcactttttaataaatatttttata

SEQ ID NO: 68464 - DNA, 1238 bp, Oryza sativa
ttattctttcagtactagacgacatacatgtcaacagcgagaccgagacgtccgtggtgacttcgttaatctcaagatatatcagcccagtctttcggaggtgctcataggggtagggtgcgagtgtatgtatttataggggtgagtgtgcgcgtgttatgggtgcctgcatttgtattgtgtttctaaataaaagaaatgaattaattaggatgcatgcattgtttttactctccgtcaactgcatgtaaataactcaaagaaaatattattttagagtggtctcaattagtagtaatctactatcagtataaacaattactcagtttttgatagttaaaaaattaagatacttagttctactactactactactatttgaggtacaaatattaatacatatgtactcctgttaatagagaccatatatactactactactatttgaggtacaaatattaatacatatatactcctgttaatagacaccatagtaaaatagctatgaaagagaatatggtacatatactggcagtgtcatgtcatatcatcactggcccgggcacacagtgatttaattgttttatttcagataatgaatgggacaaactattttctaattataatgtatatatgccatatctttttcgtggagggggatttaccacgtctcgagatatatgctttcatgtgtgtgactatgttcgtgtgtgtgtgtatatagaatgaagaatttgtcttagtgtagagaacacggcaggcatgcagtagcatatatagatgagccctaagtccatacgattttaagaggtcggcaccgtcttaaattagcatgagggcgacttaatagtataggcatctactagcttcaattcatctataaccaacctaatagctcattcatacaatagttacatactacactattaatatctggtccacttatcatacacatcgtgtgtcttgaaatccgtactacagctggctacaaatctgtagctcgctgctcttctctttccttatttatcttcttaaaatatatttgcagctagcttatagcctgctctgtacctgttctaatggagatatcaattaaaacatctagcttataattaagccttgacttacgattccctagctccttcatcctggctccctggaatatatattctcacggcattatttccgttgttccatatgcatgggctgccaagcctttgaatttttagtatagcaag

SEQ ID NO: 68465 - DNA, 952 bp, Oryza sativa
tacactctaaacccctcccctcgtttttcacgtgtatgtttttcaaactgctaagcagtgcttttttttaaaaaaagtttttatataaaagttgcttaaaaaatcaaattaatacttaattaatcacgtgtgcggtccattttccatgtacactgtttgggtcgggaaaaagagtgtcgaacacagctatgtatgtatggattgagatgtacaacagcactggcaagaagtcaagaacaacccacgacttttcgaacacacgagcgaattattcgccgttgctctagtaatctaatactccatattaatatccctccacaccgtaacgacaaaaatatttttgtaattagcttagaggggtttctaggtccatcaaaaagatgattataattagagctagtgttgtatgttggtcaatttaacattgttgtaatgataaagttttaatggtaaataactatctaacccatacagcttatcttcatgtcttcctactggctccacttttgatttacgatgttaccacagaaagagcatgatactatgcacaatggtgcttgtcagggttacgggtcaggcatatcccctacccttcgatatacgatacgtatcgacatggcatacccacgcgcatgcggatatttcctttatgatctaaggaaacctttcacgaaatcaatatacgggaaaaagtccttttcggacaagaactgggttacctacgtatcgtgctaggtctgatatgttcgagtcctactcggagagtaccagacttgcgatataaaaggaccccccggggagggcatagatcatcgaatctcagaatccacacagcctacgaagccggagcctatgaggagccaagtcgtcgagagctagtcgaatcgactcgactacaatctcgccggatctgacaagttccatcttttcctttgtaacctgtgttttccac

SEQ ID NO: 68466 - DNA, 1920 bp, Oryza sativa
aattaacaatcgccgagaagcacggcgcacacgggacgacgcaaatcgctctcggcgtcatgtttcttcatggcgccatgatcgaggaaaccgcccaaacgaggaccgagaatgcaacgatcgcgaacggcgggggccagacaatactagtcatggccgtcgccgcaacgacgacgacgaaggagatcggcgccgagataacaacgagagacaacaacaagattctcgggatccaggtcatcatcctcgtaatcgtacgccggagccaagcgacccatcgtcatcgtcatcatccgcgtcctcttcatcgtcagacagacatccacgaaggtcacgcgaccgccgacaacccaccgccccagcgctgggtgtagggctttcggtcgttccctacgtgatgtccgatggcctgagagattccgacccggggccattgaaaagtatgatgggagcaccgaccccgaagaattccttcaagtctactcgatagtgctttatgctgccggagcagatgacaacgcattggcgaactatttaccaactgcgttgaagggttctgcacgttcatggctgatgcatcttcctccctactcaatctcttcgtgggcagacctgtggcaacagttcatcgccaatttccaaggaacatacaagcgccacgcgatcaacgacgacttacacacgctaacacagaactcgggggaatcattgaggaatacgtttggcgctttaacgagtgcagaaacacaattcccgaaattatcgacgcttctgtaattcgcgccttcaagtccggtggtagagatcgctacactacccaggagttggcgacaagacgcatcacaactactcgaagattattcgagattgttgagcggtgcgcccatgtggatgacgcgctaagacgcaagaacgacaagccgaagactgggggagagaagaaaccagccgcagacgcctctgagtcaaataagaagaaaaatcgcaaaaacgggaaaaggaaagctcaagcggaagtcctcgcagcagaatacgtgaaccctcccaagcgcccagacccacaaggcagcgatacaaagaaatcatgatgccccatacacaaaacggacagacattctctggaggattgccttgttttcaaaaagtcgctcgagaagcacatggcgttcaaaaaaggcaagcgagtacgtgttatcgagaagaacgaggagacatcttctcacgaatcggattctgcgtacccagactccgacctccacgtctcacacatcttcggcggctccacaacgtactcctccaagcgggaatacaagaaagcggaacgtgaagtctgttcgacatggcagggggctgcacccaagatgaagtggtctgagcagaggatagagttctcggatgaagaccaccccaagacctctgttatcccaggacgatatccgattgtggtcgaacccactattcggaacgtcacggtagcgcgagttctcatcgacggtggcagctcgatcaatctcctcttcgccagcactctagatgcaatggcaattccgcaaagtgcgttgacaccaaccgatcaacccttccatggaattactccccaatcatcgtccagacctctgggcaagattacgttgcccatgaccttcggccaagccaacaacttccgaacagagcagatcaccttcgatgtcgctgaattgatacagcttacaacgccatcatcggaagaactgcacttgcgaagttcatggccgcatcccactacgcatatcaagtgtcaagatgccgggaccgaagggaacaatcactatttaggggaacgcaaagctggcagggtgcagtgcgacaggcggagcctcgacatggtcgaacaaacgcccaccccacccgccacgtatgagccaccggagaaagtgagca

SEQ ID NO: 68467 - DNA, 1235 bp, Oryza sativa
tctgaaaagttcaacaagaagatgaggtgctggctttgattttattgctggtgttccttcctttctgcctgtaccccaaccaccccgctctcctcgaggcgcagcagccattcgcctaaaaggaaaccagtactaacctcgggatggtgatggccgcgaccgcctgatgcgtgcgctgcggctgtcgccgtctcggcgcgggaggcggaggagaagctggcggcggccgggggcgagcaacggctgtctccccgtggacagccgcgtcgtcgacgccgatgaggaggagagcatcccctcattcgccgtcgctgccgggtggttgttggtgttgctggcgcgggatgtggcctccatggaacggccgcctccccactgcggccgccgccggcagccgtcgcagcgccgctctcctcctttgccgcgtcgccccggcggcctcctccccagccgccgaacagtttgcccagagaagaggagaaagaagaagagaagagagagagtatgaggaggaagggaaagagatggcgtggcatcctgacatgtggggtccacatgggtcctacgttgactcagccgctacgtaggataaaaccggggtcaacactatcgaaggagctattatgaccagttttgattagttaagggacggtcgatatctgattttgcggttgatggatgattttgtaacttgacgacaagtttagggaccttcgctgtactttttccttttaagagatgtttctttttcgaagcattagcgggcacaaggacctgtgcagtcgtgctgaccttgggtgaagcatttgacagaagaattgggaattgatcctatcatcaacgttttcagaggaaacgagtagccgagtactccctccatctcatagtaggtgacgttttcgattttttatttataacgtttgacaattcgttttatttaaaaaattagtgcaaatataaaaaaagataagtcatatgtaaagtacttttgataataaagcaaatgataaacaaaataaataataattccaaaattttttgaataagacgaatgatcaaacattgacaaacaaaaacttaaaaagacaagtaatatggaacggaggcagtaggtattaggtaaacaccgtttggtggaccgaatatacaggtagcagagccgagggttgaagagagcctaaaaacttgctctgggtgaacaatgggccaaccccttctgcttctttgatccgatg

SEQ ID NO: 68468 - DNA, 2468 bp, Oryza sativa
acaagtgccaccagttgatttggagggttgctccttcaagttggttacagcatttcctggttgcatatgttgcaattttgaagaaccagatatcactggactcgatttcgcagcagcatcggcggctacaggtttagaagtcaaggccttcgatgaagaaagctgagacactgggcttttcagactagactcacttgagccacttcgtctgtttccagcactagaaatttctggaaacccaggtttgcctggccaggatacagcctgacctgataccactggtttcacatcatttgacttcatttcagcatcaacgcgcttcttccaattttcgacaagacactttgccttcttctgtatctccggatttttatggcttcgcagatgattaacagacttcccaatactgcaactttgtaaagcagtaagattaataggcaatttcgccagtgcacgaagcagggccaggacaagatcttccataggcttatcagtttctttaggactaccagcttcaccagacttccctttatgagcttcttgaagccaatcatcaaacacaggaaggcctcgcagttgcacaaacctaccaaggcagtcaggactttctgtagctgcaataatatcagctagaattacccggccaggcaaatctatctttcgctcagttcgatcaagttgcatgagatgtaccagcttctctacagcttcagcatgtggaagtccacctttttctgttatctttgtaatttcagactttagattctccaccttaaagttgcctgattcgccatcctcagcctttaggggacgctcacggtctcgcttagctggatcagttccttgctcacccctgtccctcttcttccctttggaaagaccgcagttttgggcaccatcagaaccagacttttgctgggcagacgacggtccattgagccgctttggtgagcgcccacctgactgaactgctgcatgcatttctagctttgttctgtgtagaagccgatttacttcttcctgccgctcctggtcatgagttgaacaccttagcacagaaaacgattctaataaaggaaggtaactgtagaacttacatttatataatcctggtcggtaagccaccataaacacttgttgtcaatatcatacacgcgccgacacacaaatgaagaaattccagctggaagctcaacgcctttacgcaaaaaagcaactttgcaaggatgcagcagtgagacagcggatgtctcgtcctggtggaaagaatagaagatctcgtttggtgcggcgcacagctgtgttcccttgttaagcttgatgtcagctggtctatacagccaacttacacgtaacttgggaaagccttcctcctttttctcaatccaacgtatcaacccaatgaaagggggaacttcaacagcctgaaaaagagcgcagtcgccaacacggaattcacgcccgtcctggatattcaataaaaaaattatcatgtgtacaagggacaaaacacaattcatgtatccaccaaaataacattgggcatatgaaaacactgaaaaatgcatgttggcatagaagaaatataagcatacttgtataaagaaagaagaaagaagaaaatggtatcatggtgttgttgaaacatacaatacacactaaaaatcaaattgcaacagaaatagcaatagttgccatgccattgaatttgttcgatctgaaagtaaagatcatgtaaagttgatggttacataattcaatgcgagctgtctacgccaatacttgcacccaggcttaattgtgatattccggttgtttttatcttatttctaactttgaaaagaataattattattattattattatcttgtttttatacaatacattaatgaaacaagtattagaagatgtagagatagatggtaataaaccgtaagttacatcatgggctgcacacggatccaaaaataatgccacatgcaccccttagccatatattctttggatatatcatgcccagtgattatccaagaaatgctactcctaaaaaatagacaaatgaattgttcgaatggcttttgagatgcacacaagcaagaacacgccttcacacaaatcttatgtaggggtgccaaaaattgtcaaattgaactgtccaaaagactcaatcaaataatacatggaaaaccatcttaaactactttgatgatagcacgacccacccaatacatccatcaaatgcatcccatatttactcggtgaaaatttgctgatatgccacaggttaccattcaacgatataagtaactacaaacataagtttatctaggcttaaaaacaaaggcgaatttggtcacagcaacatgctcaatttcatataaatctaattaacctttgtaaacatcaaagcgaatcccatcagaggaggcacctttaagaaggaatctgatgaagctggacggggaga

SEQ ID NO: 68469 - DNA, 6950 bp, Oryza sativa
atcatccccgccgccgatccctcctcgccgtcccccggcgccgcgccgcaccatcaccagatcgcgcccgccccccgccgatgcagccgccgcctcttaaccctagctcccgagcagcggatccgcggggccttcctccatacgcctcggatcgcccgaattcgcctcgcccgcgccggtatggacgaaacgcctctcccgcaaccgcagatcggagctcgaattcgcccgaatcgactccaccagtttggtggttcaactgcaaatttggggattcggggattgggtcagaggaggagacccggcgtggggtttggtctcgatctgtggtggggtggtggagaaatggagaaaaaaatcgcgattcgggaagagagagaggcggatttgggaggagagagatggttatatggagcacggcagagagagacgacggcgagcgagattgggatgaaggggaatgcgcgatgcggggggcgtcctcgggagaggaaagcgggggcatttccgtcatttcgcccgcggcccacctcgcccgcacgggagacgctctctgtgcggaccgccgctccgtggccccacctgtcagtcgcggcgtgcggccggctcccacccgtacaggtcaccgacaggtggggtcctgttgacttgcgggtgggcaagtggtggtgtctgtagtgatttcctcgcacgctgatgtggatgcgggtggacggatttgacaagtggctggctcggtacgcggtgccctctccgctcctctcgctcacgtgtcactgacgttgcgggcccaggcgtaggtgggccccacttggtagtgacgtgagcggtcgctgtgctcgggctgcgacgcgtgatgccgggggcgcgacacgccgtggacggcgggggcgggggaagttggcaacggccaccgagttgccacgggttgcttttcactggaaggtgggcccgtgcttttctctctcggcccacatgcgccgcggggctgtgaagtggacttctctcacgtgttgttcttttttatttttctctctctttttggttagggagtggagcccgtactgagatgggccttgtgggctgcaaactggtttcccgtgttttgcggttagcggatctgcagatggctgtcagcggcggagacgggcttttgcggcagagtgtctggtcgcacactgccataccgtcatgggacataaccatctccatcgctttataaacttcagaacaatttttgataatttaaagtagggtccgcttgtagtaaattcattttttttgttaaaaagaacttgatggatctgttgtccttcattagggtatatccccttcgtccctaaaaaacaacctaaaatagaatgcgacattttctctattatactaggaacgccacaatcacattttaggttagtctttctataggacggaggaagtagactattcttaggttgtgttattaactcaaggtttccaacttccactcctacacatcccgaactactaaacaatgtgttttttccaactatatatatataagtttttatctagtacttaattaatcgtatgttaatccgtcactctattttacatatgaacgggagaagtccccaacccctctaaaagaacaaaatcatagaatgattaaagaaaactacgtaaaataccacctcaaatgtagagatttattttttagctatagtcgattggatatctgcataactattatttattcccaatgatttacaggttgtacgtagaccatgtcttactcaaaccgaaaacaaaatatctataatcaacgtccaaatatctataatcaacgtccgattattatgttgatcaaatcacatacaccactccccgtaaaaaaaacacacacaccactgccagcaactgacattgaaccaaagcaaagtatagtatcggagaataacttagttgtagtcactcactcggatcttgtcacaggtatattcatcgaaactgattcgacgggaaatgcatccaccaaggaagccataccacatgtaacctccaatgcggcacatccaggaaggccacaacatttaaagtgtctttgtcgctatttcgaccatttgaaactaagttttcaccccgaaagcccacataccacatgaaggtacagaagaggacgtcagcatcgtatttggaaaggtatgtggcacccataggagtcacctatcgatgctcctagcgagacatcgcccgccccagatctcaacttgagcttgaccttcaacattgtgctggcgatagagaggaagggggagatacatgtgtgccaacattgccttatccaaccatctttgatagtttgaagaagccgatggcaatgatgagtagggtgacacctttagtaccagtgaggccaagcgtcaacatggtgaggaggctcgtcagaggaagctcgctgaaaggaggagaaagggggccgctgaaggaaggctgctaacctaagttttattttctctattggaggaaacttgccggagagagaaggagggggctcactagaggtaggctatcaccgtcatgttgccggaggaaggtcgctggctcgcgtcttgttttcttaccatgtcacattgtaagttcaagtgtcttaatttggtttcggtgattaataacaaatctaattatatgagactaacgtttttatgagcctttctttgactagtcttatttggatatggaagtaaaaatgatgagaggtatgtattaaacttcacatattctaacttggcctctcttgtggatccaaaatatagtgtgagcttcctatttaatctttgttgattatgtgcatatgcgttccttcatatccatatgtatgcacatcttgagggggagcttattctatattttgtttattataagatttctatcttgatttgaaatcatttttcatctcctctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttccgataatgagatgtggaagacatgcattcttttgtgatggaccttaatcatgacaaggatgaaatgcatggagataaaacgatatgtaccactttttatctcctactttttgataggttcatatatatgatttccatgttattgatatataagtgtgagactaatgtttactcgaatgttatcttatttagtctcatttacattgagaacatggagatcatgaaggtatatgttttatgttgctctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagattgcatacgagtatatgacacttgtgatgttaatgaatactcaacaaacatatccatatctttcatatgcaaccggttggtcatcaagtgaaggatgacaaccgatttgttgagactaatattctcctttgaggtgtgaaaaggaataggtcccactacgatgaggctaatgaatgacaccatgggttagtggtcaccaagccaaggacatcgtcatgttggcaagaatgaagtcaaacttgtgatgagaataaagtattgacaaaggatagacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagtccggatttactagataggcgctgtactatcaagaggggtctatgaagcgagcttgtggatgatcttgtgccatattagttcatatgcatgcaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggtaggttgagctgaaaagtgacatgcggtctgaccgtgggccttaggccagtctgaccgggtctgttagccggtctgaccggcgtggcaaggccggtctgaccggccccattggtctgttgcactggtctggtttttggtggcgatacagagccgccagagccgcaaccggtcagaccgagcagacggcggtctgaccgagccgtggacggtctgaccggccactacactgcggtcagaccggccaggttgagtgggctcaatgattgccctgtaacggctagttttctagccgttacaaagttgtccggtctgaccggcctcacaacggcggtctcaccggtagagcacaaagttggggatttcggttccaacggctagttttggtggttgggggtatatatacccactccccagcagcaagagtaaggttttggcactccattgcattatcttgaacccttgcaagagctctcacacccttgtgcacttagtttatctagtgaggtgttatagagtgagttaagtcaatgctgaaaaagaaactacgttgaaaatatctcaaaatcaatctcaaaattaagtttgaaaatttaaaatttagctttttctttaacttattaggacatccgatgggagtctttttaaaggatagacttttaaatcgctaaagatatacatattttatttttaaggattgacttttgagccgttttggcttatgaacctatggcgaaattttgcgtcatgtctcgctcaaatgcaaagctcaaagggaccaaatactccaaagcaggaagaggcggggaaaggaaaaaaaaaaagaaaagagaaaagaagagagaaggaaaaacaagcgggccgagttgtgagtgactgcggtgcagatttttttcgccagcaaggccgagttcttcgctgaacccccaaaatctcacaacccacctcccctccgcctctcccatctacccaccggcgggcggcggcggcgacatggagggtggcggcgaggagttcgcgatcggggtgctgatctccgtgaagaccaccctcggcgaggagttcgaaggccagatcgtctccttcgaccgcccgaccaacctcctcgtcattcatatcctttccaaatccctccccatccggttctcccccccccccccccccatctcagtgctctgccactttcgctccccgtgttgttcgtgctttttgcggttgtttttgtttccatgacggggtagatcacaggaaggcgtggggagggcagagagaggtgagcggaggaacgtgcgggtgctcaaggcgaactacatccgggagttctccgttgtaggcaaggccgacgacccgctcgacccggccggctgcgtgctcgacctcgccgccatccacgcccgggaggaggccgctctcaggtgcgtcacactcccatctcgaccctgttctaccactgtgtgctccctatcagatgtgtttctcaggctgaagctggagtaattagattgatcatacaattcttgatgacatgtgttacatggcatatttttccagatactaattactgcaaatgtgaaattcagttttttttcctgtgataatcatcgagcgacttatgtcatagctgtcgcaacagtggacctgacctttctagttggtaaaagtgatatactccgtgttatgtggatatccagtcagaataagtgatagcaagtgaacaaggacacataggtgcttgaaaacaggaggggagatagaagaaaggccatgctatctagaacagaatcacactgtttaaactgttatgaagttcttggtcgttcatcaaaatattaagagtcgaaattgaatctgtcaacaagcagccccctccccaccccccaaaagaaaacctgtcttggttcacagattataatagcttagattttgtatttgagttggagatttatagtttgttgccttctggctttccatcaagaactgtagctactctggtcattggacaatgaagcgaaagacatgtgtgcaatgcaatttaaaattccgggatatgggctattagggctattatggatttcaagagagcattgaagactgtaaaacttggtttgacagtgtgtactttcgcttcttcaagactgtagtgcaccctgtagaattacagacatgcaatattgcaacagccaacctgttaaattgcttatgtatcagctctgagctcatgctattaacttattttagaaaccaggtttcaaaactggcttgtcatggtttggtttcttcaagcataaactgtaatctaaatgttttcttttgcttctacgcttttatgaattgttagggattaaatatgattttttataggaattaagtatacctttttcaagtttaaaatttatgatatattttaaatattttttgcacttggtatttggctagtgaactcagaaaaatgtttgctttatctactaaaaagataatttcgagatcttctgctgtttacttataataggtgatttttgcatcgacactgaatgttaagttactattttgggggtatttatgttttgatggaagcacagtacatggggatattatagtttgttggctggttagtg

SEQ ID NO: 68470 - DNA, 8370 bp, Oryza sativa
gctgcttccaggtgtggtagaatggtctcttcacgaattgatactttgttttgactgggttctgttaggtgattattgtcagcatttcgaaatttattttctgtttgttttggagaaaataaaacccatgtgagtttgacatgtcagttctgtttattattttccgatttgtcagatcttggttgtgccattgtacaatttgctcctgcttttagttaaagaatacaacacagtgatattttctgtacttaaggcaagcagacgctggcttcatgtttttcacagcaataaattttctttctttttgtttgattttattctgttagtgtcaaattgttttctgtcaatgtggcttactctaatttgttcgcaacaaattgcttttgacaaatcttgtaaagcttctctacatcatggaactatgttatatgttttgccagttttccacctgttgtcctcgcatgttgcattattagcacaactttttggtatatatgtgaaaatgtaatgaaacactgtttgttttaaacgtaaatttgtatgcatataacaagttatattcttctcaggcttccagttcagtgggacaagactgacattgttgtaatgaaggaggttcgtgtatgcaatccatacctgcctgaaaatgtcagtggaggaacatctgctgcaaatgaacgggttaagaaagtggtaatgcatcgatgcttgtgaaccatatttgtactaataatataaactactgcctctgtcccagaatataataagaagttttagagttagacacggttattaagaaagtaggtagaagtgagtggtggagggttgtgattggatgagtagtggaggtaggtgggaaaagtgaatagtggagggttgtgattggttgggaagagcatgttggtgaagttgttatattttgggacaaatcctaaggtctaaaagttgttatattttgggacggagggagtagtaaaatggctaatcattatgtatctcatcttttctttttggggtgtgtcttgcagcttgactttgaaaggaaaaggctacatgtgcgtgtacctggccaattctaacttattcggctgcttttcacctgaactccccctttgtactctactttaagggctgaatcatcaatagatttttctaaaatttgtttctgcaaaatccatgccataaactatctcatcagctagctaaatctgtatcctgttatagatatctcatcagctagctaaatctgtatcctgttatagatgtgcccttcgaataaattgtcatgctgatgttaattcagctgctggttgtaagagggctttgattgaggcaaacttagaaagtaaaatttgattgatggcattgaaagaaggtgagttatagataacaaaggaaagatggggagctacaatggaaaatgcttcattgaacttatgtattttgtgtgagatttgtaactccagtttttttttcttatacttcttggggaaacttatacttcatgggtaatcggggtaacctttttatttctgactgcagaattaatatagggagaatggaggcattttctagaccacaggaactgaaacttaaattgtccaatcctgtactatgctgtatctttaatttttttgttcaggttaagaagttgctcatctgttgtcgcgttcagtctgatttgtgatataatgcatagagaattgttgataccagtccactggcgtatatattctatacatgttctcacataattccttggtgtgactgaagaatgtgtttaccatggcaaaaataggctctcattcttatgctggatattctggagtcacacttgcatgggaatggatcttcgctgtcatactgtggaaacgttgttattatacctgatttgttttgctcaaacattgttgtaagaacgagttttttttctgacattaattgatttatacagcacatgagtattgctagccttttctgaacagagtatgaggcctggtttagttcctaaatttttttctccaaaaacatcacatcgaatctctagacacaaagcattaaatatagataaaaacgaaaattaattgcacagtttgcatagaaattacaagacgaatctttttagtataattagttcatgattaatcataagtgttacagtaatccacatgtgttaatgacggtttaattaggcttaaaagattagtcttgcggttttcagacgagttatgaaattaattttttcatttgtgtccagaaatttattttgatatccggtcatttgatgtgataatttttttttcttttcgcgatctaaacggggcctcaggtggtgtttagatccagggacttaactttagtccctgtctttagacactaatttagagtattaaatatagactacttagaaaactaattacataaataaaagctaattcacgagacaaattttttaagcctaattaatctataattagagaatgtttactgtagcatcacataggctaatcatggattaattaggctcattatattcgtctcgcaaattagtccaagattatggatgggttttattaatagtctacgtttaatatttataattaatcttcaaacatccgatgtgatagggacttaaaagtttaagtcccatctaaacagggcctcagtagatcgataagggaatatcaggctttatcacatgttgctgttgactagcagatcgggcctggccagctggaaagcccagctcgtcctatcattagcccagcaccacacggcataggtactgcatccactagtactggtgttttctttggaacaaatgttacactggacgttttgtctgcacgtaccggcgcagtactagtacggagtagtgcattaaattggctcgatgtgtttttactcctacccgcacggtggttttccatgcagggtaaaattagtcaactcataatcataaatgtggaaagtatagcgtgagagccattaatatgtgcatttatttctccaagtcccattcactttcatgtttgctgcagcatctgctctcgctcgcttctcttgtactcgttcgagggcgagagctccacatgccaatttgccagccagctgcctcattggtcgtctcaaacaaacaaatccccaggcttcacacgaattctcgcatggtcgagatctccatgcaatccaatctttctaatttaatgcggccgtgtggtacttaaacatgagtgcttctagttctagaatgccatctgatctgataataaatttattggagttagttggatcccttgatcacgcacggtcaggtgccccctaccaaaactacacttttgcttaatgcttatggtaggcgacgactactccggcggccaagagcccaagaagccaagagtacaagaatgatgccctctttgattcaaataaaattcataagaattttaaaggatttcatttctataggaatttttcctacaaagccttttgaatcaaaggaataaaccctatgtaatcctatgaaattcctatggaatgtctcttcctatataagttttggaggaattttaacgagaggtagatcctttgagtctttatctctcattaaattcctatgttttttctgtggtccaatcaaacgatcattcctacgtttttcctgtgttttgcaatactctgttttacacttacattactatcagaatcctatgttttttctattcctccgttttttcattcctgtgattcaccattgcgaatttcacgtacgatctgtatgttctgtgaacccgtgactaatcattctcaccgaaaaatggcgaaataaccaagtcccggcgaaaaaaagcaaagcactgtagcggtgagagaaaacaaccaagtaacacaatgatagggaatagtacggcgacgcaactttgcgtacaggtcgaaagcatacttgcctcctcttttcacctctcttcccttggaacgagacacgggaaagcgcgaaaaaaaaaaagagtatactcatccattttccattctcgctcctctgccctaccccaatgccccatactactatgccacaataattcactcacaataatactaatgctagtactactcacatggagtagccacatttctctcctatagcctgattgaagaagcttaagcaactgattagtagccgctccgagaatctgaaaaagcttcgtttcttagtttttggcttgtgatttgttttctgattttataattatagcttttcagaatgtaaaaaaattaaactgtttaagaatgctttcgatcctgagataagctgtaccagctaaaacttccgaaacatgcctcttagtctcccctcctgtcccaacggaaaagaaggtactacctccgttaaaaaaaaaaaacaaaccctggtttccgtgtccaacgttgaccatccgttttatttgaaaaaattataaaaaaattaaaaagacaagtcacgcataaaatattaatcatgttttatcatctaacaacaatgaaaatacaaattataaaaaaattttaaagttggatacagaaaactagggtttggcttttttttactcacttctttaggtacggagagagtactgctaaagagagacgagagtcccactcatctcttcactgtgagaaccactgtgctacgccatcgtactcgtaggagtgatctgcaataagaaatctttttcttcacgcacaatccatgaccaactcgtcctttccctactgcccaaactcaaaacccacaaatgcacagcaaaccatgctgcgcaaaacggcaccgtaccaaaaagctcaggcgaatcaaatccacaccacaacccccctgaatcaaatgtgaattatcccaaccttccctttacccgcaaaatttgacgcgctgagagagagagagagagatgagactggggagattcgcacggctcgaacacgcacacacgcaaaacaacacgggcataaatgcggttttggagcgctgcggggtgtgcgtgaactgtcctcccacaaggcgaagagagaagggggaaaaaaaagagagaagaaaaacgatgcgtggtgtggtgcggtggtgggggtgagaagagaacaaaacaaccgctccctgctgcgcccctcctgccacccgctgcggcaagcgcttttttgaccgcttctgccgtctccctcctcacacggcacccggctcgcgtctctcctcccccctactactctgatccaccgggtagtactagacgcgctactactgccgctgtactgctctgccaccacttctccactccactccactctcctctactaccaccgccgctctcgtctcgtctcgtctcgactcgactcgcattgcgcctgtgctgtgctgtggtggtggccgcgcggggggcgagatggccggaggaggtgggggagggggaggggcggcgccggcgccgaagcacgacgagctgacgccgcaccccgtcaaggaccagctccccggcgtctcctactgcatcaccagccctcctccgtggcgtgagaaccaaaccccctccctacccaattttttctccgcacgcttcccccccccgctcttgtcggggtttatcgttcgctctctgtttccggttggtcgatcgcgatagcgatggttctccgcttcctcgcgtcgttttcgcgaggctcctgcttcctcgcgtcggtggtggtggtttgcgtgcttgcgtttactactacgcgggggtgcttcgttgctgcgcttgagttgttgctgttgttgtttttgcgagggagtggatagatctgctcgagctttcctcattaggaacttgatacgctttcttaaaagcgatttgccttttcgttttgttctcccggctatttaataacacctcgcattagtttatttagtgatgctgaaaaggtttgactcgtttgattctagtcgcgggtaccaaccatgaacggatcaacccaccagatgggacctagaattgttggaaagcgttgtaggaaccggggttttggtgccagtttgatgctcattcttcagactgattccgattctctcgatcatgtttcgctgttgcctcgatttatatcaatgtcagcgtgatggagacttgtgtggatggaatattcaagaatccagtaatactatggaattttgttgggtaatttcagttctattaaattttgctttgacttgctccagtgttttcacatgcaccgtgctctttttttgttaagtactagtatacatattgttgctatccatagttggcgtgttatatgtagtggaattcgcatgtactttcttgatagttactagttccagacgatactgtccatatcgaaaaatcgttgtcgctttgagttccattcgttctcatgtttttttaacagagattttatctctttgtgcatgatttcacgtatttattagataagtccctgtcacgtttttttttgaatttgtattcccaaggcatgatgcatgaacttgaacgaacaacactcgcaagagttctaaaggatgaaactcatctgcactgtatgatgtaatcgttagttttgatattttttgatctttcttcaaaattggcttattgtcttcttatattacgttactttttctttttcgaaactacatacgttacggttaactacagcatttttatatgttgccaagtatggcttcttcctctatctgctatcccactataaaagttgtttgttatacatttccaccttatgctgtttataacatttgtatggttttagttagaaacttggttctgaagtattttgttgtatgcaattttttaaaatgcagctgaggccattcttcttggtttccaacattatctggttatgctgggaactacagttatcataccaactgcactcgttccgcagatgggaggaaacaatgtgagattacacatttacctgtttgtgtttcttttgacttgagccatcaatcaagactaacagtatttcttactgtgttaggaggacaaggctgttgttatccaaacattgctgtttgtggctgggattaacacccttttgcagagtttctttggaaccagattacctgcggtgattggtggatcatacacatttgttgtaccaaccatctcaatcatccttgctggtcgttatgccaacgaaccaaatccacacacagtatgttaaaaatcagtagctacttactttcagatattgtttttgtgtttcttgacctgatggatcacctatttttatgtgaagaaattcctccgaatcatgcgtggaacacaaggtgcattgatcgtggcttctgctctacaaatcatatttggtttcagtggcctttggcgtaatgttgcaaggtactgaggtgaaccattggtaattggcattgttttttctcttaatcaagtagctgcttcagaggtactcaagcaagaaatgatcttgcagaaaaaaatatcttgttttcagtctcattactatgtactggatttctttcaggtatctgagtccattgtcagctgctccactggtgatgctagtcggctttggactttatgagcttggttttccctcggtaaagtattgtgtttccactcaagactccatatttgtttaaaatattgtattgctcatcttagactaactgctcaggttgccaagtgtgttgagattggtcttccagaacttatcctcctggtgatcttcgcaatggtacgcatttatttccatcatgtagttgtcaccttcttcacctagcatcgctgtgctccaactttcctttttcctttttattgtttcatttttgcagtacctgcctcatgctatacacatgatgaagtctatcttcgaccgttttgctgttctgttcactattcctatagtgtggctctatgcatatctgctcacagttggaggcgcgtacaggaatgcaccaccaaagacccagtttcattgccgaactgaccgttctggaataattggtggtgctccttggtaatatttttgaaaaatatgactgttccattggtgccactctcgttgtaaaagtaacatgaccgcttcctatcttctgtacaactacaatgacaggataagagttccctatccctttcaatggggtgctccaacttttgatgctggtgaagcttttgcaatgatggctgcttcatttgttgctctggtggaggtatggccccatgctcttgggaaaatcaaataatacttcagcacttcatttcaatctgaggattctgaagtaatgagttatgaactcctgaactattatttttgtagtctactggtgctttcattgctgtttcaaggtatgctagtgccacacctctcccaccc

SEQ ID NO: 68471 - DNA, 1298 bp, Oryza sativa
  unsure (1)..(1298): unsure at all n locations
ctgttgcagatttgtcatggcctgttgttcttttgataccctccgatagtcaaatgcgtgatgcatcggaatgtctttttatcgtttgatggatgggaagtatnctacctnnncgtttgctgtgtatcttnngcccactgatnncagaacgagagagattttcgcggaaacgaaacaagatagaattggagtttgataaagaaatggtacttcccatgtgaaatcatgtggactgcccttgtcagtttatcgcgccaaatctttgtgccatacgaccatatcacacatggactactagtacttcacaaatatgcaaagatcttcagctgagccgcctccatctgatagcaatagcctaaaacgatcgccttcagcgaaggaagaaatttcgtcatgttactcccagaattttgcgttcccgtctttctgacgcacgcaaccaaggaggaaaccggcaaatctacaggaaacaacaagcagatgggggctaaccgagagaggatgatgcagcgatgctaatcgatcggccatttggggtgtggtcacggctcacgacagtcgttggaccaccaacacccacggcgatcattgctttgcttccgtccaccgttcgacagctaggaggcgttctcacggccctgaaacctgacaaaaccgccgccccagatggtgccaacgccgatcggcactgcacggacacgggctcggcagtcggcaccaccactgacacaaacgcaccaccatcaagcagaaaaggcgatgatgatgagggtcacagcctcacagtcacagggtttattagcactgatgaacagataaatgacacttggtgccagtactgaattactattgctagtgaggaggatacagattaataatggtattctctccatctcaaaataaacaaacaaaatataatctatctgtattcgtgatgttatgatatgtgatattcaatactagtaagtttaatttttacactacaagtttgcccagttgcgaacgtatggtccctggtcgagctactgcaatttatttttctggcatggttttgggcctctagtccaagattagttcagtcaaagaaatggaaaatttataacagataggagtatatacaagccttgtctgaataaatgtatggctcaggtgcatgtgctgtaaatgtgcacgcattattgccgaaatgattcgagtgggcctggccttcgttggcccatgcatttgccgcaatcgcattatcaattgcatcgcagagccaacaacacgatcgccaaatctcccacttgcgctccatg

SEQ ID NO: 68472 - DNA, 2470 bp, Oryza sativa
cagcatcacaggaaacaaacatacactatgctgcctctgttgcaagatcgcaacttgcaaaggaagatgtccctgcgtaacatgccatcaccatgtcgtacacatgggcatagcaaaccccaataccccatcctatgtttcctgaatcctgactggtgcagtcagctctcggatatgtcactgacgacggtggccaactcggtttttggcccacctgtcagtcaactggtcgatgtgtgacgcatgcaaaacggcagcagcagcagtagcttccgtcccttaaaaaaacaaacagtagtagatgtgacacattctagtactacgaagctaaacatatatgcttggagtgtactccctccgttccaaaaaaacaaaccctggtttttcgtgtccaacgtttgatcgtacgtcttatttaaaaaaaatataaaaaaattaaaaagataagtcacgcataaaatattaatcatgttttatcatctaacaacaataaaaatactaattataaaaagatttcatataagacagacaatcaaacattggacacggaaattcagggtttgtttttttaagaacggagggagtatgtaattaatgggtggcaatttagtcttttattgatggtcctcgacactccatgttagtattattttttttctttttaagtgtggttttgtatgttcagctgtatgtatcttagttatgtagaggttagaggtgttctcaggataactgtatcactttgatgtaattgactaagtttaataaaagcttttattatttaaaaatataatcgagtatatcttaaattcatagtataagaatatgttacattctgttctagaatttttttttcttgacaggaggagtacggaggaagacggcatgggcctgagggtgtgcgagaaggcagcctctcgcacaaagcagagcacatggcctcattaaattcatcagcacttgggtcgtcgaaacagccctgtgggattacgtgacactcgatcttgacatcacgccgcaagatactgacgtttaacttgccttgataactgcgttgccgttgttgagtgttgaccctcaccatgtaatcaggatgaagatcagcgcaaaaatggagtggccctaattgactaaacatcgtgagatcgatgcttatcggttcccctggcccatgacacctataatctcattcggaacttcatattttgatagactgtaaacacctcagctaaactctgtttttaaaacaggcctgttcgcttattctctccctcttccatgagaagcatttaggatacaattaaaatactaaattggactagcttgttttcaggatgttgctggttggacggtaaccagaagacattgtcgtcgcaaatcataaggtagtctattccattatcagcaaaccgcagagtgcagaaccaaaaaaaaaaatactgaagaccaagccatgatcacagaactgtgatagaagcagtattttgggccatgatatgtgccatccatcatggaacttctctgtgacgtttgtaaacaaaattaacgaaggagcctcgaagacgtcatggaactagactgcattttgcatcgcatattatactagtacatattgtaagtttgtaacattttggtgcccgatgtaaatggcaaagcctttccctttttaattaattcttccatagctagttaggtagtggtcgccaattgacatgtggaccagaatatttggctaccggaccagagctgacttcacttaatccatgcatgtgttcgtgttgctcctgagctaattctagtagcatctttcagaggactaaaaatccagttacgtgaaagaaaagattgtgtggccggctctatctttggcatgcattagatgtatacaaaaacaaaaaaaacggaagattctcttacagatgaatacgcccaaagttctctactagtggcactgctagaatacaacgttttggcacaagtttggcagctcttcgcaacttcaccaatacaaaacttcacaattgttcgccaaatccttagccccgttaccagcatgggttgagttagctacaccagtgaatcgatccaaacgtacgtacataggacagcgacccccactcaaaattctcaatgcaaaaaacggtagaaaaagaaaaggaaacggaagcaagccgcacgggtgaagctagcccgaaagggcatagtagtagtagtagtaggctgatggctcggtcggtttggcttggcttttcatggtccaaaccgcacgacgaacccgcgaaagcgaccggcgccgatggccgatgcgacacgcacgggtgtgttcccatctccgcactgtgcaccacactgttcgtttacgcggccacaacgtcagaaaggcagagcttcccgttccggacgagtacaaacaaccgtcccggaacatgtacgtgccaacccccgcgttcacgtgcgcgtcgcttcacgg

SEQ ID NO: 68473 - DNA, 6150 bp, Oryza sativa
ccccccccccccccccccccccgcgcgccgtgcccgggcgggttggcctcctgctcgtaatccgcaccgcgacacgctcgctcgctcgcgttagctgctcgtagcctcgtagctctgcccatgcgctgcctgttacgtactccctccttcaaaaaaaaaaaaaaaaaacctgttttctgtgtctaacgtttgaccgtccttcttattttaaaaaattataaaaaaataaaaagataagtcacacataaaatagtaatcatgttttatcatctaacaacaatgaaaatacgaataataaaaaaaattcatataagacggacagtcaaaattgaacacggaaacttagggtttgccttttttaaaacggagggagtagggataaaaacgtattggaaatttttcggttatcaaacttgtttttgaaaaaaaaagggaaaatgttcgttgttgagttgttatcatattcaataatatgaggttttctatttctattccagttaagaaaagtatgaaaataaaaataaaaacattagaattattttcgtctgttttttaaccattttgaccccaggtaggtggtgggttgccgctactctgtgatgcacttgatggtgcagaagtaagagttgtgtgatttcaacttcgagatcccgtgtttaatttctaacacataatttctttaaattgtttggagggacctcccctctttaaatctcttttttttttctgccgcgactcgcaggtcacgaccacatataggagcaggcggcgcgtttgagcggtaggtgcgccgaagacagcagcgggggaggaggtggatacatacaggatacgtgttggtcaagtccactctccatatataccactacaccacctcgtcgctcgggcagttgctgctgcagcgctgctcactgtgccgtgtccacctcgcgcgcgcctccctcccgttcccgtatagcggtgggggctcggctagctaaccgtgtgtgatcgagcgttgcgggggggagaggatggggaattgccaggcggcggaggcggcggcggtggtgatccagcacccgggcgggcgcgtggagcggctgtgctggtcgaccagcgccgcggaggtgatgcgcgccaacccggggcactacatcgcgctcgtcacgctccgcgtcgccgaggagcgccaggacggcgacggcggcgcgcgccgcaccgtgcgcctcacccgcgtcaagctcctcaagcccaaggagaccctcctcctcggccacgcctaccgcctcatcaccacccacggtatgcgtatacatcactcactcgccctttaatctccttcttccttcgcttcggttaattcttcgtgcgactaaaccgaatgcgtttgttgtgatttttgttgcagaggtgaccaaggcggtgcaggcgaggaaggaggagaaggtgaggaaggcgcagcagcagctggaggagtcgaggcagaagctgcagagcaaggcacgcgccgccgcttcggcggcggcggaggtggatgaggccgcggaggagaacgacaacgacagcgacaacttcgacgacgaggcggcgttggatgcgagtcttgatcaggtgggtttacatggatcagagtggtagtaacctgtcctgctttaatccaaccactttttgttcgatgctcccatgcacgtccgtggcatgattgatacatgctcctactacttctttaaggctgtgttcgcattcaccttttcccatccccttcccctcgttttccgcgtgcacgtttttcaaactgctaaacggtgtattttttataaaaagtttctatacaaaagttgcttaaaaaaatcaaattaatccctttttaaaaaaaatagctaatacttaattaatcacgtgttaatggactgctccgttttccgtgcgcagaagttgggttcccatctcccccatccgaactcagcctaaattgtctctctcagatgctgtcgttagttgttcctcgcgatcaccgtgtccttccatgattctctatctccttttaacttctgtctatctgactttatcatccaaaagaagtgttctttttttttggttttgggatttccatttaagatttttgcaaccgctgaatctccctagtaatcacggaaatcaagagtcctcgtcttaatgagcccagttgagaatacagtactacctattcccaacctccaagtgacatgcattcaataagattataaggttgtggccctatggggccaactggttttaatagttggtttctctaaatttagtgagtggagtagcaactagtgtcaggtttccaggaccatattgcgagattccttaccacttctgagaccgcggcaacatgcaaaggttccatcttttctgattactctactgtttacccacctgattgcagttggcgcgtcaggacagcaaccggagctccagcgcgcggcaccggcaatggcggccttcgctgcacagcatcgacgaaacgacggggagctgatgccctgccaatggcgtcaagcatagaacacgatcatacgatggttaatcgtcgagcggtgaatctgtatttttcggtgtttcacccggccttgattagctttgcaaaggttggcgcgtttgcacactgtgaagttgagtttgacacctcaggatgacagggctgctcgggaaactctggccctgatgaatccgtgtaaattttcaggctttgatggggccttgttgtgaggttgctcgttttttctttcttgatacatttgcacctggaatcagaacaatgttgctccagaaaaaaagagaaaaaaaaagccagaaaaactctgtacttgatgctctcctacaaatgggaatcgagcgcatttcatgatcatagttttttaaggatgttaatctgtttatacaagtataattcttgatgccaaatttcgcaatcataagctcagtgcccagtgacagatgccgagatgcacctgcagatggtggaatcagcatcatcagagcattcggaggttggaaactcatcatgctgattcgcgtcggcgattgcctattgggatatcaaacatttgtttaagctgttcctgatgtcctaacaggacaagtggtaaatgtctcaaatcaagatgcccacaagccaaggccaacattacctaccactctaccaggctgagttatgcattgacgcagtagaccagttgtttgttttcacatgcatgcctcagaagaacacatgagctgacagtctcactgtcccactgtatattaacggcaagccacttgttagcgtaggatataggtagtcttctggctctctgctagcaacagctcgcagaaattaaatactgtcagctactaaccacttgttaatgcagctaattagccccaacttctagagcgagtgagtgcctgatggctggtgcttaccagttaccagccaccacaggacatcccagccattgcacgctgcggcccctcgccggctcagtgcctctactttaatttgcagtgttgctcctgcagtaacactgtacaaaagcaccaaaatgtatctcctcggcacttcatcctccaggattcaattcggccgcggaacaaaaatgatggatgacgaaacatgaacgactggtactatttggcatgtttccttcatcttatcatcttggtatggacgtcccaggccaggcttcagggcccttgtgctggtggacatggcaaaagcttgcccggcacgtgcagtccctgacatcagatgagcggcacttttgattttcagttaaagccacggaacaaacatcaaccgtagctcgagaatcagaggaatttggatgatccttatccatggaatttggatggcatcacggcacatctgcagtgtacctgggccctgtttagaagattagcccagagctaattttgagagctagtacttagtcatgaattggtaggctaaacattagcctagggtggtacgtttggatccataggctaattcaaggctaaaaggtggagaaatagtagaaagagaggagagagaaggagatagagctgccttttgatggtcaccacacaaaattagccccattagcaccccttgaaggggctaatgttttaaggggggctaattcacattagctcaaaattagcccacctgtttgtattcttgagagctaatttgaggctaaaaggtgaggggtaaacattagcccatgaaatcaaacaggggcattcacctgtactgaatcctgcatcctgcaatgcaaaagcttttagggcttattcgtttctaaggaaaaccaaaggatttccaaaacagaggatttgaatcctgtatacagcattcggtttacaggattgagctataggaaatttgaaggaaaatttccttttgtgccagctgtatcggtaaaacataggattttttgcatctagtacgacctcttggaaattttcctggcgcgaaaagagcgcgccacgagcgcaccgcgcgcgtaatcttttcgctctcacgacaaaaaaggtaggtaccggcgctgaaaggaaaataaaaaaaaatcacagggggcaaacagactcgcatagaagccatcgcctttgatcccatctcctctaccacttcctctcctggctccatgattgggtactggacctcctctcccacatcgatcgccggcaccggatgcaccttcgccgcccaggtgacaggacgcaacggcaacaacgagaagagccacggcagagatcggcaaggacgcgttgattgcaggtttggtgcctcctcttgcgttgttatgcgtagatctgatgccccctgctgcttccttgcatataccttagcatttgggtcgccgcgaatggggtcgcagctgtaacacacaagggttcatagcgcctgcccaatggcaatcttgtttggttcagagaagttgttgccggcgggcggcggcgatgagcagcaacaagtagtatttgcataaccagcatctacgagataaaatttaccaccaggaacttgaaaaccatgattaagtgcattatgtaaaactcttgcatctgaagctgatccctcccatccaggatgtatatgcacaaacttcaaatcaaaatcacaagcaaccatacaattctgagagattgtttgcttcctatttctatatggctcttgctcatccaatggaagtttcatagggatatgagtaccatctatagcaccaatacaattctacacagaaacaagacatgtcaaagttatttttgtccagttcatgaaaaattaggatattcaaaatatgaaatcagaacaacttaacaagtggccatgcctgaaaaaaggggtaaaattgtggtttcctcaagattggatgtgggtgtagggatggtgcacgaatgtagacagatgtgagatttgtgattgcttccagcactgctttgaaatatctatgtattgtatctggactatgctgaaaccaatcttgaagtgtttcattggttgcattttttgccactgtatataagaatatagcaatatgctcttctactgaaacatatagtgccagttaggtactctttctcacgtaacttattgactagtgcatgaaaaatgtcgacctccatacggaagtttcttttgcataatctttcatgtcctgttaaaatctcatgtacacggcaaccccctgtaagttttgacgtgtgcattggtctcctaatacaagatgattgtgatgaatctcctaaagtaggcagaacaaaatgaatgaactcatcatcactttctgatatacgtcggtagcttggattcatggtgtgcagatgttaccaaactgatgctgtaaactcaaatagaagagagctaaaaatcaagacttttgctgaggaaaaaacaattttggtgcaccagatgaacaagtagtaccttgttgttacacgagcaagtaacgtccagctatggtggctagacgatgagtaaagcttctggaaaaattatgcagatagtgaagagaagagcaaaggatcagcaagcttcttccacagttgatgagcaaatagaaagaacaggggaaaatggtgcacaaggctaacgagggctatttatgcacttcaaagctaacggctagttgagggccgatgtcagttgatgcaaac

SEQ ID NO: 68474 - DNA, 2422 bp, Oryza sativa
cttctcctgcggtatatccgaatgcacactttttttaaattcctgacgtttagcttcccataggattggactccacagctatccctattccttcatttttcctaatcctatgagtgaaaaaatcctttaaaacgagtaagcccttactgtgacgatcagtatttatcgggaacggggtctttccttttcttttggaggctttaacttcttccagcattttgaccgttccgtaccaactaccaagtgagcttctgatggttttgtctaagaaaaccatgatttggcgatggcagcctttattgaaagacataccaagcgctgggtggtcacatctcagggcttgtttggtagaactctaacttataaatttagcttcaagagttgggtctggagtgaagttgtggagctgtctaaacccagctttacctttctagttcattttatgagagaacactagctccgctcccatttcaggtggagctgaaacggtttggttgagctccagctccgggagaggtggagttggagctggagctgtgacaaacaggccctcagttcctagatttgcattgacgctccaacgggaatattcgtgcacaagtaatcgagttttgtatatttaccgacgaatggaatacgcatatttttttttctttacttgaactcccgtgcagtgcactggagatgacatcattagagcatcaccaagagattacatataacctctaaaaatttgtttttttttcataaactcaaaataggaaacaaaataagtaatatcttaaagaaaaacctaaattttattaaaaaaaatataaaagtgagaccttattaaactaccaaaagaatttccattttacttcgtcagcgcacactatctcctggcgctcccctgaagccgcgccaggagaggaggaaggtgggagcagctagattggaagtgggcaaggaagccgctttctcccgtatatcaacagagcaaatatttcgggaaagagaactccaaaaatcatgcaactgagtaagggactcgtttgagtgctttctttcactaaaatccctcaaaattgattttgagatgaaatagggataaaatagaaggactgttggtgatgcttatttattctcctgttttatagggttttaacgaattgagatcaaatacagtagctattaggactgcacacaatctgagccctctatgtctaaatctaacggccaaaaaggatttggcacagtacaattagaacagtacccttccacagtaaaatgctacagtgttttctacagtctcagatgtatctcggacgtccatttttaatcatgcgatgctagtgtgactgcttatcttgcatcacactagctactgcacctgaatcgggtccggtttaaacatgtgaaactcggaaacggctttttagacgaagacagcccacaaactcataggcctacacgccacagcccgagaaacagaagcccagcaatccggcccaaacaagtcactcagcagtcagcaggtctcacaggcccaccagatagtccatgggccttgggccgagcctatccgaccgccttcacgcgtccttccttccgacctatatttctgcctcgccctcctctcgccccttccccttcgcgtttgcgtttcctccgcctcctcactccaattccattcgccttccgccaccaccacccttggctcctcccctccccgcggggcgcgcgacaaaccctagaaccttctagaggctagagcggtagagccatccgcgagggccccgggcgggctaggggcgccgcctacccgaccccgcacgcggcggcgatgccgctcttcatgtcggaggaggagctgcggctcttgggcggtgacgtggccgccgtcgccgagcgggccgacgccgccatccgcgagctccggcagcaggtggacaccgtccgtgccgaggccgacgcggcggccatcgcggcggagcagacgtgcgccctcctcgagcagcgctacgacactctctccgccgaggccgatcgcttccgggccgagctagccgagctcgcggctgcctccgagcgccgcgccgccgatctcgcctcttcccagtccgagatacaccagctccgcatccaagccgtacgaaccctagtttttatttgggttcagctcagtttttcggcttagctgaggtcacactgatcactctgtgctgctgatggggtttgcagattgcgaaggatggcgagattgaacggctgaaagtagaaatctcggaggtgcacaagtccaagtcgcagtcactggaactaattgagcagagggatgcagagataagggagaaggatggcatcatccagaactacctcgataaaatagtaagccatcctgaccattttgtactcccacttctagtgatgcacagcatcc

SEQ ID NO: 68475 - DNA, 1882 bp, Oryza sativa
tttcgcatttttgagatatctatgccctttcatcctgggaactgggaagattttgttttgcattttgttgcataaattaactgtagttgttgaatcggtcttcctgtcaggtaaatctggcagactcttctgctagtaaaggggcaaggatacaagaagttgaagctaagtttactcatctgcaggccacatgtaaccgaattacgcaggtatgctataaacaatttggtgttattttgctgcgtaagattgtagtataaggtgatgcaaagtctttcttgagttgtagactactacctaatctgttatccatggagttttactttaattgtacctattccatatgtttgcacagagcaaccgttggttcttatttagtactttcctgtttaggagaaagatctgcttgaaaagcataatctctggcttgacgaggaacttaaagaaaaagtgaagaacttagctgaactaaggaaatcaaacatggatgaggaggctaggatgtcagcaaaggttgccgaggtgagtcctattccaaccttgacatgtgacataatgcaagcagaaagcaaaacctgattatgttggtttcagcttgaaagagagacttctgaatcatccagttccttgaggcgaagcaaagaacgggtttctgaattggagcaaagggtatcatatatggaaaaggtaaattgtcagatttgttagcttttgtattattgccatcatctaatttttgctttgctttgcttttatgatctaaaggagttgtgctcaacaaaggatgctgcagctgctaatgaacaacgcctggctgcagagctttcaactgtatggtttacctttattcccattaacccccccttgtttatttcacccttactgctcccactccctgcttgtttaaattttagaaaggaaatggaagaaaatgtgtgctgagctatttgtactagaccagcagatcagtccatcgttattgtatatgcacacggcacaccacaacttaacccatctagtgtatctaggatatttctttttttttaatggaatgcactgatgttcctctctataagccaagtcgatgacgcttttaattattgccttttgttctgtttcccttaaaaggtcatgaaacttgctgaacttcacaaagaaagttctgaggaatggtcaaaaaaagcgggggaacttgaaggtgttattaaagcattggaggtaatgcctttacttgtatttaattttgccccgctcatgaacatgaaaatctaattattcttattatttttttcggtgtaaaccagacacatttgaccaggttgaagatgaatacaaggaaaagcttgagaaggagacttcagccaagagggaccttgaaatggtatattgacttattattttggatggttttcttattgaaaaatcagtttgatattgtgagtttcttagttgatcttttggctttcatgctattcaggaagctacctacttaaagcaaaagcttgaaaagtgtgaatctgatctggagaatacaaggaaatctagtgaattgagcttcactccattggttgcatcagacccttgtgatctagcaggctcaccgatgaaagaaatgtattatttctgaaactgtatacttttagtctagcgagatatctaaagcaggcgctattagcatagctaagtaacactttctagagagcattgttcaaggctttttgatattaattgtgttttgctcattaaagcttatcttattgaatgatgttaacttctgtttgtgctgtaccgttgtaaacatgatattatctttgtcccaacaccaatagttcccaaacattttgtagtcattccttattgtgttgataagtactgatcatat

SEQ ID NO: 68476 - DNA, 2075 bp, Oryza sativa
aagttttcctatagagatccttgcctaagggcaaaggggcacctcgacagcgtcgccagaaaggttaccacgctcgaaagtatgaccgtgcccattgctggtctagtgaacactgggctaggctttcgtctgggaccctcttcatccctactgttatggttcgtcgtccccaactccgatactactcgtcaaggcttgcagctaggtatggtctctcgcgctcgcgcccacccgcccctcgtgatgctgccgttcagcgcgtgctcgatgccctactcagcttagctgcagtgtgatgtacgcactcgtatccggctctgtggactgtccttgcttgcacagcgtcttcgatgagttcgatcgatcgatctccagctgctgataattttgcacattcggcgccgttggtttcaacgtgttgtttacagtgaaattcctatgagaaatttgctgcttcccgaggctgattgctgtagtaatttcattttttctttttgttttcttgttgggagtattttgggctaaaattagcgtcaatcaaggtgcgaactgttgatcgtgtacccggaatagatcgaaaaatgtactacatatatatagtgggaatgagctgttatgatgacctaaccagtactccctccgtcctaaaaaaaggcaaaccctgagtttccgtactgacgtttgactattcgtcttatatgaattttttttataattagtattttcatatttgttagatgataaaacatgattaatattttatgcgtgacttatcttcttaattttttttatatttttttcaaataagacgaacggtcaaacgttggacacggaaaccagagtttgttttttttttgacggagggagtacgcaataatttcattaggacgataatgacgacctaaccacttaatgtaactttaagttatttttacgttttcgtacagaaatgacccttaatttctggaccaattctaaaaaaaaagcgaaaatgagaggggagtggattctaatccttcgggattatatcctctcgtgtaccttttcttttaaattttatacaaatagtagtaaacaattatgatttttttagcaatatagggtataataatatctatcgctttaccaaaaatcatgtccaaattcaacctacacgttgagaaaaaaagataaatttagatgtgaatagtacattgctattcatacgttaaatttgtcttttttatcttttttttatcttgacgtgcgagttgagtttagacctaggattttgtggagttgtataaatatattgtataagcgttttcaaatttctttagaatttttcataacagtttggatggtttttaagcaatctagagaacgttcctcgtgggatcagaggagaagaatattctattggagaatatctcttggaaaaagtacaccgaaggtccctcaacttgtcatcgagttacaaaatcgtccctcaaccgcaaaaccagataccggtaaaactagataccgaacatccctcaactaattaaaactggtcacagtagattcttcggtggttttgaccccggttttatcctacgtggcggctgagtcagcatggacccatgtggaccctacatgttaggctgagtcatctatggctcccatcggatggcctattcagccaaagaaaaagccaaattttgaattttcaaacttaattttgacattgattttgagatattttcaacgtagtttctttttcagcattggcttttaagtcaccgagaacacatatataaaagttttacctacaaatttatttttattctctaataagccgttttggcttattaaaagaaaagccaaacgatgagggcatatctctccctctcttctcttctgtgcaggccggtcggtcttcctcggttcctcctctctctctctctctctctatgcagggcggccgctgggcggggcgaggcgggagaggaggacggcgccgcgacggcggtcggcggcggcgacaacggcagcccagcggagctccacggcgtgggcgtgccgcggccgtgcgcgggcgtcgacagggaggcgcg

SEQ ID NO: 68477 - DNA, 713 bp, Oryza sativa
aagcacatcaacttaaacccgatgacgttcaccgggtcatattatcggaatcagctgtatcggctagccccgtccaactcgaactctgccgatcctgaccttagctgatttagactgcagccaatttttactctgtctccgcaacgatcttcatcttggattccacttcgatctgatcttcatctccgatgccaatagtgatagaatttaccaaatttggtcgttaacaacaacataatcttcgatcgcaaccatgcgacctaagatgggctgaggattagtacctcctgctttcctctccgccttttcacggccaggaagggcgccgtcctcctggagcttctttagggtcgcgctggtggaagccgacttgccgagattcatcgctgctgaaagatcgccggagatggacctagagctggcgaagctagggttctttacggcagcggagaaggtgaggagtgctaacaggtggtgtgtttgacggagttggcggacttcaaaacgtgcacccaaaatccctttaaataagcgcacccccaacggtgcgaattccaaggaactgagagaaatccccgctggaaatttctaagtctattacgcgcggcagtttttggacttcagttcaaaattcactcgtgactgttgggcttcaaacgggatgctcgactacacatcaactccgcgattctcgcacccggaatgataacgtt

SEQ ID NO: 68478 - DNA, 1247 bp, Oryza sativa
taacagttcaggtaacctattagaattcctgacaagtatgatattggaagttcaaagcttgcaacaactctggccaatctgcttcacataaaggactgtttcaggatgaaaactgttatctgtcgcctgctaacaaaaatcatcaagtgatcccttgcatttggatctatcgagcaaaacaaccacactatatgcttattaacaggtgggtattctaacatttgatatcattgcatattgctctttcccttatttataaccttttcaatttctgtacaggttgtaccacctatatccctttatttcttttttggtttagccctacatggcattttgtagcacattttaacttccattaatacaatgtttatcaggtagagcgacctctatcatcccacataaaaaaggaagcaatgaaatgcttgttttaaactaccatcagatgctaattgagttcaggaaaaataaatattgtaaccctaacatgcaggaaattctataaccactggtacatttagataataccaacagcactcttcccaacattaaacccagcaacttggttcacaaatccaaggatcagaatatcataaacctccctactcctacagctacaacgagattgtacttcctccgtccaaaaataaaccaacttttgtaaatgaatatagacatagcctatgtccatattcacatacaaaagttggttcattttcagacggagggagtagacatgaaagaagcacgcctgtcaagctactggcccctactgaacgcatggattctagcaccgtaattcagttaaaagatcaatcgaaaatcaaaacatcatagtctacccaaaatgtgagacctagaaggtagtgcctcccaaccacgactgctcagctcaacagattcgaccacccaattcgacccagcaggctaaacctatcctcaattgaatacctcctccaaaaaagccgtctttcaaactacccagggttagcattcgcaggaggagcagatgcacaatcgcatccaaactccacaacgacacagacgccaccatacaagattaaaaaaaaaaagcagcacgaaagccgccaaactatccccaaccacggggggcgcgccgcgcgcgcgcagagataagagggagagcgagagacgggggcagaattgggggcactcacagctgcagcgcctcgaggaacttgtcgtgctcgggctccgtccagctctccctcgacttggtgatggtgtac

SEQ ID NO: 68479 - DNA, 3390 bp, Oryza sativa
  unsure (1)..(3390): unsure at all n locations
atcaataaagcctatttctaggtttcataccacgaccaaagtgttttcactcgacgatcccttactctgataacacctaacgttgaaacatatccttatgaccctttacgccgtctcgacaaggcctccgaggaacctaagggatcttcggctggggatgcccagaaccgataaggccttgtcagatccttcagagacgaaagaccatgtaagatctggtcgtgtaagagttctcgccgtgcgtattaaccaagccgtgtaatcggaaaccgagctttccaacttcacggctgggggctaggatcagagcttattcaacctaggcagatcaagtgtccaagagccttatcatccaagaaaatttctccgacgacaaggctgggggctagggagagtgtacgactcaaacagccgaggtcgttaactaagaacacactctaacacataacatccagagtaagatgcatttgtttaaggaatatttctttattcacataataattcttacttgttttttacatagatctcccactacattacactttttcctaagacatctatagcaggccacgagtattaccaagagggccaatgccagtccatagactggaataccttctcggctaacggcgtcatcgacctcgcaaggtggtctatctccgccggagtcctccgagaacgagcaaacccttcatggaggaattcgagatccaggcgcgggcggtgatctcgcaggcaagctagcacatgtcctccggcatatcgactcgctcgacgacactcttgttaaggcctcatcgatacgcctgccgatgccatcgagttgggcacaggccccgttgagccacgagatgtacccggcgccgattcctcaggagtgttgcggactactcgaagctccccgcatacccgggccattgaggtacagcaactctttaaatatgacgcaaaccacacctcgcgtcctcggagcgtttccatggcttgctctttcttcacggctagcatggttctcgagagttccgccacttcaaattttgtcttctaatattggatacgacgatcttgggttgcaagggcatcctcgagatctgctaaacataacgaccactaagacaacctggaaaccactaacccaacacgggttaaaaaggctactcacttgaggtggttgtccccatctcgacctccacatcaagagtttggtcctcgacgtcatgtgagacgcgtggttcaaactcaagtaccgggattatcgctagtgactcgggctacccgcgctgctgaacatcctcgtcaccagcatctctacaatcgacaagaaaaacttccgaaatcaacactgaacaaggatggtatcatacgcccgaaagcaaccagagttcaagatttgcaaattataaaaaatacaagaagtcctactcttcaaaaaggggaggacagactcccccaggtcactgacttcttccatcacctccttacgcgtgtcgcttgccgccccctgatccaagatatcacgcagatcgagttcagggcgcgacaaccttacacacgcgaggatgtgacacgccccggtgtagataccgttggacgtctcctccgcgatcctggccgaatgcttggaggggatttcccctatcaccgtcgccagctccgcaagagaagaagtcaacaagaactcgtcggggttcaccgggatcgtggacttgacgccgcactcctcggcgagctggtgaaggccggtgtaggtgacccgcagcgaaccacggatctcagagagattgtctccaagttccgacatgcggtcctcgagccctttgcgttggcgctcgttcccggccaccagctccctcatcttcgtgaggtcctcacaggcctcagccagttcccgcaccaaccgctcggcacgcgcgtttgccaccgccgtctccaccctcgcctctgagatctcgcggccggtgccgcgagcaccagcttcgagaaggcgccccatttcgacttggagctcttcctaggtgaggacggcctctgccagactacgaccctcagcgggatcgctaacagggccgcttggcgtcgcctcccgactcccgaccacgggcacgacatctgtcgacaccgtggcaggggatgcgctggacgttcctctggatttggcccgcgcagccttcgcccgcgcctccctacaaataaccacgaatcaaaactccatttgaatagaagacacgagaatccaaaagtctgtttactaacttctcgccgatcgtcacaatgcgctaacgtcgcggaggtggaggagacgcgtcggaagcctgcaagacaaccaatgtggagtgagaataaaccttccttgctacacaacatagcgacgaggtgaaattaccgagggagtcgctgccttgcggcgatgtccgagcacatacgagaatttcctcgccttggtcggagctttgccatcactggtggtagcagcgtcagacgcctccttgacgaccttctccttcagagatgccgccacctgatgatccgcgagcggtccgacgacatcagtcaaaggaagggcctacgctaaatcatatcataagctgatttgagcagagaaggcgggacgctatcgaatgaactcacattgattgcttcgtcgcgctccgtcgcacttttcacaaaggggtgcggggatgtcgctcgccgtggtcgggccgctgatcatcacctgaccaacacactgctccacggcttcgctgctcagacctgtcaaaaaggaatcaatttttgataagttgaagagtaacgcgagtacaagcatgtctaaatgaatgcgagaaagataccccgaggagaaacncaggtcgcgtcgtctggcccggaatagtcataagccggatgggcccgagcctggagcggctggattcgcctaccgatgaagtctgcaacgacttcatatcccaataagccctgttctcggagatcatcgatgatgtcgataaacggttggagagagggggtcaaggagggtttggcggtccagaccggaatcttgtccggttgttcctcgggaacaacgaggaccggatttgaatccttgatttcaaggtaaaaccacctgttccgccatttgttgcgagaagagggacattggaaggggacataatgcgacttcatgccatcacgaagtcggaacccgacgcaaccggataccctattggattccatccagcgcaactcgtagtaaaagcggaacagatcaagaaagggctctaccccaatgtaggcctcgcaaagatgcacaaagacgctaaggaaagcaatggaattggggttcaaatgcagaagagaaagcccatagaaattcaaaaccagcagaaggaattcggagggtggagggagaaa

SEQ ID NO: 68480 - DNA, 1589 bp, Oryza sativa
aaggacttcaggatacaggtcaggaggttgtgatttttatgaacatgaactccttcaggtttcttacataaacatatattaacagacattggaaaaagtcttggagaaagagagagatgataataagaaagaaaaagcattccgcagaaggaatgagaaagtatttactaccgccattcaaaatatgaatcaggtatttcttcctcaactagcctgagtacagtcttgtcttaaaatttttttgtttatcgtcagttgggtttagattgagcaccaaatttatcatggaactactgatttaatacagattgtcacaaagctacacattaagtagcaaatttgtcacaaagctactggtttattgccaatttaatcccaaaactacaacgtctatatcttcaacataactgtagtgctagggattgaaaatctaaaatctgtagtttttttataacttgagcaataaatctgtagttttgtgatacttctccctaaatctgtacctgatagctttgggggagtggattctaatcccttgaggggatgtcccgtcgtgtacctttttctttcaattcgatacaaatagttgtaaaaatttatgaaaaaaattcgacctactatttatatctctcgacgtgtgcgttgcgtttggacctaagattttatggagttgtatacttatgttgtatgagtgttgtcgatcttttccagaatttttcataaccatttggatggtttttaagcaaacaaggggacatccctcgagggatcaaaatagtttccctagttttggcactaaatgtatagttttgtgatttgtcttaaatccgtagtttgtgaaattttctccttttttttaaccgatgcagtagattttctaataagaaaagccaaggaagtagacattaagataatgaaagattgatatgttgacatgttcacagatgaacttagaaaaatgaaaaacttaatgtgttctgggatatacaagatgaaacttttaagtaggatgttttagtgtattctagagttggaaagttggcatcattatgaatgttctaaagaataagtgccattttaaaccttaccaaaaaattggcaagccaaattttggtaaagtttgagtgtttggtttataaccaagtttttgtcaatgttgcttgtgatgtattgattgtttttgccaaaatattggcaacacaaaatctatggcaacaaaccaaacacacacattttcttgcccttgccaatttttttgtatagtttgtttgggctataaaccaaatgctaagtgttcatgtccattgccaaaccaaccctgagtattaagcctatcattatgatctacacttttcgttacattttcttctattgaatgatttcttagaatatgaaatttcactgtttaaagcttgcaaatgtagcatcatttgagtttgctaatggttaatgtttagcatgatcacaggcaattatagtacactatagtaaattattgtctggggtttgcttattggcttttcaggccatgtcccattcctgtgatagcccttaatgatcagttagcatgcattgcagcttgctccaac

SEQ ID NO: 68481 - DNA, 1719 bp, Oryza sativa
gatgtgaatttggttttgaatgatttggcatgtcagatattgttcggacttcggaatgtgatatgatattggatttctaatgcatcattttcttgcattggttccatcgcgtggatctgaataatgtgtttttcctttgctttaccgtcacttgatcaatatggtagttcataaggctgctgcttttttttttttctaatctcagggagacaggtagctactccaccaaggcctgctcaagttaaagtggtggaggagagagcagtttctactttgcccaaaccaagcactgaagtacgtagaccaggaggaaggagaccacttgttcgaccttcacttgaacgagttgaagaaccccaagctgatattgatacaacagtagttgaaggttccacagagaaaggcggcttgttgatggagcgtgaaactcctggtggtgtatctgcgttacagccatcaagtcgtaaacgtctaattccatcaccacaaacgagagatgatgcttcacaaggagagacaacggatgccaatccaccactgaagaaacccaaagaaggatcttcacaatgtactagtgagctaaaaactgaacagtcacctcatgaagatgtcatggcacctgttcctgtgctaccatctacagagttagatgagcaacagcctggagaagagatggacaccgatcagtcttccttgccagttgaagaggttgaggaaacaagggaggatgacttgggtgataaggatgacatggaaacacatatagacgcttcaatggacatccaaggacaagatgcagaaactggtattgataatgatgcaactactgtggaagatgtgccagtcaagtcagaagcggttatggaatcactggaggaagacctgaaaactgaggatgggaaggaagagggtcagtttactgcaaccactgatgttgaagatgagagggaggagggagagttgccagatgaaccagaacaaccagacagcactccccctgtgctggatgttggtgagcaagccggtgattctttcagggcggcatctccagcaggaccaactgaaaagagtgatgttgacatgccagaagaaactggagaaggtgatggtaccatggaatcagaccaaagccctgtaccacaatctggtggagcagatgcgtcaccgagccaaatggctgatgcgtcaccaagccctgcacgtgaaccttctcctaacccagtccaagctggtgcacctcctgaacagcagaatcccacccctcctaacccagtccaagctggtgcatcttctgaacagcagaatcccgccactgcagcagaaggtgttgaaactcgtagtaccagaacaatcaacctaactgagagagcgaggcaaaaccggcaagccaggattcttcgctcagccactcaacagaatgcaaggggccgtggcaaccagtctcttacatacagggtatggttttatactacaagactactgagtttatttctgttgtgttctatttttgttatatccagtgttaattctgatggagaacaatgttttctatgtgcagaaagatggcggccgaggaacacggggtcgtggtgggcgtggtcagtcgtagagaatttaggtttgtctttgctcaagcgcggagactagttttttgcaaaggacatactgaatcagggcggcatcatattcattttgtagcactatcagaattgcgagcgt

SEQ ID NO: 68482 - DNA, 8202 bp, Oryza sativa
atgttagtcggagtaaatgattttgaaccggacgataataagatgaaggctacagtttcacgattgctcatagctaagcagagctagtagactcggggtcaaaagatgaatagattaaagccaataattagatctgaacaatgaaaaatagcctataatcccctacatttgagataagtttgcacccaggatctacaaaagccgcgtcgatctacagcctctagtttggttgtaaaagtaaaatcggatgagacgagccagacacatcagtgtattattaataaatcgaagttctctttcaaaaaaaatccaagttttttttaaaagcatggcaaaagaattttgcctaatatatttatggagtggaagattgataataaatcaaaagattacatcagcaaagaatacattaggagaatttgcatacatgtttcattctgcgctaacaactgggacaacgactttgctactatcattctgttcgattagctatatatattctaatgtacagaagtaacaggccgaggccgtccagtaacgttcacttttttgtgctttaaagaatgggaaacagtataatctccacagaaaaaaaaaagctaataaacccccagccacaagccgcagtagccagccatactgcaagttcttctcctgcatgatacggcctccactccacagtcatcatcggtcctgcatctgtgggtaggtaacacgtctggtacatggcatgcactctcccacggggagccaacgctttgccggaaaatcgtttctggacaaacttgagacgacaatgcgctcacacggaagggttggctgtcatcctgaagataagtttttggtatcattgttcatgcaagtaaggaggaactgggaacagaaactgggatattaccttaacgaatgtccagttgctgggaacatgcgttgtcgggattatctcgtgccatgtgctccttattggaagggggtgaccctccgtggtaaatatgtaattttggttcctcaagaatgaatcatcgtagagaagaaaaagatatttgcagctgcaaataatttgtcatgtgactcagtcgtcagtaccagtgatgactaaatacttagtaccagcttttaagaaataattggaagggagcaacagcttacgtttctgaaagaaagaagctatgttgatgatcttcaagtttcattgtcgaaacatccctgacactagcaaaacctccatccactttagtatagtaattaagggatccaatgatagcttcaccaacttctagataccaaggatctacaggaagagcatatgtcagcctggggaaggagaatgagggaacagaaaaggagaagagctaatggcttctatgtataggaaatctagctagatataatggctgcaatttggcttttcttgttgagcaaacctttagttgcttgataaagataaaatgtagactcagcaaactctggacgtaaaggataatacttctctgtaggatgcaacattccgaagtccaaaagatatctgcaaaatacagtccgaaacttgtgtcagtacagtttagtatcaatcttgaagcaactttttgccttatcacttaaataataagtctttccccccattaaagatgatggtactaatatgtgggaaaaacagtaaatggtacctttccggcagaacaccaaacctttgccatacattgtaaaattcacgatgtgatatatttgcagcagcaacatctcctagaagtgtctggtcatgatcacaggagtagataaacaatgcatgattaaaatcctgcaataaggtgactgtccatcaatttatggaattcagcaaacctgaagacctggccagaaggcttgaaggctagttagttgccagtgtgttgcttctccggtcctcatatcagctcatgatacctatcatgccagatgatcattagtgcttggtacaatcacaacacagtgacaggccagttagctgagatgaaatgccaagaaaaataaaagggtgcaccatgggccatgtcggaaatacttctgcactgcaaggtaagctgaatgaaacatatcccagtattcttcgcttccgaaaagaacatacgctttaatcaaatactcataaaatgaatcaactcctgcaaacatgatacaaatgaatcattattatgtctcaaaagtatgttgtgcagtgacaagatgcttaccgcaggatacaaacacatgatcagtaaatcacatgggaaaatgtaaagagtagtaccagcaccaatgcctgacgaatattcaatccacttgccagtcaagacatcaagggttgtgcctacaagatttagtgaacttctcatgctccacaacttacgaagagcacgaagagctgcagcctcatatctagaatcacccgtcaaacgtgataatgcacccatttcaagaatcagagaacctgtaaaaatgtatattacaaaatagtaagatataactaagagtaatgcatttcccctggaatacagtagaacattctatcacccaccacaccctgatgtgcttgtctcagttgtttcattttccatcactccatactggaaaaaatagttacatggtcatggaattagaagaaactctcgataacatataatatagtaaaattataatacacgacttgtggaaaacatttcgtggttgtagcttgacactgatgttctttgcaagactcgtactcattcagtcatttgttttttggcatgaactgaagcatcctgattggttagttcttctaaagtagttattatcaatactgtacatgatgagcatcactgatttagctagaaatattccttctgtaaattggagtaaaaactaaacgcatttcgtttgctgagctgtgagctattgcctccaaaacccaaaggttcctttctcaatctgatatcttctacgatggttttcaagtagccttgcgtaaaaatacaaactgaaatttgccagtattaaaattctaatattgcctaccctgattaaccacctttgaaatagcaagatcagaggatttgtaaatgaaccttaagattgatccatgcgtatggcaatccagtaggtgtctcaaaagctggtagaaaacgacttcctaaattttcagcaagatgtagtaactggtcctgatatggtccatctttaagatgactgctgtgctcctttgcaagaatatgaccagaaataagccccccaagaagtcttatgttgcactgcataagattaagagaaaatgcatgtgtaactcagtgtcctgaggccaacatgtcatttttaggtgaaaacctgtggtagtaaccagctagcattacctcaaaaagatttattcgagcatcaacatcaaatgttaggttctctgaaagccagagaactcctctttcaaactccgtgaggttacctaagacaacaagactgcatgagccaaacagagaggcattacctatcaaccttgcgaataatagtgttttctgaagaaactatatcatcattcacattctgaacagcaaagacagaagtacagaaccaaattcaaagtagtgaaaaacattacaacttcataaactgtaccttgacaacgattcgactagtgtaagtgcagatccattgtaatcatttggcaaatgttcaagctacaagttggaacaaagtgatgacatcatgacctgctatctcaaagcttttaaaatttcaattaaaatttgcaaacttgttgatactttaatacatttaggttgccaagctcactaagggagtcagtgaaacttttggttagaggcttcaattcatcatgctgaaaagataaagagaataatgttagcttgtactatttcatgtgcgtttaatcgaactgaacattgtgtgagaattcttaagatagctgatggacatactggaaatgcataagtcatatagttgtcataagcatggtaaaacctgaaaagaatggtagtgaatcagtaatagaaaataaacattgcaagacgcagtaatgtgcaaatggtggattaggtgatctaagtatagcgccacaatactaatgtatgatcatactgagctgagatcctaccttcgcatgcttttgtatgtggatagaaaattttatgctggcattattttgtgctaaccttcatatgcagagcattcaggctgaacactttggtgaggcgcatgcatggttcaaaccgtctcagtttgagacaccaaatataatagaataacttaagcatcataaataacgccaatgctcctaggagcaattttgttttccctgttggacagtcagggcaactatactctgccttgtaaatgcaaagttagactagattttcagcatttccctattttacagagttaatgcagtgatttgttgataaaaggttcaggaaataccttggtaactcgagataacatcagataaacaatacaccaaccaaagcaatccttggtaactcgagatgacaactttctcataattgttttataacatgaaactttttaatacttaacaacttgggcacacacacattatccaatcaaaaaccccattctcaatccttctatagcaaacccgtgccttctttacaattacaggcttaagttcgaagtgggggcattcgtctcaacacattgaacaaagctttgcatcctttcaactaaatttacgacgaatttatcgtagacctcgcgaacaagtggagacgaggcttaacaaaagtgcggagatgtcttcgttctccgcgatgtagccacaaccaaaaagaaaaaaaaatctaaccaatcgaccgcgcaacgaaagagagaaaagtcaagagagcatctgagcatgtagcttatggcatgtcgagcacactcacatctccaggaccttgttcctcatgtacagcctcctgccgcgcccgtacccatcgccggcgatggcggcgcccgccgcggctcccccggcgagagccgagaggaggaccgcagcggcgacgagccgcgccggcactgggcggcgcggccggggaggaggtcgcatggggttttcgcgcggggtgcggtgccgtggggcgtgaggatggtgttggatggggatcgggcccgggcgagttcgttcgatccgaaccagacagctcgttgcttccgagattttgctacagggcaccggtctctctctctctccctctctccctctctttttccgcgagggtaatagtctgccacagaaaaaggtagggaaacgctatactcgctcctccgtaaaaaaaaaaaaaaaaaactcaatctaaaattaagatggtacataatctactataaacatgttcagatttattgtactagattatggccatgtttggttccatggactaattattagcccccaccttttagccctgaattagggctcaagaatccaaacaggtgggctaatttgaggctaaagtgaattagtcctcctcaaaacattagcctctccaagagatgctaatggggttaattttatgtaaggaccataaaaaagcagctatctctcctctctttctactctctctccaccttttagctttgaattagcccatggatccaaaaataccaccctagactaatgtttaacctaccaattcatgactaaacattagctctcaaaattagccatgggcaaattttccaaacagggctaattaagtacttttggagacggagtggccggagacggagtggccgagtgggtacttcctctctaccaaaaaaaaaacaatatctttcacaactacacaactacagtacattatactgtacatattcattttcttaaagttgatcttagtgaaagttaatatttaatgaaatatatacgtgctaaaaaactatactaatatattttcgaaattcattatgctccataaggggatgtgttttttcttattacacagtagatgcatacacacaccattatacagacaacattgcgctcacacaccggcgaactctttgcatgtcatgtagatgtttatgaaaattaaaatttgataacatagataattgtataatatattgctcaggaaagtattctaaactcttgaggtgaaagtttaaagtcgacctaaccagttgaaaataagcgaatataactatgaataatgtacttgtattactcattgtgtaatttatatgtttgtttgtttcttattctatatattacatctcaattggccttttcgagagtatcaatattgttaatcttttcagacttttataactatttgattggtgtttttttgacttacaagacgaacaaatgagaaaaaaaaaagttccccctaataaatagtagtactccacagttcataaatattttctagtgttgaccagaataattttaattatgatcattaatatttttgaactgtctaggctaggatgatcgaaaggttaacgattattatatttagaataggacacaccgtcttttaagaattttcaggtctcttatacaatggtatattacatgtgttgtgtaaactgttgtggaacaagatatatgatctcattcatatatatggatagatcggcaaccaactcagggacacgacagttgtgtcatgccccacgtcttctcactctcgtggcgatcctggcaatgggcgcaatgtttctcaaaccatcgtgtctccagttatcgcctctctctcccccctatatattgtaaccactgtgatcgataaagaatcgctcgctcattcgctctattgtgtcgtcaattctctctcgctccaatcaatttcatccactttcaacataaaccttgtgcagttagcattgtgccgccttaggaaatacagtgacgcaacttctacagaaaccaaccaatcaaaagaacgtgcacattctgacgtggatgtattgcaggcgacaatggtctggtctaccagaggaagtatataagttgccacatcagatttgtgcttgcgtggaggagagatgagaggagagagaacataagcgggctacagatttgtagccaactgcagcacgagctccaataaattatatgagagagatgtgtggattatacattaatgatgtagtatatttctgcagctaactattgtatgagtgaactatattagattgactataaataatgttttaaattttgaagctagtagtgagctatattattaaacttgctctcatgaaaaactttgatttgtccatttgaactaatatcattttgcctggtgtgtcatcgaaaaatactttgtcttctaaacaatggtttatattgctacaaactcaaatggaactttgattcaaaagcaatgtgatacaggagaaatcaatccagagaaaggggaaaaagaaacagcttgtacaaataaacaacacgcacgcacatagagagtgacctccagttctcgtacgagcagaaattaaattactgaatcgaacaggaaactcgagtactcgacacaaatctagcttattcacgaatgttaacaaaccaacgatgaaaaataagtcacgcacgcaaaacaaaaaaatacaaatacaaaaacgaacgaaaaacaatcgatttagcgaatcacttaattatgatatgacgatcatatcgtcctcgtaaaccgggcgcgcgcgagcgggcgatcgatcgatcgatcgatggatcggatcagatcagatcagatcatcacttgggcatgggcccgtggttgtaggtgtcgcagcgccgcctgatctcgccggcggcgccggtcttgacgccgaagaggctgagcttgtcgatggcgcgggagaagtcgtcgaagaaggcggtggggttggacgcgtagagcttcacgaacggctgggtgcgcttgtccgaccacatctcctcgtccgtggcgaggaggccgagccctcgctccaggttcacgaagtacatgttgtcgaacttcccgggcgtcatcacgtcgttgaacgccgcgatcgtcgggtccttgaggtactccttgcacgccgtctgcaagcccttgctcagcaccgggttcatcgtcgggtccacgttcccgggcttcccctggtagtcgtagatcctctgcgcgaactccttgcagtgcgagaatcccagcgtgtggccgccggacagcgccaccatctcctgcaccgtgaaacccttgtcctggaacaacttgatcacctggtccatgg

SEQ ID NO: 68483 - DNA, 2639 bp, Oryza sativa
agcttgtcgccccccaacggctgccccgacggcttctcgcccaccaacggctgccccggcaccacggctgccccggcggcttctcgcccaccaacggctgccccggcaacggctgccccggcaacgattgccctggcaacggctgccccggcaacggttgccccggcggcttctcgcccaccaaaggctgccccggcaacgattgccctggcaacggctgccccggcaacggctgccccggcaacgattgccctggcaacggttgccccggcaacggctgccccggcaacggctgccccggcggcttctcgcccggcaacagctgccccggcagattctcgcccgccaacggcggccccgcgcgcgccccgccggccaagacgccggcaaacacgacgaggaggaggaggaaggacggacgcatggctgctgctgctgcttcttggtttctcagctgggaagtcgattgtttcccttccctcacatagagtttgaggcgcgcgcgggtgtggaatggcaggtcgaagaaatgcgaggagaggaggggggaggagttgggtttgctgttcttggaggcggtggagaagaggaaatggagggggagggagcggcgggaagaggtcgtagagaggaggaagaagaggagaggtacgtactatttctggatcaacgtgcaatgctggtttgccctttaagtaggggtgttagtgtccgtttgcccttcagtagcagcctctggttgtaaacgtgtggtgtgattgttttttctatttctggctatagcattttagggttatagactttaaattttttttccctgctctatcaatagaaacgttgcactaatgtacgggttgcttcaaaaaacgtgcagtgctggttcaaaacctgtcccttgcattgccgttttcagctccattaacgttcctcgagttaaccatggacgttcatttgtaactccgggtttttcactttttcgtaaatgcaatgattattaattagctcggcagttgttgagtatgttgatggagaaaccagccaaactgaatctctctatgacatgtagctaaatcagaaatgtgtaacttcacaagataggaaaggaagttctgttagaaacttttcactgcctccgtttcaaattacttgatgttctatgtttgttataaatcaaatattttaatctttgatcatgaatttctataaatttatataatttaacatcgtatcgtttatatttttagattcagcataagcaatacttacataatatataattgaaatactgttaaactatacagattttaaaaattaatgatcaaagataaagataagacatatttaacttaggataaatctagaatggtaagtaatttaaatgaagtaatgaaaacagagttgctgaagaagttatgctaagcatatcataattcatgacatgcccatgcaaaatggtcaattattgatgtttaatcgattgcgtagatataagatcataacttgcccatttccctaagtgccaggtagtaaaagatcaacgtagccatcacctaaaaatttgaacgaatctgaattggattctggctgcagtgtacaacataagacagtttcttgaagctgtatacacacatcattaaccattttggttccgggtgaacggatacagcgccagtaagatccccaaaagaacactacatgtaatattttacatcatttctgaaactgccgaggctcctgacttttcaggaaacaaaatgttacgtcacaggagaaaaaataatttgcgagggtgtctttccgaatgtcaaactgagattcctgcctatttgatcccatggagtggacgacaaagaaaaagatatttcttctcggagcaactcccttgggttccatttcctgggagtagtaacttgcagggaatacctaaagatcacagaggaagataactaaatactgcagaagctacctcaaatcaaaatatgttattatcaaataacacactaccttcctcagcagggtcttctcttgtctactttcaaatggatgttgaaccatttcttccttcgaagtcgttccttaggtttcttttcctttctaggaccatcatcatcacttctggatccctccatggacttgctcttcgatttcttttcctttttcacagtttggtcatcatcacttttggactctttagaggatgttttccctttgttgctactggaactccgttgcagagttgtgttgttggtgtaggatgcatgaattgcattcctttccttgagaagctcgtcgatctataaagaaaacatgatatcagaacaaggtcagaagcagaaatgaactaggagtatttcacaaatacaaacagtaccgtctgcatttcttgagcgtatctgctggtcatctcggtgaacttcgctaagacctgaaaatttcagctattaacaaaactatctcttggatttgcggacacaaacaatttaaaaggttggattatacctctctatactcagactcaaatttagacagctcagatcgttttgcaagtatctttgcctccacgcatcgtagtttcaccttttcagtacaaaagggttcagcacatacaacctctatattataggttgcactcttgaaga

SEQ ID NO: 68484 - DNA, 15737 bp, Oryza sativa
gatcctttgcagcagcaacctggcagtaactagagctggtaaagaggcaccaaaaacaaaaacatagagaggtagccagacaatagcttgcatactcactgaattattttgttcaaagcgatagactggaaagccaagaaagaacattccagcagaagtaactttccctgtctttacactgtcttcctgcactaacatgatacattagctgaaaccatgcccaaaacatcaaaagactagcacaataaaaatatcaaatccttgtcattgggtactggatagaatgaaaattggatgaaaaagcagtattggtgcaaagcaacatgttaatagtcaatcccacagaccagaatttatttcaaagggaataatataacttggaaggccttcggcaaaagatgtcagttgcggatgtttgaatacagcacgcagacataaccaggattaatcccgtttcattacctgaatttgtcatgctagtgtcttttcaagtgctctgctaatttaaactaatcttctatggtgcataaaaccacatataaacaagaagcatctttccaggttaagctaaacagagaaaagctttttaatgtcgaggaccctggattcctaaaggcatcattaggcagtaaatattttgtatcgtacaggccatccttgcaacattgactacacaaaatcataatattcgaagtttactagttatgccaatatggaaagttttccatctatattatgagaatgaaggctcacttaagtattttatttacagaaagaatagtcaccaaatacatctaccaagaggctttctgagtttgtcttgctccacagttgtgatggaacaatagtttgtcaactgttactagtggagtagtggtgcactcaagattacaggaaaattcacagaaaaagaagtgccagccaattgtaacatagggttaggaatggttctaaaaaagggaggtatatctctggcttgtgcaaaaaatagagtaaatagttcaaacttgtcaattaaccagaatgtgctgtggattatattgcataaacactttacaggatgaccccgtgacaaaacaatatccaactcagtgtgttttggattttcatgctagaaacttacgcagataataagctagtcccaaataggagtattttttgtaacccatttttagtttgtttctaggactagcaaaatataagaacagactatacatacctgtaaagcaaggcttaacccaccattttcttcaggctcgaaatatagcaactgaaagaaagagaaacttaccttagaatctgtgcatggcaaaactttctaaacttacagtataattatacatgtatcaagtacttgattgtttttactttcgaatatcataattagatatcatggcaatctcagaagaaacagacagacggctaaaccaagttcattattatagcaattaacattgccacctttggccgtaaaaagtttttcaagaacaacagctcacatcacaaccacatttcttgttgttgagaagagaaaatagaaagtaacagctaaagtcagctaagcttttcaacatacaactaggaggcggcaatgctcatcagacaaagttgtataatggagtagttactgtcgaaagatcataacggacaaacactaacaacaagttagcaactaaccttgaatttacttttagcagttgattgaactctacacactaaccccattttggcttctttatctgttatgtccacagaataaaagtgagctgattgcttttccacctgccaatatgtgaaatctgaaacattattcactgacaggaaaaaaatggaaagtaaattatgggagatagttgaataccttcctaaagacggactggccaagctcgagttgggaaattcccaccgacccattcaatgcttcctctaaaactgttgcagaaactgtggtcttgattggtacacctagcttgctacacaaacataagcataattaaataatcgattaagtaagatcaaagtaaatggctatccttaacaacctacctaaacagggcagcaaacactgtatttacagtgttcagacttgacaggtccaactccagttcctgactatctgcttcaatggcctgaaagataacaaaagcattacaggcagacaaaatcaagcagatcaaacatcatgcttttgtatgccataaattacctcgaatcccgaggaatcatactgccgcctcttatcgggatctgacagtatgttgtaagagaatgtggcttcttgaaacttgtccgaggcaacagggtcgtctgcattcttgtctggatggtacctgcagtaccaaaaagcagaaaaaaaaaactcacttcattatcgctcagtcgttctgcaacaattaccacacaagcaaagcaaagtaccagcatactaccaactttttgaacgtaaggtaggagaaggcttttttttttctttttgagcaagggctcgaggcccccatttccattaccagaaatgagacaggagaagccttggtttggtgtttgaatctaatacacggttctaaaagctcagtgaacagctcttgtgctggtgttacaggagatgaatttattcaaagtgagccaatttgaccaaaaagtgcactccgttcttcagaaatttgaacaaaatccttccctcccgaacataacaacagcactcaaaagtgaccaaatccaagaagctttacttacttgagggccatgcggcggaaggcgctcttgatctcctgctcggtggcattacgccccaccccaagcacctcgtatgggtccctcctctgcgccgccgctccggcccccgccgccgcccccgccgagctccccttctccgacttgaacgacccaaacttcgaccccgccatgaaccccctccgcggcgccgccgcaacaccaaacaaaccccggcaacaaccctaatcccacccccaaaacctcagatcttactgcttgttgaaccggtcgtcgtcaggccctgccccaccacccgccgcggccggccggcggcgagcggcggcgcagcctctagggtttcccccgcggtctctcctcgaagagcgcgcgaggccagctcctcctcggcgcggacgtgcgcgtgcgcgtggtgcgcggcttctgctaatttggggaggtggcgagggaggagtccaggactcgagagaggccgacgaaatggggggaggagaaggcgaggaggagagggagaagagaccaagacgaaattattttggtgccgacatgtgggccccaccgcgcagtggcctcgtcgtcgtcgtcgggcggtgaggtggcggcgggtgcggtgcttcgctcgagtatactcctatgtgtgctcctgattaaccgttaactactctactcatcggctcatcgctcgcaccgatttgatttcgaaatttcgaataaatatagggtggcccacatctggtggggcacacccgtcagtgagatgactgcagggtcgaaatggtagctgaagaaagagttttttcgtcgttcccgcgtaaggattatcaatttgtggaaatgtgggttgttattgaagtgttgattacgctgtactctctgtggccgaggtggggatgggacggtgacaggtgtgggaccagagaatgtggatttagtgctcaggcccagtggccagtgagtgagaggacctgcatttaggatgcagcttcggagtatctgaccggttacattttcgttggcattaccaccgttgaagctaaaaatcatgcgcgcagtagaccatttctccaccatcacaccaaacgtgtaataacctttttgaccactgaaacaattcacagcttttagtcagttttttttaagtggaagcggcaaatattacaaaatagagttgaccctgtttataagaaaaaccggaccaaaaactatacaactatacggtttgctaaagtaaaaccgataaaaaccttacacatagagacacagaaagcctgaaggcaaaaacgactacggaccgcagaaggccgagggaagagcaaaaaccctaagacgaagcctccaaggaggtgaacaacgacataagccgttgtcgacacccgcccatcagctggactaagttttcacacaaggaggggagagtccacaaggcaacacctccaaggaggaaacagcaccggcaggcgtcgatattgccgatcccggacgactaagcagggcttttgcccccggactcactcaaaagtgcaggacctccaagaagtaagaggaaacaactctcgcaccatagaggtaagcacaccgcttcaaaattggcgcttcaacaagttcacacagccagcaccaacgaggcctaagagccctaactacagacagacaagaccaacaccgcggacgaacaaactcctcaagcaccgaaagagcactgccagatctgtaagcaaatagccaatggagggggcaccaaggaggcatggtcggcctggagaggaactgagatatgaagagagggcacatagacatcggtgtcaaccatatttccggcgaagaactccgggcttcgcgggacaaaccaatcaacttcagcgaccacctgcgacttcaccaccaccacagagagatgagcactagggggaggggaaggaagagagaaaggaaggcagagagaaaggaagagaagaatggtggtttcataggggcgtgggaggtggggaggggtggcggaagaaccgacgccccccccaagctggtcgacgcgctgccgactcgaagccggaagccgctgcccaccatcagccgccacccaagcgctagactgccggccaccacgagccgcatcgaccatgccgctacgcgccggacacgccgcctctacatcgcgtctaccgccgccgtcatcggagaagatcttatggctgcggggccggatctaccactgccggcgaacgtcgcttcccccgcgccgcatcgtggaggccctgttaccgccatcctagctttgccggtggcggtagggttttgcccccgtgtcgcttgcgcatgagtgacgcggggggccgggggcgggaccattaactgaattatgtttaattagttactccatccgtccaaaaaaaacccaatcctgggtttgaatctggatatagtgtatgtccagattcaaacctagaattaggttttttttgagacggagggagtagttcttaacaatatatgattgatgatttcaccaagtacctcgtatcaatcacatcgagtaattcctaacgacgaaggccttttatactttcattataaaagatcactttacttgcaaacatccacctgaacaccgacgagtggttaactaacacgtagtaaagcagttctctttttttcatcgataccatgttcaactccccaagcaaagcattcaatcatggatagctcaagatgtcctccaaaaggctgttacctcgcatcagatcagatgttcccgcaaacaaaatagtacatgagcaaggccctaaaacaagctcagaaacagtagccagacgcacactattcagctacagcaagatcaggacacgcattgcaggctgtacagattgatcaaaggccccactgcctgcctgtgaaattgtccggttacacaaccccaattgcatatgatgatactatgaagcatcagatcttgaaatgattggcatcgatgtggtccacggatcatcaggcagacaaaaacacgagaccacatcaaacgggcgccttccacggacaccagcagaggcagcagcgcccgagagcattgggcccagcgagaaatcgcccgtgggccgacgtcacatgccgatcccgtttcggcctaaattgccccgcatgtatgttcgtggaaaaagtatacttggactccctcaactatcgaccgagtatgattcacgtcccctaaccaaaaaaccgggtatatggacttctccaactattaaaattggtgcaaacaatatccctcggtggttttggggtggttttggctgacatggcacctacgtggccggtcttgaccaagtttttgtcctacgtggcgcttacgtggtattagaataaaaaaataaaaacatatgtgggacctatatgtcattctattaacagtgaaatttggtaagcccagagtagtcatcggcttagagtcagcatcggcttcgaagtcctgagattagccgatgagagttttcaagtcgtcagttgtcggattcttgctatattcggttaaggaaattgatctactaaaggaagtttatccagaagagaccgagttcaaagagaatgcggcatggcaagttatttattaattaggaatagtttgttagtttcttttatctttaggaaagtgtgtttagtgtcctataaggactttatcttttccttttatctttaggaaagtttctttcttgtccgacaaggacttgtatcaacccataggtataaatatgtatacccggggtctatgtaatctatcgctacgatcaatacaattcggcgcatcgccaccttttaccttttctactttattttatcgttcggcgggacttggcacctgacgtggggctgcatcggtgttcgatctccagctaaggggtaagtccaatgttccgccggtccagacaattgtatcgtttacgtcggcatcgttcaagactgcatcaggacattcgacctcttcgattactctggtttggataatatatttgcctagctatttatcatatgtctatgttaatctagtcctagcatctcaatttagctctatcggctgtctctcgctttagggtttctgccggtatcggctaaatcgtcttgctagattagattagcctaggcatctaccacccttaaaatcagtcaacggcttaattgtctagatattatgtttcttttcatacttagtgctgcatcagttaagtttgatctactaagtcgtgcttagaaccattatctccaacctgtttcttgattgccaataagggtttcatcggggtttcagccgatgagttatctggacgttgcatcggcttacaaggattgcatacatattggatttagccgatcgcaataagatttaattgtttaatataatcttgtggattttatgacatcggacctccagccgatgtatgctttaacctttggatcagtgcttattatatattgtttctagccgattggtttctactcgattatattgttattttattacatcagccgattgcctttatatcatcatctacattggacatatagccgattgcttaaaccctatcgctattggctggtatcggcatcggctggaatcactacatcggcttgtcagccgatcggctattttgtctgctgtttacatatcttgtcagttgcaagatcaaactgactggcacgcccgcatctcatcaatctttggacctgcagaggagttaagcagatctcccaggccggtgtgttcaatttttttcgtcaacacattcacacaaaaaaaatatagtgggacccacatgtcattctccctctcctttccttcttcctccccctctctctctcccttatctctctctcccctctaggcctttctcttggccaaagcgtgggggagagcggcggcggcggtggcggtggcggtgaggagcggcggtggaggcggtcaggagcggggacgggtcaaggacctccagtccctcctcgtcccaaagggcgcccaccacccaccgcatgccgcgttgtcctcctctccctgtcgccgccgcacgtcttccaccgcatccgcgtcaccgcgtgcgcgctgcgcgtcctccacacctccaacccgcagggtagcagccgcaagctggggccgccatgtggagcaagcctgttgatggctatgggccttaggtgttgctgtactacatgtcgctccgtgggacctacgaggactaccacgccgtgcgcaccatcctgtgggggctccgcgccgccatcgacgagcgggacctctccatggactcggccttcctcctggagctcgccgcgctcctcccccaacgccgccacgtgaccctcccccagatgttcgtcaacggccgccacctcgccgctcccgaccgccgccgctgtcgctccccgccgccaccgctcccctccgcctcgtccccatcggccaccgctaccgctgccgctcctgagtcctgagaaagagagataagggagggagagagagagaaggggaggaagaaggggagggaggatgacatgtgggtcccacatattttttatttttgtttttaatctagtgccacgtaagcgcaaagacccggtcaaaaccaccacgtgggcgccacgtcagccaaaaccaccgagggttgttgtttgcaccgattttgatggttggaagagtcgatatacccggttttatggttggtggtcatgaatcatattcgggagatagttgagggagtcaaagtatacctttttcctatcttcgttcacattgccgttttgggccaactcgtccggtaggttcgtgtgtataccatgacagttggcccaagaagcgttcgcaagctggactcggcttgttgctcgcaaccacggcgacttgtctgttcggcggtcgcctgtcggtttgagaaagcaatactcctgttgcgagatgtgaagacacggagagagaacgacggcgttcgtttcttgctcccgggctggcccatgtcttctccgtgtcattgtacatggctacatctacatgtactatattctcatcatagtctcgtttaattggatcggtaagtgtggccctacggctacgtctacgggtaataatagagttagacacgagaggagcgaaggacgccaacacttgcacgatcgacgacccagcatgagcgccaacgcacgtaagtcgtaaagccggataacacgtacgcctgactccagccaagggccataggtttgtgcgaaggcgcgtcgcatgcatgttccgttttgacgatcgagagattgctgaagaagcttattaaagacgaggttggcacttggcagggaaagggggagacagacggctgttgtccgagagagagcttatttagtggagatgaacgatgtgagaaacaggctacccgtaggtgacggcatgatgtttcatgtttgttactgaaaaaaccaaaaatatgactaaaaaatggtcttaaaaaatgtatggtcgtaggtagatcgtgaggagaattggtggtggtgcatcatccttaagagacgtggacagaatttacaataaccgtccacagaggacaacgaacacgaactagctacaaacatggaataaacacgctccagatcttcacatctccatccagggctccgctgcaaacgagggcagaagatccctccgacgagcacgatccatcgtcgtcgcgtccgccgcgcaccaatgccaggctcttcacggccgcgccatggctttccatgacggcgaggcaagtgtagccgttgttctccgcacctcccctcctccacaccctgaccgtcctgtccgccgagccgctgcacaccagctcgccggccgccgccaggcaaagtatcgctctcgcgtgccctctgagcgtgcccgtggcctccatgccgccgtcgccgccgccggcgctctcccagacgacaacggagcggtcgcacgcgccggagtagagcaccttgccgttggctccgagagcgagcgcgttcaccgccgacctgtggcgctccatcgtgccgaccagcgcgtgcttcctctgcccggggccgcgggtccacgccttgatcttcttgtcggccgagcccgtgtacacgcgcccgtcgggggagaccgcgagcgcgttgatggcgtcgtcgtgcgccgccgcgatggactccacgcaccggaagccgggcaggctccacaccttgatgctccggtcccacgacgcggagtagaggagcgcgccgtccggggacaccgcgagcgcggtgaccgcgtccacgtggtgcacccaggtgcacctcctgtgccgccggatctccacgtagctccacggcagcaggcacgtccggaggcggtccacggcggtcgggagcaccgcgcgcaggacgagctgcggccgtgtctcgccgtccctccgccggctaccggcacgccacgccctgatcttgccgtcctggtgggagctcaggaggagcccgccattgcccgtggcgaggagagacttgacggagctgtcggtgtcggcgaccgtcgtgctgctgctgctgctgctgcaaccgtcatcctgctgctgctcctcctgacttctccttgcgccgtccagtgcccacagcctgatgctcccgtccgacgaggcgatgtacagcgagtcaccgtcgacggcgagagcggagacgtacgccgacgccgacgagtggcctttgatcgtggcgatgaattggtggagcgaagggcttgtgttcaggtcatggacgtcaagggaaggaagggaacggaggctcggctgcgacgcgagcgacatggctcccgagagcatgctaccttctgcagcctcatgttggatttggcttccttcctgctcaccagaagaggatttcatggaacgggagaccctactagaccagaaaatcaaatcttctccagggaaacgatccaaacacaagctagagtttcatgcaatataataagaagcggctactcagatagcatgctaggatggatcatatagtttttttattattattatttttgcgcctggttttaaacaggaaaatgaccccataggccatagaccaacacaaaaaccaaataatcaaaaatgcatgatagaagctcaaactcatgtttaaaggcaaaagggacaacctagagcgctctagatcacgatcgagatcgaaatcttggtagagtgtcagtatcagataatcagatagagagaaaactagcagcagtcaaaagtaaaatgatcagaagttcataaccctggaggattcaatcctcgcacactagcctttactgtggagagttcaggtagacgtcatacgcgcacagtgttgtccaataagcaaagatcgctctagctagtggggtaacaattgccaccgttcgcgtgcagctaagcgtccgtatccatggatgttacctaacaccagcatctgccctaccatttttggagctcatcaatcttccttttctatgacactttatccactgtgcttgcatatgcattctttgaatctattctagtacaattctacacaaaggtagtcttgtaatgatatctcacccaatccgccttttatttcgttcccatccagcgcatgtgctgccgtgtccccttaacgttctaagcaatagttatatctatagcgctacatttttcatcgaagataatcaaatcgtttttacattgtatattaactatatttactgttggaggtcgtcgtaggcagtagctttgcaggttccgaagatgtcactcgttgccgaacgatgaacagcagcttcacgccggcggcgctgtcttcaaggagattcacgccctcgccgaggtgcacgagacggacagcggctctcctccaagatacaatgatctcgtatccttagccgtgcactcggccaagaacgaaccagtggactttcgtgggatgtaattctctctatgcaaaacaagcagatggatgtgggcaaaaacttcgtgcaacaaatacagcagcagtacgtgacttatatagccttgtatagcaacaagaaaatcttatccctaagccggataacaaacaaacaatagattgatttccgtcggcctgaaaatctggaacgataaagacttatcttccacatacagctcaaaaaaccaacaatatcaaaactgaaaaccgaaatctgaagataaggcaaaagttcagatatatttatctgaaccaaactgaagaatcgctggtacaaaatgaacagaaccatagagataaaatctgaacaaccatcaaatatcgtttgtgactttcattcaaatataatcagaaggaaaaccaactgaattccaacatttacaccctaagtttcaataaatacactgaaatttttaatacacaccatataagagaattatggttaaaaataattgattaaaaaaacgcgaacgcgcaaaagaattgcacgtcaatatattagaagaaaagaaattttgttacacgatgcaatcagccaaaccggcttatgccaagaaaagggggaaaaacataaccaaagaaaaggaagagactactacgatagctaaacgcaactccaatcagctgggacgagggcagaaccccgctacactcccaagaaatcccaaaaaaaaagcaaagccagctaatgaccacagacgacccttcaagaggatggactctagaaccactgagaccgaagagagtgcatagtcgaaaaaaattgattacatatagcaaaaatcattacaaagagaaaaaggtgactgaaatcaagtaaaataatatggtgccgtttttttagcaaaacctataatagttgcttgcttccctgtcagccttatcaatgtgtgtaggtaaaaaaggacaaaaaaagagaaagagagaaagaaatacaataaggatttttttttttggttctgagtaggcatgctaaattagtatctgaattcatcatgacaacagtttcagcaccaagatgggacgaatccccagctgttttctgaagaataattcagcaccgacatagtcgctcgattggtaccgtgcaattgtgctgcagtactgcaagcgacaacacacttatccaacattgtctgggagaaactccatcccaaaatcctgaacctctatgtgatgctgcggaatcaacttgtacgtgcaaacaagcattattgggttgtgtggttctatgctccgagtgaaaccgagcgatggcgcacatgttgtactgtgttgctgtgatcgcactcgataacaacaattatcaattggataatggaattgaatcacacatgctgaaatcagtgataaggttgttcctctgtcataattctgacagttgatattcttccttcggaacagagggcgtaaatgagcaggaatatgccggtcgtgtcaatagcaacgcgagcggtagactcgcattcggtgttcccttgctgggccagaggaaatcccatgctgaacatgaggagacaagcagaaagcttagccctagtagaagccaaagccagcattgtcgttgtaactgcgattacgtctgccctgcttatagacaaatcaaaggaaggtagcctggtagatcaactgggaccaatatggagtatcttcgaacaggacactgcgtctgcgtgcctatgaattgtgaggcactagttctgtgccctggtgaatggtgattgttcagagaatcagagctcaaattgcagatagttttctgattgtttctgggtagttccttcgccggcccggcaaaaaacaggattgttcctgatcagtacacttctccgtgaaagctaaggacgatccttctctgtgcccgtatgtgtcgctttcctgataatacgatctttttgctaggcaagttgcagactcgcggtatcatttttttacaagcgggccgccattcttgtcgtctcgagatgatcttttgtctgtactgtagctgataagtcagaccactattctggtaaagaacttgtccgtagcatttgtaggaggttagatactgaaatattctaatcgccagttgataagcaaattgctcctgaactatcgaagaatatctttgtctcgtcactgacagttccagttctaactgctgatatgcctgtcttgtaagtctattactggtccttggaccttaacaactgggccttcaggggaaatctgtgaatccggcccataaggtcaatgggccgaaattgatcacctctggccggtcggcacgggtttgatttcagcccaataaaatttgaagctggaaattttgcttggaaacagtcagaaagagagtagaacacctccctttgtgatgaccgcatcttcggctttcccatttgtttgtcttcgctgaggtggtgaaactttgtgaaatagggcaaaaggcgtatcttaggcagcccagctaagagatatggcttcctcaactgaatcaaggccacctaaatacctacttcaatcacctgtcgaatagtcgaacacctgtattgcatgttcaactgctcagagccgggtcagtgttttggttcttgctttgttcatttgtacactactaaattatttctttgtttatactttgtatttcgcggatggttcaaagccgagatagcagttatcaacttgtcatggaaagagaaaattgatttagaatgtagaccattcgtgaggacaaggtatatcagaacattctttttccacttttcactcgtcgtgtttaaatgagaaaaatcgagattccaactgccttgagaagagcatctcgctttggaacaaccgaaccccctgcattcccactttgtacgccatggtttctcgatttcttcctccctttcttaaatggagcaaatataaagaaacaatggcatgggctaaaatgcttcctgtcccaagtcaagctagccagaagattatgtttccctacattctgattggcaagttggttattccttttctgattggttaggttggtgattcagagatgtcgagacgtgtgttcttttgcatctcgtgtatgctttggtggtgcagttggaagagatggcgtctctggtctaatatctgaaaacggcactgatgacaataattgctggccatggtttcagcctacgacccttctataatcgtcagattatctcttgcgtgttgcgtgtagctcaccggaaaacaacccgatagaagcttcttgccaggtcagactgtaagcataaagaatccaatcacgaactctttgttattttgaattgacaaaaggtgcttgaattctaaacacgtcctatcatgtcacgtagataatatgacacgagttgacaacaacatgaaacagacgcaagaccacacacacacatacacatccgctgataatctcttgaccaaaccgatccaaacctaccaaacacgcgctaatttttatttagacatttcgttcgacgtaacctgcggcgacgagcgagcgttcccgcctcctggccggctgctgaccaggcaatccgtgtcgtagtggtggactccattgaaaatccttaaatcttacgtgacagcagctggattttgcaccgatcgcaccacgtctccgtctgtttgcggctcaaggtttcagcgatgggcgcctccacctcgcctcgtctcgccttgctagtagtggtcgcggcggcggcgttcgtcttcgtctcgccggcgatggctttcccgatgggattgccggcgacggcgaacccgttcccgaacccgtggtccgctttccagaacctctctgggtgccacgccggcgaggagagggaggggctagggaggctcaaggattacctcagccacttcggctacctcccgccgccgccgtcgtcgtcgccgtacagcgacgcgttcgacgactccctggaggccgccatcgccgcgtaccagcgcaacttcggcctcaacgcgacgggggagctggacacggacaccgtggaccagatggtcgccccgcgctgcggcgtccccgacgtcatcaacgggacatccaccatggacaggaactcgtc

SEQ ID NO: 68485 - DNA, 2124 bp, Oryza sativa
cgtcggtgccggactccatcatgtacccgacgatccgcacggggacgaggaaggtggacctggagtccgacgatgtcctggggatacagagcctgtacgggaccaacccaaacttcaagggtgtcacgccgacgtcgccgtcgacgagcagccgggagatggacggcagcgcggccgccgccggcatccggccgtggagtgggttcgttggattagttgtgccggcagttgtcctgctcttagctccgtagactttctagtccatttttcgtgcctcggtgttgccacgtccatctctggttctatttcttgtacgatagattattgttgacttttggacagattcttgtgtacataacattactgaagaattatagatatcaatatcatacatatttttttgatagagaaattgggaagtacttctcttttcttttatttaaagttacttctcggctagttcgtcatgctctggaaaatgagcatcaaaacgtactgtatgtcctgtttagtgaggtaattaaactctaaattttcaagcaccatggaagattccattgacacgttagtcgtctgtccttagcaattagcattcattagtagtatattccggaagaaaattctatgcggcggtgccgcaccagacagcccgggcaacaccgtgtaccctagtgacgcgtgtccaatccctgttgcaacccgagccgatgtccaatctcccagagctctacagtatcgagtcatatctacctgctgcatgtaaaatctaattcatttttttaacagtgctctatttgatgcgagatacataatgccgttacttttagacacatatttaactactcgttttatttaactttttttcatgattattatttatttttagacacatatttaactactcgttttatttaacttttttcatgattattatttattttgtggtgagatgttgtaatcactaaaaatattttatgcatgatttacatcttatgtatgtccacaaaatttttaaataaaataaatgatcagacatgtgttcaaaagttaatgagatcattattaaaaaaacggagggagtaatatacagggggtttttctagggtaatatacattttactaaactttattaatatgcctcaactggtcagaaattattttttcatttgaatagggttgggaaattccattttgatgacgtagaaatcacggtttgaaaagggctttgagattacatttttgttgacatataaatcacggaaagtttataaggctgcgttcgatcaactccaaaagagagaatttttagcgcacgcaaaacgagaaaacgtattagctcattattaattataaatttaaaaaatgaatttatttgaattttttaaacaacttttatatataaattattttaaaaagacgtattatttaacaatttaaaaaacgtgctaacagaaaacgagcaagatgaagtttggagtagaagaaaataactaggcctaagtaataatcttgctttgatagtcatgttctggtaattgtatatgcaaacgctgctacaaagtacgcatggaaaaaacaatttcatttatcaatagttcaagaaattaaaaatcgatagttataaaaagcggactatacgacctagctagcctcaccatttctaattatttgatattaggacatttcctaatatttacgtcttattggtagttataaaaagtatacataatctatcgtaatactttctttagtttatgttttcttaatctatactacatattgtatcatgtcgtacttatgatgagtctcaatttagtatttatttccgctagttttgctaagaaaatggaagtcccttagtctaaaaaacagtacttttcttaatttggtaaatgtcacgccccgaactagccccgaatggaactagcccgtgacgctccaaattaacctgttaatcgataccagtcccaggaaacagtgctggtatcataggaagacaaaatatcacagcaacagaggtctctttattttagagtaggattacagtcatgttgggctgcggacagatctcgagctcacaactgcattacaaaagggaaagcggaagccaagacatggaccaat

SEQ ID NO: 68486 - DNA, 1850 bp, Oryza sativa
aacattaaaatacactccaagtggttaatacattgtacgatattacggtcctttgtttcagcttaaaattattataatctagattattaaatcagattactctaaactgaattataataagctagcataaaataagctacgagatgtttgtttatctaaattattgaaggcatctatagatagtgggtctttagccacctaataatctggaaaaagctcctctagaggagattattagattatagtaatctggcttacagattataataatctatcctaataacctacttgtttgtttcagcttactcctaataatccagattataataattttaagctgaatcaaacgagtctaataatctacttgtttatttcagcttactcctaataatctagattataataatcctaacctgaatcgaacgagtagtgccattcttttatccctatcactaattcgctatgttccattgttttatctaaacataacgacgactatctcatctcgagctattgtaagttcactatgctaatgctgtcttagtgctagattactgcaaggacgtccatgaaatccacgtccaccagccaccatgtaggctgtttcaattgacaagtcagcgatcctcaatctgcaaggagaagaataatgtgcaacagattagataactgatcagggctaattgtgcttggtggaatattaaccaaagtactccttgattacctaccagagccgcaggtcaggctggtcgccgtcgtgcggctgcggccacagctgcagcaacgtgcttgacgccgccacccccttctcctcctccgggaagaagcaattgaacgcctccgccgccgtcgtcgccgccgccgccggcggcagcatcgtcagcgcctccattgccgacgcctccccggaaccagggctctgccagttctcgctgtgccagttctcactcatctaaagccgaacaaattgagtattataatactcctaaattcaacgtccacatgttaaaaaaagaataaattaaattggaaatagttaacccgcattcacggttatatttgtcatttttgttgtaatttataaaagttgaatttaaacttgtatgtttatggagtgaaatattttcatattgatctatcttatcagttcttttaaaaaaatttgataactattttatactagttacatgcccgtgctaacgctacggcgaaacaacaaaaagatatacaatatattgtttgggctatcaagtatagattcaagacattaattaagacttacatatgagcgagtttagttaagaagcttattagaagttcctcagttattatatactcgaaagggataaacaagccaaataaactacatccaggacaaggttcaaaatttgcaaaacaagccataaggtcgacccattcagtcgacgatgtattatgtcttcaacgtcttttctccatgtcacagaaaaaccagtaagcaaagaacaaaagtttgattgatatattaagttctaaaccgattccaggacacattcagtcaattcagttcaaatacataatcatgcgtttcaacattaattaaagtatcacattcatatatcagtacatggcttggaaaccacaaagctgaggatgccttaatctaagctacaacaaaatttcttttttttttgcattttagaataaacaggtaaagagaatggatagatcacatgtcttggatctgtcaatatctacgaagtcctgagcagctcaattttggagagggtagtagtgttgttccatttatggttcatcttgatgcatgaagaaggcaagttcaatttctggttcagtaactcttgttgttc

SEQ ID NO: 68487 - DNA, 1424 bp, Oryza sativa
ggtttcttttgacgaacccaggccacttggattcaaattctagatttgatatggatgctcgcacttacgcgtggtgacttcgtcaatctcaagatatatcgctccagtcttccggaggtgctcataagggtaaggtaagtgtgtgtgcgctataataagcgtctatgtttgtaccgtgtttctaatcctatcttactataaagttatctcccactaattccttaagcttaacatgtaaagatgacacatcatctttcactaacaagatgccgcatcatcatccactaattaacaaaatgccacatcatcatccactaacaatcatcacatttaaacatcatgcaaacatgctatatttttatagtttttataatttaagagcttttcaaatacaaacatgttaaattatcgtccaacataattaacataatgtttcaatgtatatatttattatgttttatgatatcctatatacttatatagtttatccttatttagttagtgcttaaatgattaatctacggtccaaattatctttctcctttttttcctctaattaagccatatcacatcaattgtttgtagcctttagatgattaatctacggtccaaactatcttcctattttttttcttccataaaatcataccaccttaccttttacgtttgaatcaccattccacatactatttgaatttaaattatcataaatcacattaatttacttaatctgatattatctagctatcttacacgttatttttttttgttatcagacgaaattcccgcagcaatgcgcggggtttcacctagtaaaaaaacaaaataagtgcaaaatatttggaaccatcaatccaagtctagaaaaaggaataacgaacaacaggtgaaaaatgcaaaagaattttgcctcacgtccccactggccccacctgccagctacacagcttcacatgtctctcccccgtctacggacgcaggctagaggtggccaaacgggcggcccggcccggcacggcacgggcacgggtccggcacggcccgtttcggcacggcccgttaggcacggctgatgaaacgggccgtgccgtgtcggcccacgtgccgagccgccggcccaagcacggcccgtggatggccgggccgtgcccgtgccggcacggcacgcccgcggcccacgggccgttcggggcacggcggcccgtgaaggcaggccgccagcccacagtgcatgcacagtgtttttttttttaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaat

SEQ ID NO: 68488 - DNA, 1092 bp, Oryza sativa
gtaaactactataaggtaaaacaacttttaacattaaatacgttgcattccaccgatgctctgcatcggtggcaaacttacgagcttccacaccggccgcaatgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtcgcctcctgaaccggtacctcctcaacgacag

SEQ ID NO: 68489 - DNA, 880 bp, Oryza sativa
caaccctttgttcattgcttatactttttttagtaccaaccgttggaaacaatagagcacactacactccgttgattgacccttcatggctaactaaatctagaatcatgcacatataacaggccaatgggcatgtagagagtctattgattctgttaataatcatctggtaattgattgctctaaagatagaatgaagtctcctaagcatccataagtacaagagaaaactgctccaaagttgcccaaaagttgaatgccagtagtaacacccaaccttggtccaaatttccaaaaatgattcgcaaaagaaacatgggcataagtcagatctctgatgaaagcggccacacctttggggagcgaagcggcgggagagtcggagaccgtgaggccgcagcaagggtgagcgcctgtgcacaagagacatgtaagaaaaagattggattagatatttagaagtaatatctgcttgactaacactgctgcagtagaccggactcgaaggaagagagagagtgagagctcaccggaggaggagagaggaggcggccgccgtgagcttcgccgccgcggccatggccgccatgagagaagcttcgggagtggtggtgggttgcggccgtgcggctcccaggccgcgtgctgggatagtggtgggtatccgactcgacgaccgtccgatctaacatcgacggcccagatggggtaacctagcatttcgaggcccaacaggccgaggctacaaggctaacccacccacaacgaagcccattaatcctttcccgaatcatccctctcggaaaaaatccccaaatcgatccgcctctctctctctccccccttctcgccggcggccggcgcggcgcggcgaggcgga

SEQ ID NO: 68490 - DNA, 1335 bp, Oryza sativa
aagcccattattctccctctttctctctcggaataagtttacctgaggtcccttaacttgtcaacgaatccgattttcgtccttcaaccggaagaccagatacaacgggtccctcaactatcaaaaccggtgcaaagcaggtccctcagcggttttgatggtggttttggctgatgtggcgcctacgtggccggttgacttggtcctcgtcctacgtgacggtgatgtagcactagaagcaaaatataaaaataaaaaataaaaacaacaatgtggggctcacatgtcagtcagacaaaaggaaaaaacagtgggacccaccatcctctctatccacggcgacgggagaggagcgaccggcgcgtccttctctctccctcccggccatccttcctcgtcggcaagcgcgcacggagaggggaaaaggcagcggatccactggtcgtttcccgccgttggtgttaaacatgatatttacaatgggatttgatccagtgatagaggtgaatgtaatcaacatgagcatgcttaacgtagaataagcatcaacaatcacataataacgcaatgttgacattgcgatgaacattaacagtaaaacttctaattgaaataatgtaagaaggttatacccaagaatggtcctccgctagagtttgaggcagtgttgcctccgttggtgttgtcgggagcctccttctccttgtctccagtgttgccgttgtctccagtgttcgacatgttggtgaagatgaagtagacattgacgaacaatgagtagtcgcgccttgcgctccccaaaaacctgatcacccgcccgtccgtgcaaacgtcgtagcagtgcatggtttgcatggtttcggaggcctactctcccaacgcgtgtgcacacactcgtcgggatgggattattgtagcagcaacagccttggaaatggatgaaagtgtgtctcacttcttcttagggagatcaaatccattctcattttatagaaggaatggaagatgaagggtaagagtcatggaataattaattctcatcaattagccatcaaccatcctccactacacaaccatcaaccaaccattaatgaggagtaattgatgtaggttaccaatggaataggaagaggaatagagcaactaattgtcatcaactagccatgaaccatcctccactacacaaccatcaaccatccatcaattaggagtaattgatataagttaccaattccctagtcaaatggattaattctcataaactcttcatcccattgatatcccataagaaaatgaatacacatgaattcctagcataattcctagcataatgag

SEQ ID NO: 68491 - DNA, 727 bp, Oryza sativa
gcatcgcatcagagaccaaacgccacacacttacacactggattcaagctagaaacagaaccagacgcacgcacccacgcacgcaagcgaaatcgtaaagggaagcactgaatccaaagcaaacgagcacgcacctgagtggatcggagcggggcgtggaggggagagggggggggggtgggccgaactaggaaggggagggaggagggagtggagtgtataaatagcccgacaccgacgaggagggtagcggcagattgatttttcctcctccgctcgcttggcctctctctctctctctccggtgcgcagttgcgtggggatttggggaggaagaggaggagagggggatgggggcgacgtggccgcctccgtgcccacagcgtcgataaggaagagatgagcccacttagacggaagccaaagcccatggagacgaagtgaaatatctctccgtcctggtgaaattggcaaatggctcgtattttttgcgtgccattttcgtagccagtggggttttcctccgatggcttgtagtgtcgtggctgctggactcacggctcacgcaagattggactgcttggaatcctggagatgtgaaggcgacacactggtcagagcatggcaatatgacatactaagttgctgccaacattagttattgggtaaacaaagccagagccgtccatttcccttgcacgacctgccgactgaatttttttcctcg

SEQ ID NO: 68492 - DNA, 1800 bp, Oryza sativa
tcagctctataccctgtgcacccacaccacgagcaatggccccacggatatctataccagccatctcagcagaaagtaaagcacgctccatttgcccatacctacatagcatgaaacaccactggctgagtactacagcaatagcaacaaaaaaaatctcaccaatgcagttaactgcatgcaacagaatttttcacaagttttttttttaccttgctttaaaagtctcatatggggaataaatagctttcaatgtattcagcagaactaaaagatctgactctgaaaataaatgttggatgttccgagcaaaagtgcccgtcatgttgtgcaggtcgatcagtgctccaagatgcttattctgcaatttggtactttttggcaagtcacctgataaaacatctagtatacctgggtacagaggacataaaatcaatttattgttacgaaagaagtacgcatatgtggcaaacaagtaatatccttttttaattgaacagagaaaaataaaacatgtaattcaatcatgaaattagtatagacatacaaaaatgaaataatacgagaagtttatgcattaccttttgcaacagatctagtttcaggaacagcatctccagttgctaggttgacacgagagacaaaacttgaattcaactcactcatggtttcaccaagtacttttgggactagtgatttgtattcttcagggaaagcagtcaggcaccttcagcattagcattgtagaacatccattaatttttggtggagcaaaaatattgtccgaatgcagctaaaagatgctgccaaaaactggcttctgtttacaagggcaaacattgctgattcagaacaaaagacaacagggtacaatgaacataccacttccattcttgttcaaggtaaagtagtgtctcatcatagaaatttggaagccagctagcaaatgagagactgtttatgctttctccaccatacttctccatctctacccgcttagctctctgttttagatcaaaatcttcccaaagtttctttagaggcttgacatggatcttagtatattgcacctccagtgacttgaatctgccaatacgtatcagtattccacgaagatcttgcacagcatcgaccttccaaccaaaatttgtaggctttagatgaaatagagatgcctgtactactgtttaacaaatataaatgagattagtaagaaaaaccttgcggttagaaagtgcatccaccaaacgaggttgaaccatgtcatctagccgttcttccaatacttcaagctgctttctcacattagcgaactccgcaacctgaaagcaacttttatataagcaaaacaaatagcttctgcatataaactcagtgtactgtgcatgtttgtgtgagagagtacaatacctcaccaactgccgacaagcaatgtctcatggttgccagggtttctgcagcttttggaagatcaccactagaaaatacatcctcaacactttggctcaactgagctagtccagccgcatcctggcattccgaccaacaagctgttaaatctattaaaagataacctaccactgtgagtgaagcatttacttcagtaacatgcaccatagtccacatacaacttacctgtaatgttgcatacgccgcttccattcgttgtttcacagtatcaattcgtgctagtgcagttattgactctgcagatgaaccctcagcctgattgaagaaatcatcatcatcagtaatacagaatttatgaaatgtagatgggactgaatacctagttagttg

SEQ ID NO: 68493 - DNA, 1623 bp, Oryza sativa
ccctggcgagatgcatcacaataaacctggaagtctttagtctgatctggcaaaatcaaaacaggtgcagataccaaccgcgtcgtttgagttcttcaaaactcttgtagcattcagcagtccagataaacttttcttccttcttcaatagctgggtcattggcttggcaatttagaagttctcaatgaaccggcggtaatagcccacaagttctaagaaactccgaacctgagtaactgtccctggtggggtccacttggtaactgactccacatttgctggatccagagccactccttgggcattcacaacatgaccgagaaactgaacttccttcagccagaagtcacacttactgaacttggcatacagttggtgctcctataacttttcaagtaccagccgaagatgctgctcatgttgttccttggacttggaatagataagtatgtacatacgatgaaaaccacgacgaacttgtccagacattccataaacaccttgttcatcaaattcatgaagaaggcaggtgcgttggtgggtccgaaagacataattgtgcactcgaacaacccgtaacgagtgatgaatgctgtctttggaatatcctcctcgcggatcctcaactggtgatagcctgatcgcaggtctatcttagagaacatagtagctcctttcaactgatcaaacagatcatcaatccttggcaaagggtacttgttcttaatagtgacctcattgagcgtgcggtagtcaacacacatcctcttggttttgtctttcttttccacaaagattaccggaacaccccaaggcgacgtgctcgggcggatgtatcccttctatagctgttcatcaacttgcttcttgacttccaactcgttggctcccattctaaacggcctcttgtggatcggtgcagttccaggtgccaagtcaatccggaactcgatatccctttttggtggcattgttgtcatatcctccggaaaaacctctcgatactctctgactatgggaatatcctccaatttcttagtggttttctccattgctacctcttcttcttcaccggtggcctggttcagactgatccctggcttctgcggtactggagaatggaaggttaccacttctcctttcgccattggtcaacttgatggtgcggctagtgcaatcaatcactcctctgtgccttgtcaaccaatccattccaagtatgatatctaggtccttggattcgagaagaatgaggttggctggaaaaatcaacccttggatttcaactgtcactgatgggcagtagtgagttgtggtcatgccacctccaggagtatgaactcgcataggtatcttaagcttcactaaatataacctatgtgcaccagcaaaacgcttggaaatgaaggaatgagttgcaccagaatcaaacaatattgttgccggtatcgagttgacaggatatgcgcccaatatgacctctggtgctgaccgtgcctcctctgtagacgcatgattgagacgggcctgaacaagcttgggtccagcacgtcttggcttcgggcacttaccaaccatgtgtccaggtttgttacaattgaagtagagttcgggcttttctc

SEQ ID NO: 68494 - DNA, 3686 bp, Oryza sativa
gagctggactcattaatggacttggagtcggattgaggctgtgctgctcgctgttgctgtgactgccactcttgtagttcttgttgaagctacccgggtggtagggacagtgctgccggataatcatggtggaaggtccaccctgatgtcccgtcatgaagcgaggcttctaactgttcccctggagagttctgaactaagatgctttcctttttcggttcattttgttacactgctcctcctgatggatagccttgtccacaagcttcatcaacaggttgatcaattcattatcaagactagaccaaaacttctcctgcctctcgacatcagtgcgcacgtcctcaggagcgtagcgcgcgaggcggttgaactcgtgcagatactctataactgttttggttccttgttgtagagaacaaaactctctcttcttttgtgccatgatcccctcaggaatctgtgccttattgaaactttgacagaactatgcccaagtaacctctgtcccagctggacgggtcaccatgtagttgtcccaccaaacagaagcggcgcccttcaactggtgtgtagcaaaagcaaccttctcctggtcgttgcattgcaaaaggttcagcttcttctcaatagcatgaagccagtcgttggcctcgattgggttggtggtgcttgagaaagtgggtggcttgacatggagaaactccaacagcttggacttgggaggtggaggaccaaaccgcaggttctgctgctgcggttgtgcttgctgctgcacctgctgcaacacctgatgatactgttgctgcatatgttgcatcatcattgtcatcatctgagtctgattgtcaaacacctgagcgattgttgggttctcgggcggtggagatgaactgctgtcagatgcatagcagacacgtgctccactgatctgctcttcactgccactgacgttgttggagtcacggagaccattccttatcttcaccatctagaggggattgggtagaaatatgagaaaaggaagaaaaacaggaggcttagaaactaatctttcttataaatttaagtgcaattatcttaatcttgattgaaacactgaaaaggaagcaaacaactcctaattaaggtagccataccactcacacatgatatcgaccgccgactaaccaacaagcaacaaacctaaacacggaaactagcaagcaaacaaaactaagaaggcgacgaagctaaaggcagtgactctgaagctcggagcggcgcttgcgatcagtgaacaggtttgacacctaagatggacaagggatagcaaccaaggcatgctcaaatccaaattaaacatggcaacaaatgactcaaatgaataaccgagcatggtgatttctatgcatagaacatttttcgtgaacccagataaagaaacaaatgcaactgactaaacaataacttaatgcataaaatagatgcatagttataataatatgcataaaattgccccattgaacatagacacgacctaatgcatatcacccgataaattcccgactgactttcgaataaactccgaataaaatattactaaaaccctagactgagctaattataaagatccgatccgaatgaatgactaagatttttttcgcaaaccaaagaggcataaaccccaaattttcccgaaacgaatccaagtgcaaagagcatatgcaaatgaaaaggggttcaaagggctcttaggtttccagttggcttgtcctacggtgaaggtcggctctgataccaacttgtcacgcctagaaattcatgaaccagaatttctaagctgaatgtgcattaaatcactgtccaggaccagccagggtacacaaatgacaattattgacatacagatccacgtcttacaaaaatataaaagattacaaatgcaacggaaaagataaaaccagctaaacttggaagcttgacttctgcagcgggcgactccactccacaagcaacccttgacggcagcgacgaaaccaaccctaacaagacagcttcaacttggaagatctttagctctggtgtgggggaaaagagagcaagattgagagcaagactaagtcataccagaagaggagaaatgatgcaggatataactaaaggaggctaatcgttcatttgcaataaagcaggcttttaaaaatagtagttgaaagcagtaaaaacaattgtagtaattaatcaatattaaccaatcactgtccaacgctacaccgcgttgcaacaggcccaaccaaccacctgaactacactagttcattaagctaaactaggggtgagactaatcacggtgaatctggttgatcgcccataaccgcgggcacggctattcgaatagttttactctggctagaggcgtacaactgtacccacaagacatgattccacacatgtcgccatgccccgaagtatcaccatgatattgcaaagggggaaatcgtgacaagaccctttgcataacccgcccctaaccatccacaccacgctaagatttcacccccacccctcaaaaggcagtgagtagtcccctcgtgcgctacggtgaatccggcagctggacaaccggacaacccggccgacccaactccatcacgcccactctcgccaccggtatctaggaaagggtcgagctatactacaagtcaagcagttacccactcctgcttgtggcaagcacggtaagactcgcagggtttcccgtgaactggtccttaactgcaagggtgcgaccagcaaaatcatgcacccacagcccaccattcagtgtattttaattaactaacaccattgcggtggcacaaatccaaagctatgctaatagtcaaagtatatgtaataatgtgatctccatttgtgtactagttgaactaagcacggctaagcatttcctaaaccaacatctaatcattttgatacccaagttatcaatggcatatggtaaacaatatatggctgagtaataggacccataccacatgacattgtaaaagaatgcaacatttaatagaaatacgggatatttgtaaattgagtataatatgatcaaatgtaatgcatcactttccttgctctcgcactgatgagacctcagcaacgtcttcgagaaaccgtggatcgacgaaacggccgaaatgctataagactactgaaacaggaaacaaaaccatttttaataaattctagggatttttatgaatttactgagacttgaatagacttaatcggagctcggatgaattagttatgattttaagaagataaactttttttattaataaaggaaaatccttattcgatttattgcgcaatattgccccagggctgacgtcatcaaaggaggggggcgccgacaggtgggccccgcacgtcagcggcttgagagagagagggaggagcgccggcatgcgggccccacgggcagcggcacaaggtggaagggacgcggctggcggctcggcacagctcaagccggccggccatggtgcggtggcggcggcgcgcggccaccagcggattgcgaggcagcggcgatcggcacgaaggcgacggcgcacggccggagcggcggctcggccaacggcggcggcgcacgtgggaagggagagaaaaggagggggagggagtcctcaccggaggaagcggtg

SEQ ID NO: 68495 - DNA, 1819 bp, Oryza sativa
gccgagcgcgggagggagtggggcgacggcccaagaagataaaaggggaggaaaaagaaaaaggaaaaatgagaggatttttcatgtgattaaatattgcacttgctcattttaaattagttaaaattattttcaaggctctgaaaattctactaaaaatgcatgcggaactcaagaaaaattccaccatgtcattttcgattattaattgcatttattaattagggattagctctaggttaattaatcaatttcttcggacaatttatttaacaaatttttaaagaaaaaaaagggaaacttcagggtgtgacaggagatggcggagacgatgcgatggtgccgctagccacgaaggccaggacgtcgcacgcggagagacaacgcccgtgaggtctgtgtgctcacttgctatcccctcttcccattcacaatttgattcggttcgattttatttactactagctcatagtgatctctgttcaatcccaaatcttatctatccaattcaatctgatttgtacctatccaatggaagcagagcctctctgtatctgtctctatttctccctctcttcaacttaattaatggataaagaacattttcttgagtgattggagtttgaggatgatgcgtgcgggtccggaggatgaacaggaccacaggagacgagatggggaagaaaggggcattaggtccaaataatttagaaaatagagtgaaggagtaagtagtggtatatgtgaaataaccaaaaagttgtaatggcatgtctctaaatagatgaatagtaatgacatatttcaaaacagtgaaagttataatggcatggatccaattaaacctattattatagtcggttttttattgaacatgcacctataattaattaaaggtgttggtttttttattttcagccagtggaagtggggaaaacactctagctgttggttttagctcttctggcacctattgtgccgatctatatgtgtgtttttaagtagtgaaaagggcgatgcgctcgatgttgtggtatggtttactgtcaagaaaataaatgcacaacaaaaacacaaatttttacataaaaaactcttacatgaaaacaccatgaacatcgattggcaataatcagtttagaagatataatgacaacgtaggggatacagtagaccgtcgcactattcgcgtatagccgacaagagtatataaagaagaaaaatagagtcctaataggataaggaaactaattcaaactctaatagattaataggaaactactcaaaatatactggtaagtgaatctcagataacatatttaacatctacaacgatagcaatggcttgtacgtcaccagtttctagcgtcgtcggctggggacaagatccacagactggaaagggcgggtgtgctcatccaaatacggtgtgtttgtgtggaagaatctgtatatttgctctcttttatggtactccatagctcggtggtaatggcaaagaaaatattgcacattgtttgtctttatttgtcttatctaagtaaaaaaaatatatactcctcctcttgattaatacttccggtcctgaaatagttatctttataggttacttagcatatatcaagaacaacggacaagagagccacttatcaaataaacaatttattttcggcagcagaaggggaaattttgataggggtgattgatgaggcaagtccaaattacatctaaaatttttggagtgggcctaaaatagggtgagctaaatttctatttatttttcaactaaaaatactagtaatatgcccgtgctaaacac

SEQ ID NO: 68496 - DNA, 6244 bp, Oryza sativa
tttagaaccaaccgattactacagattcaatttggactaaaaagggggatgaaataaacctcataaatacaagaaggattccactagattactacaacaaccaatcgaggaagactcaattggtcagatcgaagccgcgtgaagcgcagatccagcaagaaggaagaagagggttctggcggttcaggggctgaagagagcatagaacggcagggggattgtgggcgccggtcagcaaggaagagaagattgcattattgcaacgatgaactcaccgtggccactctagatccgctccaccgctgatgtgtgcagccgtcgtcgaggttgtcgcccccttcttccaatctgccaccccacctcatggccggcacaagaaaggagagcaggggcgccggcaccatctagctcgccatctggcgagtggggggcaaaggcaaggggtgtaaggaacgactgaccctggcttgctcttgcgccgccaccatcaagctcgtcgtccgacgaggaggggcagtggaggcggaggctaggaagatggcgagggagaggtgagtgccagcggcacaagatacgccgtcaccgaggccactccgccgacccctaggaggccaggacaccgccgccatggagccctctgccgatggctcgcgcctcacgtctgctgaggggctgatccgaacgctgccgcctggggagagaggtcaccgcagaggggagtccagatccggcggagatgggcagcatgctcctactctgacccctcacttccatatccaacgtcgccaacaaggggacacactgttcaccaagcaccataaatcctagaaagagaaaagtaaaatggaaaaggaaaccatcacctcgctatggaactgttcgagagggaggcaaaatcatggtggtgctagctggctttgtggcttcctgggatagagctgtcgatggagaaagtaaggggcattttgatttatagaaaaaatgtagaaattttggaggatttcaattctatgaaaaaaaaatcctacgaaggtctttgaaacaaaagattgtatcctatctaatcctttaaaatttttatggaatgggtaatcctatgtatattttggaggaaagttagcaagagatctaacctcttggaacattttctctgagtctatctctcttatcttattcctgcgtttttcctgtgatccaatcaaacggccattttctctgagtctatctctcttatcttattcctgcgtttttcctgtggtccaatcaaacggccattcctgtgttttttctgtattttgcaatcctctgttttataattgtattcatgtcagaatcctgtgttttttctattcctgtgttttttcattcatacgattcaaagggccctaaaagggaaaaggataaggcctttcacagtgcaagcgtggggaatagagagactgagaagattggaataaacgagagatttcttctgctttccttttttccacttcccgtcggctcagcttttatttttttttatgtattttttttcttccggtctgtttggcttccatttttccccaagtataaaaattaccctatatttattgatatttcacttcaaatgaaatttacaaataaaacacaatactacctaagaaaaaaaaggaaaagtttgaattacacccctgaacttttgggtgagtacgacttacctctctagacctaaaatccagacatctttcacccttaactatcaatactagatgaaaaaccaccacgggtagctttgtaagcggttttgatcctacgtggtagtctagtcaataattcttttattaaaaagtcgatagggcccacctttagatctctctcctcattatctatttcgctcctcattatctatttcgcccctcagacccctctctctcttgtcagatgccaaggaggagacgcgtcagcggctgcgtgcgtctcgcggcggagggccaaggcagtggccaacgacagtgaggaggcgggagtgacagagcgaggcaagtggcatggtcttagtcgagccatgtctcgaggtaggcgtgatgcaagatgtggctgcaggggggcggttcaccaccgcatccgcctcgaatcgcactaggtagacgtggcaggtcgtcgtcggcccgcccccatcggccgccgagagagatggaggtgagggaaggaataagaagagaggggattagggaaagagagagaggggaggagaaagagatatagagggtgagagactaataggtgggacccgccgattttttttaaaaaaattactgattggactgccacgtaggatcaaaaccacttcggcttgagtggggggtgggggggtaattcgtccggtattaatagctgagggtaaaaaatatctggtttttgggtttagggggtacttcgctcacccaatagtttcagggtgtaattcggacttttcgtaaaaaaataatgacatcaatttttatgattcagatgttccatcagctctcacaagtccttgtgtcatgaactcgaatgttcccttaatcaattccattcatttttcgttaaggtactaaaaatatattgatttttctattcatcacataaatttacatgtgtcaccttctatgcaaaaggagacgcattaatttgttcaccactcgatcctcgccattaccatcaggcccacacacgtaagaagcgtcatccacatcgtgcaaatataaagaattaattatcaaaaacaaacataatctttttataattgttcatatcgccgatgcttataatcatctcgtgtgctttggataaatcgtaaatatcaaacttcagccacccttcaatacccggtgcaacgcacgggtattttgctagtttttatagataaatatattaatatttacaacaccaaattagttcatttaaatctataattgaatatattttcataatatatttttcttgggttaaaaatattattattattttctacaaacttagttaaacttagagcagtttaactttgaccaaagtcaaaatgacttatagtctgaaagggagggagtagtaatcttcaaatggttctttctcctagttaattattcatatgttgagattcaattacaccattatatttattgcacacatgtgctcacttcgagctacaaagctcggtgctgagatcacccgtttcgctgggagggagtggctggcggagagaatcgatgctaccaggatggtcgagttcttggtcaccaatatcgttggcgaggaaagggaggtggccaacaagttgtcaaatcattcagttcacgaaggtggatcccgacgcatccgccaaggcactccagatgctcaagtccgccatcgtctatggctagggctacgctatgctttgccagggcaatagatgaggttgtatcatgggtgtgagaaatatgatgaaggatggcctcgatgctgcccaggccatgctgttggatggtgtcacttggccaaggggggtgcactggagaaggagggtgacagtgaggtgaatttgacaagcactacgtcttagtccatgagcgtcaataggagatagaaggaagaggtggtacgactagaggcaagaaggatatttctcctctagctttcatgatggtagtcggacatgtcatgtcacgtgggaaaagtggcaagggactatggatgcttttccattggcaaaaatttatgaataaaggcaaatgtggcatttgaagaattggcaagggtggcaaataattaaattctcttttgcagagacgtggagagagataccgctttctccgtttcctactcgctgcatcactcatccaagcacagtgagcccaaaaataacattgggccaatgaacccgagcccggcctagccgtccctcgtgcgggcgattgtcacgccttgattttttttcaaggatttaaacttatctaataaaccatttttagaatttatattcatgtgtaaatttattgacaagtgaagtaaataagggaaataaaatttccttaataaatcatggttagtgttacttttcttaaattctccatgcctgaaaatactccttggattttctcaaaattcccatatctcaatagctaatttgaaaatacaaacatcattacagtagtaatcatcaaagtgaaaaccgctaaattgtcaaccactcatgcccgctcactgctccttctccccacctatcgttgcttctcacagctagatccggcaaaggtaagcttggagtagcccagatctacgatctgcgagctcagcactgcacgttgtagccaccaaagcaggcaatggtcccttcaagctcgggcagctagaaggctgggcgagcattgacggcaatggcgatgcctacgacgatcgtgcagcaacggagaggagactacaacgacgactcaagaggagtcaaggaagcaaataagggaggtgggatgcatccccgcctcgctcaccatttacaacctcgcatcccgacgttcgtccacgcaactgcatgcacttagtcaggtgagaagtgaagctcaatttgagcaattccctcttgtcttgctagtcagacgattttcgtacatgtagagcttatccctacaggccatgctagcactaccaaaaaattgatacaacaaaaattgatttcaaacaaaaaagcccataaaccaaacctacatggcctataggataagatctttgtgtacgaaatctatcaaattttagcactagcaaatttaaatttgatagtatagaattggttctgaggtgaaaaaaaaaacggttagccaaatacccaagttatactagcaaaagaattgataaagataaaaattagcttcaatcaaggtaaccaaacacgccagagcttcaagccttcaatccagttagcccacaactgatccgggcggcttttttttcttaaaaaaaaaaagggacccgggggcctcgtgacgacgtggcttctcccaccaccgtaactcccgccccctcgcagtctccttcccaacaactggtccatacaccaccaacccccatacccccgccgtttcacctaccacactcccggctctcctgcaccgggcgcacccaattcacacccacaaacgcacgcccgcacgcgcgcgcgcgcgctcagagacctccgtcgccgcccgccgcacgccggcgacccaccgcgccgcacgatgccgccgacctcagtgagcccaccaagaacagcgccggggccggcgaacccgagcccggcacacccgtcccgcgtgcgggtgatccacccgggcggcgggaagcccggtgggccggtggtgtactggatgctgcgggaccagcggctcgccgacaactgggcgctcctccacgccgccggcctcgccgccgcctccgcgtccccgctcgccgtcgcgttcgcgctgttcccgaggcccttcctcctctccgcccgccgccgccagctcgggttcctcctccgcggcctccgccgcctcgccgccgacgccgccgcccgccacctccccttcttcctcttcaccggtacgcgcccttttctttttctttttctttttctttttcttttgtctccatccgtgacgatgacatgtgggccaccccgtcttgcgaaatgtgacgtggctttttctctggctcgctgacaggtgggcccgcggagatcccggcgctggtgcggcgccttggtgcgtcgacgctggtcgccgacttctcgccgctgcggccggtgagggaggcgctcgacgcggtggtcggcgacctgcggcgggaggcgcccggcgtggccgtgcaccaggtgagcgtggtggcattgctgtttgcatcaatcttccaagaaagttgggaatctttttggggatggataatgaattcgccggagaatttagagattcttgtggaattcttcgaatgcaggtggacgcgcacaacgtggtgcctgtgtggacggcgtcggcgaagatggagtattcagccaagaccttcagaggcaaggtgagcaaggtgatggatgagtaccttgtggagttccctgaattgccggcggtggtgccatgggacagggagcagccggagggggtcgactgggacgcactcatcgccagggtttgcaggtgcggatgataattctaaggtgtattgggtggtaattttgtttgtgtagatatggatgactattgattcttggttgtttgagcagtgaggcggagaatgggcc

SEQ ID NO: 68497 - DNA, 2149 bp, Oryza sativa
gaccggaatgatcccacgaaaccacgggcattgtctgggctttcaccataccttcattttgggcacatttcggcacagcggtgtgcgctcgaggcaaagaaatgccgacatcttagtcccaaggtgctgttctttaactgatttgttatgattaaaagagttatgatcctcttgcaatgtaataaattgttagatggcattgtttttctttaccgtgaactggctagaattcttagtgatgttgtttacctaatagatgtttgaagtaacatgtgttctgaaacagtccgtcgatgctttcttggaggaattggttgtaaggagggaattagctgacaacttctgctattaccaacctcaatatgattcgctgtctggtgcatgggaatgggcaaggaagacactgatggatcatgctgctgataaaagagagcatatctatacgtgagtaagttgccctttataatttattgtcacaattttaaccaaattatcttcctgacgatgttaaggtaaaagatcttcgctctaattggttatttgttaattgtcattttgttttggctaggagggaacagcttgagaatgccaaaacacatgatcctgtaagtgctattggacgtggtgtactctgttgctgatattgaagttactctaacacactgagttattttttttctaaatgattatcagttgtggaatgcatcgcagttggagatggttcaccatggaaaaatgcatggattcatgaggtaatatatcatgaccagactcttacaaaatcacgcaagtataaaatgtttattgaacagttttttttttatgaaactgcttgttatatttcttctgtacccatggcacattctagttagttgcccataacctattggcccacttgttgacaacatatggttattttacccatcatactgatggtgtggtgctaacctaaaggcattggattgcccccaccccatctttgctgacataactgattagtttgctttgttggatagatgggaattttctgacgttgtggtttactttatcctatgtcagaaaatatgaagttatttgaaaaaaagcattccttaaaaaattagttttctgtagagtttgtgtagttccaataaatttatgatgatctatgtgatatgtctggtagcaagcctttggtgcacataattctctttgattctgggcaaaccttttacactatttttgttcaacttttgttttggatctggaaagaaagaaaagtaagttgttttggcgaacatcaaagaatgatgttatatctaattgattcttagttctgaaggtaacagtgcctgtaaggactttttcctttcctaatgtagtagttgtctgtagaatgtactgggccaaaaagattctagaatggactagtggaccagaagaagcactttcaactgcaatttatttaaatgacaaggtaagacctatacacatgtttgggaaatacagttgtgttattttgaatttgtcctttttatagttttgctagttgtagttaaaatagctatatttcaacacatggaacatgataaagaaacatggaacatgataaagaaactgctcacatgaaaaattgtaattgaatagcaacttggaagagtctgcccatgcttaaattagttcctgcgccgataaccgaaaagttggagtcacatttatcaaattaagaaatatataatttgacattcttttcatgtaaggcagaaaattgtatggttggtgctcttttcattatcttatcttcccttaagttaaaaacatcatccttctagggacaaccagacaataaatcagcttcacggtcgcctcggataagctggactatcctttttcttggttacctgtcagaagaaagatacaaaacagtaactggggaaataaattttcaggaatgtgaaattgctcgaagatattttcatagttgaacctacaattctttccccagctggattgttctcgttctttaataggagtagttgtttgcattgaagtacttctacggattttatttatgcttttcaacaaagtcttacaaatcaatcttgtggcagtatgagatagatggcagggaccccagtggttacgtcggatgtatgtggtccatatgtgg

SEQ ID NO: 68498 - DNA, 1346 bp, Oryza sativa
ctgtagatctgtttgtctgatatccttgtaggcttctaatcattcaaaatttgctagcattgttaagactttaagacatacagtgtcacaccagttgaattcaagtgtacacattgatctaacactgaactaaagtactgcttactgcctaacaaacagtacttggcaaacgatgcctactgtgtaatgagaaagataaaagaaaatgtcttgcaggtagtgacgtttttttttaagtaaatttcacaaaactatatgtattttgtacaatttatcataaaactaaagatttaagagctttcacaaaactacagatttagtgtctccgtttattataaaattataggtactttgtacaatctatctcaaaactatagatttaagaatttatttcacaaaactatagatttcgtgtatttgtttatcacaaaactacacattcagtgtcttcatttatcacgaaactacagatttattgtctctattatcacaaaactacatgtttttaacaatgctcaaacttgtagttttgtgataatgaagacactaaacttgtagttttgtgataaatgaagatattaaatatgtagttttattataaaagtacttaaatctgtagtttgtgatatattgtgcaaagtacctgtagttttgtgataaatgaagccactgaatctttaattttgtggaaaagttcttaaatatgtagttttataatagactgtacaaaatatttgcagttttatgaaatttactctcttttttttatattaaagtaaatgacaaggataaaagaaaatatcttgcacgtagtaacgttatttttttataggaaaaagtacgaattaccccctaaactatcgtggttgatcgaattaccccctaaactcgaaaaccagacatcatttaccctgaacttttaattccggacaaattaccccccttacctcaatccagagcggttttatcctacgtgacgtatacgtagcaatccaatcagtattttctttttttttaatggtgagtagtcatattccacaaacaaaatctaccactgtgttgatagggcgtggtttggtagtatatgctaatttgaccactgttagtggacaatgatttcgtacagtcaaagattaatttacaaacaaatagttccacgctgtgccccctccaagaaatcatgcttaacaacagacattctgcatttcttattattttcaccccttttttaatagccaacgagacaaggcacaggttcttatttccctagaacgacatttttgaactgaacaaccaaagcatgtacatctgatttcacaaagagagaaacaacaaaaagggatcca

SEQ ID NO: 68499 - DNA, 969 bp, Oryza sativa
atctacgactaaatttccctgcaaatcctcttcttggcaacagacatcttcacttgggatgaccaagcttctaattggttgcatcttgtatacaacccactaatcacgcaagtctcgccttcgggaaggatattgcagataatatacttgtgttgcttgatgagccatagcaaatggttcaaagtttgttaattttgaggtagactttatttctatcattcccaaagttggtgtggatcgtttgccccgaatggggtcaaaccaacggcattggagcagcactatttcaatcttccggccagcatcaaatgttagttttataatgtcttcgatgacaccatagtagtcaagttgctggtcatcagaggtgaacgaggacaaacaaacccctgagtttactgtggtcaaccttctacgagatttttcatatttctcggacctaaaacgatagccattaatatcataagaattgtatgacaagaccctaggcttgcatccagtagctaaattccacaaatcatcatctgcacttggatcatttcgacactacaataagtaaataatttagaaattaaaaatatatattttgaacattataggtaagaaaatataaggatatatatagagtttttacagcattcttaaaccagtcaacaaattcctctctcatcaattgatcaagcccctcgactgaaagattattatgcattgcatgcttctcttcagaaaactttctacaaataagatatgattagaaattttgtttgtaacaaactatatataatgaaattttcatcacatactcttgaaatttgtcgaccatagagcaatttgtcaggacatataacatcgcaacattcaactcttgtggactaaggtctcgaggcacacctctaccatgaagcatgccctgttcctggaacacatctaaggtgcaaccatcattttgcaccactgtaccaccattgt

SEQ ID NO: 68500 - DNA, 9686 bp, Oryza sativa
  unsure (1)..(9686): unsure at all n locations
atgcaaatatagttctctttgtcacatattattgccaaaggtaccattgtgaaaccatcggtaaagttatgctcctctcggtaattttttcctgtacctttggaacttataaccatttccgagaggtatattaaacccatcggttactaatataccccgtcagtcactaataataatttccgagagttatattaaacccctcggttactaatataccccgtcggccactaataatcatttctgagagttaaattaaacccctcggttactaatataccccgtcggccactaataatcatttccgagagttaaattaaacccctcggttactaatataccctgttggccactaataatcatttccgagagttgaattaaaccactcggttattaatataccccgtcggccactaataataatttccgagagttatattaaacccctcggttactaatataccccgtcggccactaataatcatttccgagagttgaattaaaccactcggttattaatataccccgtcggccactaatgataatttccgagagttaaattaaacctctcggttactaatataccccgtcggccacttaaaaccattttcgagtggtatcttataactctcactcattgatatatcccgtcggccacatgctaaatagccgaatgttctcataacaaccctcattaaaatttcaaacggtcggccacctaaatcttcctgacggtctgtaggattttttgtttggacgcttggcaaatcttaggattctagtagtgcatgcatatgatgtacgggtaaattccaagggtggtgtgtggctatttgcataaagctacatttcgcaaacctaagacctagcaattttgactaggaaacatgttagattaacgagggttcatccacctctacaggccttgcttggttcagtttaccctcataagttcatttacttcaactacatgagtcaaccttcctatcccataggcaaggtcacaatgtcatttcatgtttttaagcaaggttaaaatctatgagtctaatcaagacatgtataagtactagcgcttaataaccgtgagcacggctattcgaatagattagtttactcacactgcagtggatgtacgcttttaatcccgcactccgcggcttgcccaacacatgagcctagtcccaacacatgagacttgccacggcccggcttttcagttgctctcgcatttcagcacccactccaaggactatgagcccccattgcaccccggcacttcaacctacctactactggatggtgaggggagtcctggcgttcttgggaaaagggatatttactacatatacttctagggtgtattttaagttattgacatcatttaccaaattgacactgcactatcctcaacatactcatacagaaccctacccatgatctgaaggtgccncggtctccacgaagagcttctctaatccatcaggtctaccaattcgtgaaatgtggtcgtactcagttcgtttcttgcatagcttcctaactcgatccttaactgactagggtcggtgattaaccatttctagaaccacccatatactactcatgccgccccagtcaaaatagctttgtttcattaagttttgggttttcgcaaaagtttgtgtgaggtaggtggcgctcatgtctccacccacagatcgttaatcgcccctactgggcaacctttcatccatagtcttattgtacttgtatggaatatatacaaaacgtctacaagagcaacgctaagcaattgttggtaatcgactacgcgtaagtaatggactcgggcgtcaaggaggtataatacatgtaagggtaaacaatatcatggcaggcatcattcaagtgtaggtacgcaattataaataacatgcaagtttatttgcaaacaacacatttgtaaataggctcaatatgttcaagaatggggcgtagaaacttgccttgatcagtcaaggtctcaacctcaactggctcgcactcctcctcacagacgtaacctgtttaatcgaatgcgggaattaatgactaacttacgtctaacgccaaggctaaattgcaagaaaaattgaaaaaataccaaaccagcgtcatttgaaagatgaagattctagaagaattttggcgaaggtttcatcgaaatccgagttgaaatgggggagatataagcttttgaaagttgggttttgaataaatcaattaaaagtgaaagggctgacaggtgggaccggggagggttcggctgattggtccaacggattttaaaaagagcggggcctgcgtgtcagcctcagtctccttctctctgtggtcctctctctctctctcgcgcgcgtgtgcaaggcgacggaccatggcggctagggttgtgctaagtggcggtgttatgggatggaagtggttgcggccagggagggtggtatggtgaagggtacagctaggttagggaggcggtgcgtggcccagggaggtgtttggcggccagcaagggtgggtgcggcggcggccttaccacggcacgacgccggagatggcggggtggtggcatagcgtgggggcggggcgagatggctcgagaggagttgcgggtaggtgtactgaggggtacggagtcggtggctttgatcaagacggccgggagagggatggcggcagtgcggctgatggtggcggtgaccagaaaggggtgtggcagacatggacacgattagggcgtggttggctggtacggggttgcagggagcatctccgaccctagaggagtcaattcccctggctggtgtggccgaaagcgttggctaggggtgtggtgacgatggcctggacacgatcacggcggtgggcgcacggtgtccacggcggggctcagccggaggggatagggagggggatgggcatggtacgcggggtggctagcgatggtagcaattttgaggcttgggtggctcctaggaacattttggagttcggctggtggggctagctcgaacagagcatgcccgtgcgcggcacgcacgcacatgtcccgcggcgagagtggcgcaatgggtaggaggctagacaggtgatgcggttcatgaggaaggttgtctagcgtggtagcgttgtagctggtgaaatggcggctagcgcaggggctgggtgcggtgtttcacccttcgtgtggcaccgtgccatgtcggcggcggcagaacgagagacagagggagagcgagcgtcggtaagggcgggagagaagggcatagtcacataccttgtggcagttgtgtagcgacacaacgggcggtgatccctgcacgaaacaatggtcgtcgaggtattgcctggggatggtcaacccgcggatcgtcctcgcacgccaagtgttcgatcgacgatagcaaataaacacacggcgttaaggataaatgatagtgggttagggcgagttagttgttaggggccagttagctcaacaggaaggtacaagtcaacggttaggggttagtgcaaacgaaatcgaaagggttatcaattagtcgtcccaagttagttgttagccgttcttaggatcgatcaagcgtggcagcctatccacctcttgctcgactgaggcccagccgaagccggccgtggcagagcaagcagggagacggcggcttgtgcgcgggagagaggtggtggagcgaacgggcatgagtgaggacagaggggaaagagagcgtgcttgcgtgcatggccggggcagggtttatataggtgacagggatgtgaggactccccacgcgtgcattgaagaatgctcatcgccatgcgcgtgttggtagggtggtaggcgaggtggcggcgcgacggcacggtgttggtgacggcgcggtgccgtggcggcatggcattggcgaggagggacacgagatggcgtctggcagacggcgccgtgcgtgcggtgccttaccggccaggtccacgggcggttaaggcggcgacggtgatcggcggctaagccccagcggttagggcggtcgttggccaggagcgatgcaagtcgtggcgaggagtcggcacagcgagagtggaaggactggcgatggcagtcgttagcgacacgcgacggcattcgtcggtcgtcagcgagaatcggatggacggagatagctgtagagccggcacggcgatgggcggtggcgcgcgcactactagaaaaacgattttttatggcgttggcctattatttttgctggcggaaaaatgtgaaaaccgccagtaaagtcgtaacgagggggtggggggcaccgcccgccagcgaaaatatgtctatttttgctagcggtcacttaggttcgccgccagcaaaaatagataatcttcattggcggtcaaatttttgctggcggccaacaaatgaaaccgctagggaaaacacccaaaaatacctgtcacatattaaaaccacccacatacctcatcctcttcaccttctctcgtcttcttatccacttctcttctctccttctcactctcctcctccctcccggcctccccaccagcaacggcggcggcggccctggtggcggtgaccggcggcggcggctttggaggtggtgactggcggctccccatgccgccctgccctcccatcccctcctcacccctctcccagatctatccgaggggaggaggccgccgtcggcgtcacaaccgaggggagcacacagcgcggtggagctgacgacacggcgggcggtaggtgtgcacgcgggcggtggcagatctgacgacgacgaccacgaccgcggcgacgacgacgacgacgctgcaggccgtgctaggtgacagaggaggcctgccacggcggcgggcggcggatgtgcacgcggcgcgggtagcacgcgggcggcggcgaatctgacgacgacgaccatgaccgcggcgacgacgacgctgccggccgtgctcggtgacagaggaggcctgccatggcggcgggcggcggatgtgcatgcaccgcggggagcacgcgggcggcggcggatctgacaacgacgaccacgaccgcggtgacaacgacgacgacaaagctgccggccgtgctcggtgacagaggaggccgatgggcggcgccacagcataggggaagcggcggcggcagcactgccctcccctccccctactgtgttttcttgtgtgttcttgtttgtaaagatgtttattaggatatgtgtgttgttaatctgttctgttgatgatgtcaatgttgaatttggattgatgccaatattatgtatttgtgatgctctggatttggattattgtcaaatatgaacggttttgaatttggccaggtggggaattttgaatttggggtaggggattttctagcggttctcaaccgccagcaaaaaatcttttgtccgcttgcgaaaatcgatttttgcaagcggaccgcaaccgctagcgaaaattattttcgcaagcggaacgaaaccgccagtgaaaattttagatcttcattggcctttactttgtggcggctctaaattccgccagcgaaaatcaaaaatggtcgccacgaaagatggttttcgtagtagtgtcggcagcgtgcacccaggattagggggtgttaaggtgggagaaggggagggggaagtcataaacttctttattgggctgcccgagcaagagggaggtaaagtagacttttcccgaggtatttctcaggccgagacagggttcagcagaggggggagaaatagacttttgccggatcaaacaaagcgacataacaacaaggagaagaaaatcgaaatattcggaggagaaaagaaaatgatccaaaattaaatgcaaaacttggcatgatgcaaactaattgtgacaggtttttaataatcggatttttcagggtgttcccagtccctcacgccgccgcaagctccccatctccccgtctccttctctctacgcgaggcagagggcgacggaattggcggcgctcaagctcgagctctcaagcgatgagagtgagttgggtggcacggatccagcctcgtgctcgctggatctgccgtcgttgggctccctttcctctgtcctaggcggcacgggccacaacggcggtgttgcgaccacaacagcggcggcagatcctctccccctcccttcttcgcgagcgtcggcagtgctcctcttcgcgagcgtcgcatcggctggcctctcccatcccacccctttctcgtgacggtgaggggccaccggcagcggcggatctgaccatgagcacctactcgtgaattatacactgcgcatgctcttagtgcctgcgtacaacatagtgcaatcgggataacgtgcaatcagtactagaaaacaacacaccttataggtgcctgtttgcttaaaacctacacctataacacgttttacgtcttttcttggaataaaattaagaaccaatatctataaccactcattggaaccggtttataataaaaaccggcataaatagtcctcaagtaataggtgtcggttccttttaatagaccgacatctgtgaacatcatataggtgccggttcttataataaacatgtaccaatgagtctggtgccataagtaccggtttttattgtgaacctgctgacgaaaaatccgcgctcgcctgatggtgccggaactgtgttggcgcaaactaagttaacgaacacaacggcctagaagatctgtttagctcctgtgcagatccaaaatattaatgagatgcgggagtgccagtcagtttgatcctacaactgacaagatatataaacaacagctcaaacagctggtcggttgtcaagccgatggagtagttccagccgatgctgatactagccaatgtcgatagggtttgagcaattggctatatgtccaatgtagataatgatataaagacaatcggctgaagatagtttaatagaacaaaaatataatccagcagaaaccaatcggctaataatgatatgaatatatgatagaataaacactgatccgaaggttaaagcatacatcggctggaggtccgacgtcataaaatccacaagaatagataagcagtgaaacatttgttgtgatcagttaaaaccaacttgtatgcaatctttgtaagccgatggaatgtccagataacacatcggctgaaaccccaatgaaacccttattataatcaatgataggttagcttttatgattctaagcatgactaggatgatgcgtcgcaaagtatgcgaagaagcataaagtctgaacaatcaagcctttaatataatctagcaaagggatttagtcgatactggcataaacccagaagcgaatctcaaccgatacaagtaaatcgagctaccaaactagattaactaagatatatcataaataggtagataaacataccaaccaaaccagagcgatccaagaggttgaaaacgatgcagccttatacaacaccaatgtagctgatacgattgccagggccggtgcaacgtaggacttaccccttcgctggagatcgaaagccgatgcagtcctgcgtcaagtgccaagttctgccggtaataagtaaaaacctcagtaaagagggtgggatgcaccgagagtaattgtattgatctgtgagataaattgcaatgacaccgggtgtacatatttatactcatgggtagatacttgtccttgttggacaagaattaaactttcataaagataaaaggaaaacataaagttcttattggacattaaacatactttcttaaagataaaatggaactaacaaactcttcctaattaatagataaactgacatgccgcatcctccttgaactcggtctcttctggataaacttcttttaatagattaaattccttaaccgaatataacaagaatccaactattggcgacttgataattctcatcggccgattccaagactctgaagccgatactgactctaggccgatgatgatttcggggcttaccaaatttcactgttaatcacatatgtacctgttcttgataaaaatcggaaaatataatttcataggtttcgattacaattaaaacctacatctatgatgccacggctcgtgtatatgtattttttatctaccttttccatacgaagttggatgaaaataaactttgtatgaaatttttagagttctatgagatctacagctttgttgttaaaaacgttttgattggaggttgtgtgggtatccgaaaatgtatggtaaagtctcagatctatatgaataagtgaatttttaaaatttttgagcgatgtcagatgaataaaaaatctatatgaaagttgtagattttggatgagatctataattctgtaattgacaaaattttcatttgagcttatctatggttttaaatatgaattataagttcggataacagtggtctcaaaagaatagcattttctactgaagacaataattgttctgaggtgtgatgataagtagctttgaatagagacagaggccttgggttcgaatcaagctcggcatatttcatgaatatgggatgaaaaaaatgagaagtgaagtgtgagtgtggtaggtgcctaataaaatgtgaaatatttttctgtatctttttcgcatcttagaaccggcaccaatgaggggtagtaaggtagttggtgccggttttagaaccagaaccaatgactaccctcatagtgccactaaattgatgccgattttgggggtttggaaccagcaccaataaaggttattgaacagtgcaattaatggtacaaatgctgaaacgcaactttagcaacgctactaatcggcattggatcaaaacatacaaggtccatatggaccatattcctaatgaaaaagtacaaatactcctctaaattttagatggaagtccgtctatcaccataaagtttagaaccggatatccaccccctgaattttgtaataccattccctaaggtggttttagatggtgtttttttttcatatttttaaaggttaaattaataactttgaataactaatataatatatttggatatcatcaattgtaagtcatcaatttatacttatacagtgataatttactattattgtgttggtacctgtatgtgaggactaacaacaggtaaaaagaaatatttaggtatatatacgtgtgtgttatgtatatgtcacatgatcaaactcaaccaacttatatataaattagataaaaaccactatgcaaaaaccatcttagggggttatataaactttattgtaaagtttaagggttcaatgtctggtttaaaagttaagggtgttagacagacttttatcctaggtatagatgggtatttgaaatttttcatattcctataacattgttcatcaaaataaaagaggaaagtaatcaagaaactcataaataacaaaactgacttgacagtctatttgccaaatgactattttttttcttttccatcaatcattttttttggcactagattaatatcagcaactcaacttatctgtatttttatcttatggtgaaacaaataatattctaaccttaacgtaatgaaaaatatgatttggtgtaaattctaccagtataaaaggtgcatctaggtgaatcggaaaaaaaaa

SEQ ID NO: 68501 - DNA, 9239 bp, Oryza sativa
gatgctcataggggtaagatgtgtgtatatgttcataagggcgagtgtgcacgtgttatttgcatcttgcatttgtaatgtgtatcaaaaaaagaaatactgctttatgaccgagtagaaggtttaggtgaccgatggattagaaaaaaaaaacaagttaaaccgttagagaactgataaatagcacagttgaatactgcacgagaaaaatcctgtagtaagtatcgtagcgtaaattttaagagggcactgtagtacaggttttttttatcgatgtcttaattctgcaacagtacaggatatgtcctgatggtcaaatttgtagtccttatacttaacaccttgagagtaattttagcacagagctcaaataacgtaatttattcaactatgataaattaaaagtcttctattgattgggccacttgcccatagcaattatattttttatatttctcctcaacgaaggcttttatcttcctctcgtatatatcttaggtgatttggacataaatacaactactccattcatttcatattaataataagatgttttaatatttttttttcaaacttctataactttatcaagtttacatatagaacatatcaatattttcaacacaaaacaaatatactaataaaatttattaaaattaatttggtattgcagatgttgctaaaatttcaataaacttaatcaaatttaaaaagtttgattaaaagttaattaaataatcttctcataatatgacggatggagttagatgtgagtataacgagtcgtggggacgcgcggcgtgggtcgcacgagagccaggtttggtgtgcggacttttcattagtggtcactgtctttcagatttttgtctgtcggctagctctgtttgcggctggatacgtatatcgccggtctgtcttgttgtcctcctgtcctgctccgatacaggcagtggattagtccctcatccagggtgagagatatgcttttgatgttagaatttgtttcttctttccagccggtgggctatatcaacacgactctatttgatgagcgatcactccaagtgattggcaaatgttttatccggagtgcgtccagcggaggtagggatgaaaaccgattgattacggtaagaaactaactctatcatatttattttcataattatttttcagaatcgaaatcaaaatcgaaaaccggatatgaaaataaaaccgaatattatcgaaaacaaatacggaacgaatacgaagcgaaacaaatacggtgacgaatattaatcggaatataaaaacccctcactactacacaaatattttttgttgtacgagaccccataatttttacaaatggaccataacttgccgcgtcggcatttacacatacgactgcttaagacgccaaaataagctcatttttgcatgtggaccactcaagagccctgatgaggacatcactacctcggatacagacaacaatcctccaacggtcattcaaggaccgataacaagagctagtgcgcggcaattaaatttagaggtgagctcgttcctatgttcttctttgtatgaattcgagaatagaggggacaaggaaacacttggagaaggacttagagccatggaggatcatcgaggacgtctaagtcaaggtggagacccaaaccaaatcgacctcgggtgcaattcggagtccagaaccagtctgcattaaaacggaagcccaggtcgcatacgcgctcggattggggcgttctttatatggatggaaagctaagaagataacctttccaatggttttggtcccatgtccaaattcttttcgagtcaatgggaatcgaccgaataagttgacatccagaatctgtcccggtgctacgtcaccgtatttgggcctttgggccgtgtatcgtgttggaacccattagggttgcgtcgagaggggattgtacgaccctaaactctatatatcagtaccagatatccacagatccaaaaactgctctacgcagtgatcattacatgaagaaagctacgacactactttcaagcccacagagtcacggttgtctcctccttccctctcggcgaagttgtgagaaacaaaggcgttgtcggccgcattgcgaaatgggtagtcgagctaagtcagtttgatgtccactttgcaccacgaacagccatcaagtcccaagtacatgctgattttatagctgactggaccatgcctgacaatcaatcagacaactagatcgacaacgaaacatggacaatggcattcgacggtgcactcaacagccaaggagcaggggcaggattcatcttgacatctccctccggagatcaattcaagcacgcaatccacctcaacttcaggacgaccaataacacatccgagtacgaaggactactcgccgggataagaagagcagccgcacttggggtcaaacgactgatcttgaaaggggactccgagctagtcgcgaactaggtacacaaagattataaatgctctaaccccgagttatccaagtacctcgcagaagtcaggaagctggagaaaaggttcgatgggatcgtggttcgacacgtataccgcaaggacaacatcgagccagatgacctagcacgacgtgcgtccaggcgagaaccactcgagcccggcacctttctggacatcctgacaaagccatcagtgaaagaggcaatcggcgagatcaacacagccgtccccgacatcaactcggaggccaaagaggcggaatgcgccatcgccgatatcgagaccacagacgactggcgcaccccactgatcaaattcattaacagcgaagagttgcccgaggacgacgtagaggccgagaaaataacccgtaaagcaaaaatctactgcacgatcggcaacaatctatacaagaaagcgccaaacggagtacttctcaaatgcgtcttgtccgacgacagcagacacctcctcctcgatatacatgaaggcatctgtgggtcacatgccgccggtcgcgcattggtcaggaaagcctttcgacaagggtttttctggccaaccgccctcaaagacgcatgtgacatggtctagtggtgtgaagcctgccaattccacaacaagcacacaaaatcacttgcacaagtgctccagaccatccctcttacttggccgttctcgtgctgggggctagatatactcgggccattccagcgaggacagggcggctacaagttcctattcgtggcgatcgacaaattcaataaatggatcgaagcagttcccacgggggaaatcaaagccgccaacgccatcaagttcatcaagggaatattttgcagatacggactaccgcatcgcatcattactgacaactgctcccagttcatcagcaccgatttccaggattactgcatcgggctgggagtcaaaatatgcttcgcttcgtttcccatcctcaaagtatcggactagtcaagagggcaaacggcatagtactacaagggaccaagacccgtgtctacgacaggctcatgacacatgacaacaaatgggtcgaagaactcccatcagtactatgggccatacgcaccacaccaacaacgtccaacaagaaaacacccttcttcctcgtgtacggctccgaggccatgctccctagtgagctacgacatcagagtacacgagcacagaagtattccgacgaggaacaggaggagcagcgaaacgacgatgtgaatctactcgaggaacatcgcgagcgagttgccgttcgagcagccgcctacctacaagcccttcgccgctaccacgagaagcgcatccgagcccgcatactttcgatcgacgactacgtcctccgaagggttcaaagccaagtagggcgaaacaagctctcacccaaatgggaaggaccatacacgatcacacaagtcttgcgatcaggcgcattcaaaattgcagacggcgatggccacgagttggcaaactcatggaacattgaccaactacgtaaattctatgtatgagtcaataccatccatatctgtaagacaacttacatcatcaataaagcctattttcaggcgcatattacaatcacagtgttcctgcctgatgatccctcactcagacgacacctagcgttgacacctatcctcatgtccctttacgccatgctgacaaggcctccgagaaacctaagggatcttcggctggggacgcccagagccgataaggccttgtcggattttgtagagacgaaagaccatgtcagacctggtcgtgtaagagttctccccatgcgtattaaccaagccgcgtaatcggaaatgaactttccaacttcacggctgggggctaggattagtgcttgttcaaccgaggcaggtcaaaggtctaagagccttgtcccccgagaagaattctccaacggcaaggctgggggctagagagagtgtacaactcaaacgactggccaaagtcggaaactaaggaggcactcttacacactatatccagagtaagaagggctcattaagatagatttcttttctatttcataagatacttcttacaatttcacacaagtccaaaaccatattacacttttccccaagatgtctatcgcagggtgcaaaggctaccaggaaggccaacgctagtccatcgactggaaaactttttccgtcagcggtgccatcgacttcgccaggtcatctatctccgcaggagtcctccgagaacgtgaaaaaccttcccggaggaactcgaggtgcagctgcggacggtgatcccgtatacaggccaacacgtgccccccggcataccggcttgagcggtgacactcctgcttcaaggccccgtcgatgcgtcaaccaatggcttcaagctgagcgcaggccccgttcaaccacgagatgtatctggccgccgattcttcggggtcgccacgaggtactcggagctccctacagaccctcgacatggacgtgcagcaactcttcagatacgagtcgaaccacacctcgcgacccctgagtgcctccacggcctggtcttttttcatctcaaccatcgccctctcgagttatgcgacttcacactttgtcttccaatattggatgcgacggttttggtcagcaagtctaccctcgagatctgctcttccattccgagaacacaaaaatcaagttaccccgggaagaagaataaaagaaatggaaacaaagatcaccaacctaaggaggtcatcgccacacccatttccacgggtgagtttcgtcccatctcgtcctgcgacacaggcgtttggagggcaatcgccggaacgaccactggtaactcggctgcccacgctgctggacatcctcgacatcgacatccctacaaacgacaaccaaaaatactcaggaccagggtgccaacagagatcaaggcagcgattgcgcgaagaaaggcagtcgaagccgacaaatcttatacaaagtgtagtcgattacagaggagctgaggccctactcttcaaagaacgggagaacagactctcccagttcgccaatctcctccatcacacccttacgagcgtcgttggcggccccccgatcaaagatctaccgaagatcgagtttggggtgcgccaaccttacgcacgctaggacgtgacaggccccggtgtaaatcccgtttgacgcctcctccacgatcctggccgcatgtttggagggtatcgcctccattgccgtagccagttccgcaagcgaggacgtcagcgagaactcgtcggggttcgccgggatggttgtcgtgacgccacactccccgacgagctgatgaagaccggtgtaggtgacccgcagcgacccacggatctccgacaagttgttctcgagctccgacatccggacctcgagtccccgccgttgccgttcgttaccggccaccagctccctcattttctggaggtcctcgcgagcctccgccaggtcgtgttacagcttgtcggcacgcttgttcgccgatgacgctgccactgccttcgcctcttgatctcgcaacttatgccgcgagtgccagcctcgaggatgcgcttcatctcagcttgaagctcctcccaggtgaggacatcagccggcggtccacgagtaggtccgaggccgctggatggcccgctcggcatcgcttcacggctctttgacacgaccacgacatcggttgaggccgccgcaggagacgctctggaggcccctccggacctgtcctgcgccgctctcgcctgcgccgacctgcaaaagatcctcacgtccggccctcaaaacaagccgccagaagataaacaaggaaaggatctcgacttccgtttacatacttctcgcctagcgtcaccagctttctctgtcgcggaggtggcggagacgcgtccacggcctgggtaaatcgagcgcgagttgagggcggcacttttcgaatacgaaattaaggagtcaagggacttaccggtggggaggatgctttccggcggctaccgagcacggaggtgaacgttcttcgcattttcgggacacggcttccactagtcgcggcagcagcggccacgtcggacatctcccgagcgacgctctccttcagtgaggccgccgcctggtggtccgcgagcggtccaatgacgtcagtcagagggagagcctacaccacatgaagtcattttccaacccgtgaagcaaaaatagcgaggttgccgaatacactcacgttgattgcggcttcgcgctcggtcgcctccttctcacaaagaggcacggggatgtcgcttgccgttgtcgggccgctaatcatcaattggccgacgcggcactccacggtagcgctactcaagcctgcagatcgagaacagaatttgataaatcaggaagaacatgatcagaagggaatcaatttaactaaaaaggaaaataccccgaggagaaacccgggtcgcgtcctccggcccggaatagtcaaaggctgggtgggctcgagcctggagtggctggatccgcctaccaacgaagtcggtagcgacttcataccccgacaaacctcgtactcggaggtcgtcgatggcatcgatgaagcactggagtgaaggggccaagacaggctttgcggtccaagacgaaattttgtcttgttgttcctcgggaacaacaaagacagggtccgaattctttatctgaagatagaaccacctcgcccgccatttgctacgagaagaagggcactagaacgggatatagcgcgacttcaaaccatcctgaagtcggaacccgacgcatctggacaccctgttggattccatccaacgcaactcatagtaaaagcggaagagatcgaggaagggctctaccccaatgtaggcctcacaaaggtgcggaaaaatactaaggaaggcaatggaattggggttcaagtggagcagagaaaggccgtagaagttcagaaccaatagaagaaattcagaaggtggagggagaaaaccacaaagaatgtaatccttgatcgcaaccatgtgacccaggacaggctggggttcagtacctcctacttctctctccatgactccatgaccgggaagggcgccatcttcctggagcttcttcagcgacgcgttggtggaagtagacgtgccgagatccatcgccgactacagatcgctggaggaagggcggagattgacaagctagggtttttacggaggcggggaagacgagggacgcctggaggttggaaagttttctcacaacaggcggacttcaaaatgaatccccaaaactcccctaaatagacacgcttcgcatggcgcgaatttgaagggaaggagagagagatgcccgccggaattttctgggtctgttacgcgcggcggtttcttggacttcagtttaaattcactcatgaccgttgggcttcacatggtgttcttgattatgtcttgtctctacggtttccacaccgagaacgacatcagcttcgacatcagaagtcgcgattggtcacacgagttcatttaagcagaagtcgggggctactgtcagggttacgggttagggataccccttacccttcgatatatctcacgtatcgatatggcatgcccgcgcatacatggacactctctgtatgagttaaggaaatccttcgcggaattggcagacgaaaagagacctactcggacaaggctaggttctcaacgtatcgtgtacggttcgacgtctccgagtcctgcttggagattgcttgacccgcgatataaaagggaccccctgggagaacctggggggacggaatctctcacagccaacaccactgccacagtctacgaagtcagagcccgcggaagccagatcgccgggaggtctagtcggattaactcgattacgatctcgtcggtttcatcgagttccatcgttccctttgtaacctgtgatttccatgatataatcccataccaactgcattagggctattacctatcaaggggcctgaaccagtataattttcgtcttctgtttgcttgatgtcgtattacgtggacccttgtatcaacgtaccccaatactctctatatccggtctacaggtatcacccgtcgacaccgccatctttaggtttttgggttttgcttagattattctgtcaagaacagtttcgccgctagatcggtttgtagaaccccaaatttgtgtgcttaatcgttcatatgcaatttggttgcaatatatcttgttcttgcttgtgttcttcgattcgcatgcagggattagccttctcggcgaggtcaaccggatttcggcacggttgataaccagaggagacgtggtactgcgattgcggggctcagtagcgtgttcgttcagaagccagatcgagttgtgtcgtgactctgcccaaatcgactgttgatcaatacctatcggtagatcgggacctaactccctcatcaagcccgcatggaaaaatgaaattttccatacgggcatcttaaggagccgtatgcgaaaataaaatttaaaaatttgaaactagtttattgtagacccccgattttggaaatcggaaatcttctgtgtttatccgtaccaatccctggatcagtagttggtacacacatacatagttggatcacaacatatcacgaatgaattcaggctaaaagggttaaatacttacattagggccaggtaggccaacaact

SEQ ID NO: 68502 - DNA, 1181 bp, Oryza sativa
  unsure (1)..(1181): unsure at all n locations
catacctttggttccaagagcttggacgcatagtgaataaaggtcgggttgaaggggcgcagtcagctggcagcttcttggccggcatcatcaaatgataaagtcttggataagaatctacaacgcagtggaacgcccttgttgacgattctatactacgacggcatctagggctcctcgaataatgcgatatcccacaccgagtaaatccttaacccttcctcctcttactaatactacataatgttcttgtaaattatggccaataccaggtatataagcagcgatttcaaatcctacggttaattgtactctggcaattttccgtaaggcatagttgggtttttttggggttatagtggaaaagtcgacagataagtctcccttcctgtccctctacagaactatacatgagatttccacctcatacggctcctcgttcaattctttcgaagagatccttttcctcgttcgagagtctccgcccgaccaacctcgctaacttgcgggacatgaacttacatgtttccaggcaggtaacgtatagtaaggcatgcagcctctgccttacttcctagcaatgtattttctaacgaggannnnnnnnnnnnnnnnnnnnnnnnnngaccgggggggggggggggcatttagactgagtgtctctacctggggtgggtttaaccccctctaggaaaactagagcctataccggttgctatctaatctttcatgacgtgaaattgaactaccaaaaccattaaaaaatgctttgccgacggcactgtctagaatggctcgtggtcaaagatgataattaattgcgtgcaagtaaactaacgtcgttcgttcggcgaccccgcctcacttcacttaacagaaagggggcctattgagaattacgagatttactgcttacacgggatttatggacaaaagttaagcaagagtacttcactgaaaaagcaaaaaattcactggtaccgctttactactcatgattggtacagccttttcttttcctgtattaactcgccaatcaacgaaaatgggcactacgaaagctgtttagtcaatcctgcacaaaaataacgagcgagtaactcacactatttcggcgtaggcctcccaaaaggtaacggaggcgtgcaaaggtttgaaaaaaaatgaaaactgctactaga

SEQ ID NO: 68503 - DNA, 3482 bp, Oryza sativa
gggatccccctcctcatcgcgatcagccatctgtgcatacaaaaaatatttgttaggtctataggtcatattcgctaagcgtaatattaaaactctactaatcttatattaaatctctaataatcttatattaaaattgtagtaatcatatatgctaagtctaacaatcttatattaaaactctaataatcttatattaaaattataataatcatatgctaagtctaacaattttaaattaaatcgctactaatcttatattaaaattgtaataatcatatatatatatatatatatatatatatatatatatatatatatatatatatatatatgctaagtctaacaatcttatattaaatcgctactaatcttatattaaaattgtaataatcatatatgctaagtctaacaatcttatattaaatctctactaatcttatattaaatctctactaatcttatattaaaattgtaataatcatatatgctaattctaacaatcttatattcaaactctaataatcttatattaaaattgtaataatcatatatgctaagtctaacaatcttatattcaaactctaataatcttatattaaaattgtaataatcatatatgctaagtctaacaatcttatattaaatcactactaatctttgtcacgcccggaaatgtcacgcccggaaattcactagtaatttccgaccttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccattcccacaggcagctcaactggggtataagccaaacgtcttctccttctggatcctttttcttcaactgaggttcatttattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaaacaaattattaccagttatagcatcaataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaatgcaaattggccataacaaaggaacagattcacaccacccagtgacattcgaaaataaatgcacagttgaaataaatagagaatttaaatataggatcaacatgctcaaaggattgtgtttagaatctgtgtgacttgccttgcaataattggtcttcaattaatcttcttgaatacttccggcgcactcacgaaccttcgcaacgacggaaacgacaagctaacacgcaaaacgaagaaaaagactaataaaaaccaaataaacagtacatataaagtaaacaaacatgtagatctcgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagcggcggcgcggcttcggtcgacggcggcgacggggctccggtgaccggcgacagcggggagagagcggccgagcttgcccacacctcggcgcacattacggcggtgacggcgaccggcggcgacgactgaggcggcggcgcgacgcggatggagctcggccggcgacaacggcggggtggagcacgtggcggcggcgctacgaggcacgggagagggggcaaacgaaagaggaggactagggggtcctatttatagccatgggaggccgggatcgagcccacaacgacgggaaaaactcaggaaagtttagatcttcgccggaaaaaggaaaggttgaaccgcgaaattggaaaggatttccatataaacttttggggatttcttggggacaaggaagaggagattgagaggattccattcccgcaaccaattcggaaaaaggagcaacgatgaggttggattttggaaggggatcggcggcaacaggcacggcacggctcggctatggctctggctctgtccagagctggaagatgaacagtagcgcagggagagaaagtagacttctttccgggcttttcttttctcagcctgattagaagagggagcaaaacaggactttggctgagagaagaagagaggatgcaggctcgggttgggccggcggaagagagaggaaggaaaggaatgggccgattcagcctaagacaagggaggagaattttattactttcccaattaaaataatcacttaaatgatctttgaattgttaaaaatacttccaatgctcaaataatttcaagaaaaatcctgaaaatacttggacactcaaagtacttaacaaaattacaattagaccatttaatgattagtttaatatgtgggtaattactgaaatgctctttgtatgattaaaaattaggaattgagctccgaaaaatccgagaatattccagagagtataattaaccatggagaat

SEQ ID NO: 68504 - DNA, 724 bp, Oryza sativa
aggaggacgcggcggccgcagcagcggcggcgaggcccacaaggagcacaagcaagaggtggcggagtgagatccagtcggtcttcttctccaagtcgtcaccgtctctctctcccttcgcccgtcatcgccggatctggtaggtcacgcctcctactccccaccgtgctaccgccaactccgccccaacacgccgctgagggtgaaaggggaaactaccactgcgagagcgggaccacaagcgcaaggcttcgccacatcatcacccaacgcgaagccccaagctgtggcttgacgaaaagtagtcgaggagcacgtcccaaggagaggaggaggcgaaaagaagtcaaggagcacgtccctcacaaagacgtcgtggctctacgctggccgctggggaacacctccagctcgaaaaggtacggcatttgaacggcgtcgccagggataggcccttggccccatatccccatcacataaataggcatcctgtggaaggttagtagattgttggtgttagccccatgccccatcacataaataggcatcctgttccacactagagcttctcgatacagaagatcacatgtgcccggtacaactaagaaaatagctataggccgtgtttagtttcatttaaaaaaaataaaaatttaaagtatactgacacatcaaatgtaattagactcaagatgtgcaattgattttattttcaccatgcata

SEQ ID NO: 68505 - DNA, 1596 bp, Oryza sativa
ccaagaagctgccagctgactgcgccccttcaacccgacctttattcactatgcgtccaagctcttggaaccaaaggtatgtatgagcattctgggaaggtcgcaagaagccggttttagaaggtttggagcaatcgcaatttatcatcatattattacccgtttcaattgatgactggctaatatataagtgttccatcacaaattatttttggttcctcaattacagcttattctttttttcgaggagaagggaatatattactcaactaaagagtcctcacaaacaaaatgtgagatgaaattacatttatcatccggtcaaaactcagtaagagattcacaccgggctctgttagctagagtatggctaacattattctgattttgctgaatcttcgcgatgatcacttccatgtttcctgataacagttcttctatgtccctgacaatgaatgcaagttcagagcgccctttcatcgcagattagatgaggttcttctccaccaaacaatcagtctccactataattggaaggagtgtccactgaagaaccaagttaataccttccctataggcaaggagttctgcctccaacggactgctgcaccggtcaagaaaaccacaagcaaaaaaaaaaaaattaccatccccatactgttctttgactactgaatcgagatccatatattatttgtttcatgctggacatgtggactcgagaatattatctccgggatcagatcagataataattttgtgcattttgccttatcgtgacttatatcttggacgtgcgtgctgtaaattgttaaactactacgagtcatggtgtttttttaagggtttgctgccagcttccacagatgatacggatcggatgctattaatatgttggaaactactaccgccgggcgcccgattgggggtgggaaaaaaactattttttctcttaaattatttatccaaatcatgatccgattgcaccattaaatttgttgcaattaaatatttaaaacaagactacacatggatatattccgatgaaaaaattagcttattattgaaatatttttaaatattgcacgttgttccaccaagtagatcagaattgtttcactgagtagatcgaaaatgtttcaatcgtttaaatcgagcgttgtttcaccttatataaaaataatatttcagcaaatagcgaaagaatgttttaagtccctgcaatatttgatccatacatagtgaaacattataagtacactaggtgaaacattttttgtggaacaaaaaataaaacgaattcccttaatagagggtttccataatatgtgggtgatttgttgcaaaagaatgttttaattcactgcagtattagatctatatatatatagtgaaaaattatgattacactaggtgaaactttttggtggaaaaaaaatgaaacgaattcccttaatagagggtttttaaaatatgtgggtgatttattaccctcctcccatccattccaaccgagcgaccgattgctgatggtccttatcgatcagtctcgaccgtcaatattactaaaattggagagaactggtgatgcctgca

SEQ ID NO: 68506 - DNA, 1283 bp, Oryza sativa
tggtataggtcgtgtttagttctttggccaaaatttttttgagtgtatggacacacatttaaagtattaaacgtagactaataaaaaacacattactgattctgcctgtaaactgcaagacgaatttattaagcctaattaattcgtcgttagcaaatgtttactgtagcatcacattcttaaatcatggcgcaattaggcttgaaagattcatctcgcaatttacatgcaaattgtacaattggttttttttgtccacatttaatgatccatgcacatgtgtccaaacatttgatgtaacatttttgtaacacccgtatttctgttgcttttatttaaaaagttgtcatttacaaatttggagttaaatttggttcttaattgatttttgtgccaaaatggatctcaaatcctctcctagaaattcccttcaatttctgtgaaaccctagtccaaattcaaattcaaatcctttcaaaatctcctcaaaattcaactctacaaatctctggaaaaaggtgaaagttcactgttcaactgggccgccctcccctttcttttttctcggcccaactcccctccatcctctcctctgttcttctccccttagcaggccggcccagcccagcccgcaactcctcaccttcttcctccttgagccagcctcatccacgcacacaaggtgttcgacagaatgccgacccaagacgccgcaccgttttcgtgtcgtggcagcgccgcgtcgcactcccgtgcaccgcgtgtcgtgccaagaccacctccgcaccaagccgaggccgcgccacaccaaaatcgcgtcgcgccaagccgtcctcgccccggtttctgttgacggtcattatcgatcagtttcgaccgtcaatattactaaaacaggagagaactagtgatgcttgcaatgcataaatatgttagaatagtaatattctactagtattaggtcttctaaccttttgcagagaatgacaataaagtggaggagaatcgacatcaacaccaacgataaaacaatcggacgatgtcgagaaccagacttatatatgaatgggccaagaagtcagaattgacacgatgaattgggctaaaattcacaagtctgcggagtggagcaatagaggacgtcgccagccgaagatgggctggtttgggccagcccatggttcggccgaaccagggggttcggccaaacccccatctccaccgttgaggccagggtttggcatggacgtccaagattgcaccccaatgacggttggagggta

SEQ ID NO: 68507 - DNA, 5669 bp, Oryza sativa
acacgcatgcaggcaccacaccaacatgatcaaatccaatttcccaatctccattcttgattgggagtaagcagtccactccaacagacacaattttatacattcacacacagtgcttcgttgttttatatacatatagttgcaaatatcccagtttcttccacactattgcttgtcaaccccagtagtgctaccaatggcgtcggctttgttcctttggctttcatggcttgtgctctccctcctctccatctacctcctcgatctcctcgcacactcccgccgccgcctcccgccgggaccccgccctctcccgctcatcggcagcctccacctgctcggcgaccagccacaccgctcgctcgccggcctcgccaagacgtacggcccgctcatgtcgctccgcctgggcgcggtcaccacggtggtcgtctcctcgccggacgtcgcccgcgagttcctgcagaagcacgacgccgtcttcgccacccggtccgcccccgacgccgccggtgaccacacaaggaactccgtcccgtggcttcccccggggccgcggtggcgcgagctccgcaagatcatggcgacggagctgttagcgacgcaccggctcgatgcgctccacgagctccggcaggagaaggtgtcggagctggtggaccacgtcgcgaggctggcgcgcgacggcgcggcggtggacgtcggccgcgtggcgttcaccaccagcctgaacctcctctcgcgcaccatcttctcgcgcgacctgaccagcctcgacgaccgtggcgcgtccaaggagttccagcaggtggtcacggacatcatgggggcggccggaagccccaacctgtcggacttcttcccggcgctcgccgccgccgacctgcagggctggcgccggcggctggccgggctgttcgagcggctgcaccgggtgttcgacgcagagatcgagcatcgcaggcgtgtcgccggagaggagcatgggaaggtgaaggacgactttctgagggtgctcctgaggctcgccgcccgcgacgacgacacggcggggctcgacgacgacacgctccggtcagttttcacggtaaggacatgctccctctgaccaaaatataaaaacctcgattttctagtgaatctgaataatctatccaaaataatggtaaatgtcttgtagaattttaggttcttatattttaccacgaagagagggttcagctttttcacatgctgaaacgtctagcgagttccattgtagctactgtaggtaaacagaaacagcaatagttaaattaggtttgctgtcaatgtcgcatacttccgttttttaacccatattgttgttaacttatcgttgttgaatttagttccacgtcggtaattgataatgggatagcacaacttaaaaagtgagggcagtaattatccaagactagtctcactagtactagagaaacaattttcctgaatgagctatttagtttacagacgaacccttaagaagcctgtaggtgaaaatcgcatgccaaaataaaccgattttcttatttttgcatgcgggcattgttggcctcttaaaaatatacttacaagtcaatccttcatcctcttttccctcctctacacttcaaaattcaaaatttcatcctctttttcctcctcaacacttcaaaattcaaaatttcaccttgcgggcctcttgaaaacatgcctacaagtctatccttcctccacttatccctcctcgacacctcaaaattttatctcatccacccatccacgtcattatcctttctatcctctctctcactctctatcctcttccactctctcacctctctctcccgcggccggcgtgggcgcggccagcggcaccgcgcggcttggcggcgtccttagcggcagcgaccgagagcggtgagctcggcagcgtgtgcgcgccgctgcggacgaccgcccctcacctgaatccagtagaggccgctgccccacgccccgatctggcggcgacggtcgtcccccgcccggatccgaaggcggtggcggcctcagcggcatgcgcgcggcggcgaccgagagcggcgggttcagcggcgcgtgcgcgcagcggcggcggtggtggcgggcgggcaggctcggacggtggggaggcaccggatccggctaccgcgacggcgacggcgacgatgacgatgacggagaccgcgatggcgacgacgacggcgaccgtgaggagggttttctttttttggatattttttttggttttttatttttgcgtgcgggcgacataaccaccccgcacgcgaaaatcgcgtgcgggtgcgccacccacacgtaaaaatagtgattttaaagacacttggttccagacagttggaagatccgcacgcgaaaatcacttttgaccgcacagaagaatcatttctctactagtgtgtttagggctgtataggtccaggacctaaagttgtgactccggttggtcctatggtagatcaggcccaatgtgacctggatggcccacggttggtgggccaggctacgcactctaataagtggtatcatagctcaggtttggaatccgcaatgatttctatgggtcacatgggttgatgtgacggaaaagattgttgacaaaagtatgatatttacacaaatatcagatggctacctcctcgtgtgcaaagtagagttttcacaaagtttggaatccgcaatgatttctatgggtcacatgggttgattgacggaagagattattgacaaaagtatgatatttacacaaatatcggacggctacctcctcatgtgcaaagtagagctttcacacgattattacgcgggtaatgctgcaggtggcttatctattctattttcctttctcttctctctcttttaaccactttttaaaaaaaaattagacaatttttccttctaaattaattatacgattcatgattcaatttcatcattacgttcgtcataactaaatctttataaattgattctgcttgattatatttatgagaaaatatataatatgattacagatctaatttaaacatttttatattatacacgaaacaatgagatgtaaatgttggaatattagaaaatactcaatgaaacattcaaagtacaatacgtgcaatatttctgaataaataagtaaaacattagaaaataatgaaacatccgatgacactacatgcaccattaacaaataaactattgaaacatcacaaaataattattgaaacattaaaaaacacacccggtgtgacatttaaaatagatccattataacacaaaacttaaaagatgcagcatagtcaaattctaattgtaacatttatttctcacacgtcaaacttttgttggagaaaagaacggtacaggtacaactgcactgaacccgtcccccaatttcttcttgtaaatacatatagttgcaaatatcccagtttcttccccagtactgcaatggcggctttgtttctttggctttcatggcttgtgctctctccctcctctccgtctacctcctcgacctcctcgcacaatcccgccgccgcctcccgccgggaccccaccctctcccgctcatcggcagcctccacttgctcggcgaccagccacaccgctcgctcgccggcctcgccaagacgtatggcccgctcatgtcgctccgcctgggcgcggtcaccacggtggtcgtctcctcgccggacgtcgcacgcgagttcctgcagaagcacgacgccgtcttcgccacccggtccgcccccgacgcctccggtgaccacgccaggaactccgtcgccttgctgcccaactcgccgcggtggcgcgagctccgcaagatcatggcgacggagctgttctcaacgagccggctcgacgcgctccatgagctccggcaggagaaggtggtggagctggtggaccacgtcgcgcggctggcgcgcgagggcgcggcggtggacgtcggccgcgtggcgttcaccacgagcctgaacctcctctcccacaccatcttctcacgcgacctgaccagcctcgacgaccatggcgcgtccaaggagttccagcaggtggtcacggacatcatgggggcagccggaagccccaacctatcggacttcttcccggcgctcgccgccgccgacctgcagggctggcgccggcggctggccgggctgttcgagcggctgcgccgggtgttcgacgcagagatcgaacatcgcaggcgtgtcgtcggaaaggagcatgggaaggtgaaggacgactttctgagggtgctcctgaggctcgccgcgcgcgatgacgacacggcaggcctccacgacgacgcgctccagtcaattttcacggtaaggacatactccctccgtcccataaaaccccattcctaccatctgtggcgaatccaggcctatttcgtggagtcgactgacccacaactttttaaaaaacatcgtataaactttgattttcatgtataaattcaaaagaatttagagaaatgaccccacttaaatacgaatcattagtaattaacccagaagcttaaatttttagctccgccactacctaccatctcaagaagagattagtgaagagtaaaaaattaaccaaaatacgtctcattattgaaaaaagtagtaatgttgatggtagataaagggtatttaagggagaaaatttctcgtcttatgtgccgaggttagatagaatattagaagttggtttttttgaataaaattcaaatttcagaagttgagttattttaatggaggaagtacatggtatttcctctgtccaaaatataaaagcctcgatttttttagtgaatctaaataatctatcgaaattaatggtaaatgtctcatcgaattttatgacgaagagggtgttcagctttttatgtgctgaaacgtctggcgagttccattatagctagtgtaggcaaccacaaacagcaatagttaaattaggtttgctgtcgatgtcgcatactccgttcggttttattttaattgacattttggacaatgatacggtctacaaagataatatatctttgaccttatttttctattataatatatacaataaataaatgcatgtataattttattatagtgttttgaaagacaaatctatatatgttgttctagtttttttaaacaaaatatttttaaagttattgatggtcaaagttataaaagtttgacctcaaccttgtccaaagcgtcaattattatagaatcggagggaatactcgttccttttttagccgatactgttgttaacttattattgggtttagtcccgcatcgataattaatgatgatgaagcataacataaaagatagggggtagtccttacctatcagatagtcttttgggctgtgtaggtccagaacttaaagttatggctttgattgggtctgtggtggaacaggacgatcatacatcaccagtccttaactttttcaaatcgttcaatttacatcccttagttcaacatcttagttctaagaaatacgcatgtagctcggaaatcttaattcgttatctcttcaatattatagactataggagatagcttagagcttaaacacaatcatttatacaaagcatataatgggcctgttcgg

SEQ ID NO: 68508 - DNA, 1232 bp, Oryza sativa
ttagctcttctttgatgattccctgcatcatgcctctattccggtatgacttgctgagtacagtgggtagtactcagtcttgctctaattttcccaaccccagagcacgagtatgtgtcagacgaaggtttctccgaggagtaggcttcgtccgtgccgtcgaggatgcctgtggagtggtgttcccgctgcagttctagtcaaggcttagcttctgttgtctttctttctttccgctgcatttatgtaagacttttatgatgtttgtaagacgtggatctgaatgtcaacattgtcgtctgtgtaccccggccggtcctggacggggattttaatgcacattctgcttggaattctattcgggaatttctgggcgtggcaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttgtcaaaaacaagtcagtccagggttttagtaaaactgttgagatttattcgtcagtcagttgggatttgatgggtgaaatgcattaggtcctagctcaagaacatgggtagcaaggtatttatgctcttattgttattattagtatgtatctaatttccccattattttatcgttatgtgagtctgtcttatttattcgctctcatgcaaaatgatctatgcataaaatttcgctcttattcgattcgcttatttgagtcttttattgctttatttaaatttggatttgagcatgcattgatcctactcctttgtcttctctagatggccggccactcacccaaccaccgtggagaaggcatgatcgactttgtggcagagttggcacgtatgacactggtggtgggctaccccaacgcgccagagtacacgacggttccaccgctcagtggcgagcttcctcaccgtgttcgcttggaggtccacggctacgtgggtacctgcctagctaatatggtggttgaggcatctggaggcacagcagatcacgcctgtcaggaggcagcatacctgatgatggccagactacgggagcgccacaactacatcttccacgacacggcgtaccgatttcaccctcgtcgagccagtggtgatgatgtcagtacctttcgtccg

SEQ ID NO: 68509 - DNA, 2730 bp, Oryza sativa
cttccgtatgtctccttcaaatagaaacccctataatcgcagctactgggatgagggcctgtttagatttcttggcaaaattttacaccctatcacatcgaatgtttggacacatgcatggagtattaaatataaatgaaaaaaaaaactaattacacatattgcgtgtaaattgcgagacgaatcttttaagcctaattacgtcatgatttgacaatgtggtggtacagtaaatatttgctaatgacggattaattaggcttaataaatttgtctcgcggtttataggcggattctgcaattagttttgttattagactatgtttaatacttcaaatatatgtccgtacattcaatgttacaagctaaaactttagcagcatatgccatgctagccttcgtactactactttgtaaggaatttttttttcagattagagtttctatctagactctattttgggcctgttcactttgatgccattttcaaccttaccaaattttagtaaagttaccaaaaatatggctacatttaatttgctgccaaattttgttaactatataagaaatccttaccaggttttttttagcatcaaatttaacaggcgcttggatactgaaagattggaattcagttttctaccctttgcgaatttgcgaatcagaacagcaaaaacctaagcaaaccctagctccggcgatgcctcccgctgccgccgcggaggcggagatctccccgccgcccccggcggccgacgggggggccatagcggatacggcggaggctggtgtcgcggctgagaaggagagtgacgggatgaaggtggaggatcgcggcgaggtggtctcccaggaggccacggcggtgaagccggatgaggcggaggagcccgaggaggatcctgaggaagtcggcgagggggccgaggaggcgccggcggcgggtcctggagacgtcgcggccgccgcggctgagtcggggcccgtcgcgatggaggccggtgatggggagccggcgctggaggtggccattactgcccatgagccggtggaagaggagcccaaggatgtaatggagacgggcgaggaagcaatagagccggaggaggatgaggaaccagaagaggcagaggtagaggaggatgaggaaccagaagagttggagatggaggaggaggaacctgaagatgcagattcagaggagtcgatggaggaggaggcaggctcagaggtctctgaagaagaagctgcggcggatggtacgtagaacctatgcattttgattgtgtagtttcttaatttcttagtgcaatggtaacttctatttggtagaatcggcaaagacagggagaggcagagggaggcctggcctcccctaaccgaataatatttgtcgagtagctgctaagcactcttgtaatttatatatggtgtctaattgctgcgtgttagactttacatgccaatatgctagtctgcaaaaagcattgaggcctggcctcccaaccgaataatatctgtcgagtacctgctaagcactcctataattatatatggtgattaattgctgcgcgttagattttacatgccaatatgctagtctgcaacaaacaatccatccctaaaaaaagaaaaaaacaatgaaagaatcttaaagcggaattgctaggcctcttggctgttactaagtaattcattatctgataaaaaagcaaaagcatgaacttagcctctaatatccatttatttgtaaccacagatttacctcgccactataatttcgattcctaaaatcttagcatgttatatactccatcggtctcaaaataagttatttctggagttcaaaatttgtcccaaaatatgctgatttctatccatatttttatactgggtccacaaatagggcatttctatctattcaataccatttacctacctaccgtattaattctcttcatactaatttgaatcccgattgataggaatcaatttattatgagaccaagggagtacatcttgtgttccgccggtgataaatggtagacgaaaaatactatattgtccaaatatagatatgttgatatgatttgttatccatggaaaatgattgaaatttccatgtattgtcatgctaaatttctactatcatcgtcagtcggtatgtaaggaatgttgccccctgcatgtttaaatcctggctctgccactgactcgtagttggaactgataaggttgaggggctattcagttgaatgaacaagattttgatgcgtactgcatgaatattcggatacttgttggatggtaccaactagtctttacttttaaaattacagatttatttgcttattgagagggaacagttgagtcaaaagggctgtaatgctgtatggtgtgaaaacagctgcttgctaatttatctttgcccaatatcaacattttgtcagcctgttacacaaggttggtttccggccaaaacctcaagtgttatctgaaaccatatcttatgatggctaaacccttcagttttgttttatttgttcagtaataccacatgttagaatctaatttgaggtgcaaatagtagcaggggtctctactgactatatttttttatagatattaaaatctctttaactaatttcaaagattattatgctgagatgagcattatgtacgagaatatttctatttcattgtttcttgtgccctaccttctatgtccaa

SEQ ID NO: 68510 - DNA, 1564 bp, Oryza sativa
tgctatatgccatgatgcttttatttgatttaaagaaactttgttttgatatgtgatggatattttttcttacttgcatttgtttccatgatgcagggacagtatagcgatattggaaccaaggactatacatctaaattatcagtgtactgaggttcatgatagtgctctgctgaagaatgtggagattattgcaaaaagactcactaatgcatccgtgatttaaggtacttctggtagcattggagtctataaaatttccctacacatctttgatttaaaatattttgctttatgcatgtgtatagaattggagcctttctcaacaataatataagcttatgaacatgaaattctgaaagatcatcaagatatatctttcttaatctaaagagttatgatgatcaggtcaatttttttttcagaattaagtttagttgcatggctaaattggaacctattgtacttgctatgccccgttgtaatgctttggaatttttaagagctccatactgatgtctgctgatctggattggtataagtgttggctatgacattgttttcaggcaattggcaatgtcgtgctgcattgtgaaccttcttcttatcaccctttgatgggttggaggtatagaatcgagatgattgccaaaaatattccggtaattactgccaataaataagaataaaagcagagcggacataaggtaaaaagaaagcagaaagacattcatctagtcgtgttgtatttacttggtttttagagcatgataaacattaaggttcttagagcatgataaaaaattgcaataattaaacgatggttcatctgtctgcacagttaatgtttttctgcataaaattgctcttgctgcaattaccaatactttttctttcttctagtaatatataaagccacttaaaaaagagattttcatgtttgggtttgcaactcctagattttgtggtggtatgttatgaaaatagccgctgagcaactgaaatgaaaatatgcctgttgctaacttgctatatgtttctgcatggacagaaaaaagaccttgggtagttttattcaatattaatcttataaatctaatgaaattgaaattgcattcagggttgagttcattgataacctggaatcgacattaattggaggtggcttgacatcctagaggaagaagagccttgtgatctatatcttcttgtgcgcttctattatttgtattgcctgtaatcatatttgtgtattttgtcctgcgagaaaaatctataaaatcacgttagtgggagtgctagctaaatatagcggaaacaaaagcgggatagaatctgactcgggatagaatcgggatagaatctaactcctgacttgggctgcgcaaacaggagcaggaaaaggtgtgggcgaaccaacctgactcgtatgcgatattgttttcttgcgtgaacctggtaaacctggactctgtttttttgtatgtatattttgtgtgtgaactggactcctgtgttttttgtgcgtgaacctggactactgtgtttctgtgcgtgaacatgg

SEQ ID NO: 68511 - DNA, 1977 bp, Oryza sativa
ttaattgtcataaacaactcagaatcatgtagatttcggacttggacatgaatgtctccgtctattttgtctttagaatgaaaaacattacttcctccatttcaaattacttgttttaactctatcctaagccaattttcttttattttgcttatctttcttatctgtggtatttatttgctaggcttttgtaatgctatcctggactcttagatttgaaggtacctcctcaggctgaactgtggagatcatgggtaccacatatccactcagcctacgtatccaattggaaataggaggtgggttggacccatagcattatgtaatggtcttgggcttgagaataatgttggcttgtatcatgcggcatagcccataggttttgttaggttatcatataatagattagaaaactgatgccgtgttcaaataggtttcttctctgtaaatctaccccgaacctatacaagtgagcaaggagctctccgaggacataaccataactcgatcgccaaatcaatacaacatccggcggatacaatcctcaaataggagtagggtattacctcattgagagtgcctgaacatgtctaaatccttatcttctttattcatccacttttagatctcgtgcgctgctcccttttgttattgccgatctctatttccaatttttcttttcttaaaatcatgtggataaggtttaaatgggcctttaagaacatatgctctccgaactgcatcttgatcattgacaagataacttacaatgggtagtctttcctcttgatcatgtggaaggctgtcaatgtcataaaccggcggcggtggtggtgagacatcttctcaacgtcttgttcctgagtgtgctcctataccacaactggggaagaaggcaatttagaactatttttctttgctgcatgtttcaacaattagcgatctacaatatagcggagagtggactcgtagtctcgtcacgctagccactcggcttcgcgagcggtggccggtgataggcgggtggcggcggcagccggcgctcgtggagtcgcagtcctccgtcctctgctcctctccacatggacttgctgttgcaaatgcgggtggcaggaggcagcgcgaaaaacgagtagtcaagtgaggagaggacgcgtagcaatcgtgtgatgctgcgcgcgacgtttcggtttccaattccaggttcatgcgctttttttctattattttttctatatatagttgggtcggttgccttattttttgtgtggtcccaccgggaccaccccacagattggtaaacctaggccgtctgttacaccactgcccagaggtggattaggccgaacgcacggcgttcccaagggctatgagcggatggcagcctagaaatccctaggggggggggacatagtggatcctgcccgctgacaggattagctagcatctgatctactcaacaatgtggtagtagcacagcaactagggcttagaccatcatgggtgtttgcacggttctcttggttttgtccctctatcatactatataaagggccgagggttccccatgaaggggttgaaaacatttgaagacagactctcgagttatgtaggaaaaatgatttgggtttgtatatccctagtttattcaatccaaaaaaaggaaatgtaggagtaggattgttatcctcagggaggcccgaaactgggtagaaacttgtgagttttgcatgatctagaggagagcaagcaaatcaaagcctcaaacccactccaccaaacactggtttcactagattttgtactgtcaggcacagttcgtcgacactgttgctgcactaattgtatcaagttgggaagaagttgtactcgtaatatgatttctgttggatgcaggtcagtgaacctttcgacctgcctgccgaagcaccaaggaaccagagaaccagcatggagcagagcaaagagaggataagc

SEQ ID NO: 68512 - DNA, 3382 bp, Oryza sativa
aatcctgccctccatcctatataaggtgggcaggaggccctctagggggcatgagcacatatgatcgtcagatctatactacacctggcggattcaaatccctaaacaggagtagggtattacttctcatcgagagggcctgaacctgtctaaatcctttgtctccgcatccatccacttttaggtctcgtgtgctaccccttttattattgctgaattcatgtttcaacaatcgatatcatatttttcttttaatcgccgaatatccgaaacattaccagtcttaaccaatgtcgcagtcatgagtgatacatattattttattcggtacatgattctagtgaccactctgtcgattatgagatgaggggtgattgtgcggaaaactaagttaattgactatctcagtgatctagattaacagctggacaatcacaagctaaatatataaaaaaaaggtatgctgtaggattggatcgatcaatatcgagttatatactccctcctttcctaaatgtttaacgccattgactttttaaacatgtttgactgttcgtcttattcaaaaacttttgtgaaatgtgtaaaactatatgtatacgtaaaagtatacttaacaataaatcaaatgataggaaaagaattaataattacctaaattttttgaataagatgaacggtcaaatattttttaaaaagtcaacggcgtcaaatattttgagatggagggagtattaagatatgtaaactccacagcactagttgattctcctgaaactcattaatttgaaagggaagattaagctcaatgcaggagtgcagtgattgtgcagaaaaaataatttaacaaccccaagccagctatgtttggactacaatgatagctcgacgatcgcaagctgcatatgaaaatacgaattaatgctgaaatatttgggtacggtatcgcattctaaactagtttgctctacaatattatatgttagtatttattaattacatactctaatctatagtctatcgtgaaaataagatactatatatattgaacatggcagggatatttttcctgttatctaaaaataataacgcgcgatgcaatggaattaatcatgatagcagccaggtacgtagcagctccttctaatataataaagctcgtgtaaagattttgctcatttgatactttgcacgatgttagaggacatgaagtggaaaaagggtccttgatccagaccacagtagctgtggattgaatggcagacccaactttaattgtaaatttagagtttggaagatatgtcttttatagttctcttaatgtatgattttgttcatggccatgtgatcagggtgttactacatatattatggtattgagttatatatatatattatatgtggtctatagaagaaaaatatttctatttcatttcattaaacccacggaacatgtgacgattttttgagaatttctctaagccatttactaatgcagatagagttcgtggctacctagtgctaggtagctgatatgcttagtataaaaacacagagacagcagcaagaggctccatccatagacgcatcacataatcttctatctctctcaggctaactaatttcataagcacacatcttccatttccatcaccatgcctggagcagctaccaccgccgccgttgttgacagccgccgtagcgcacagcgcgcggaaggccccgccaccatcatcgccatcggcactgcaaacccagctaatattgttcctcaggataactttgccgactactacttcggcctaaccaagagcgagcatcttactgaacttaaggacaagatgaagaggatatgtaagaagatcgttcaatctacttatcatatgactattattaattattttccatttacttcaatcagaaacaagttatgcaagctcttacatttctagcaatatcatgccatggttcctaaaccacacatatatttattctatgttgaaaagaatgtaggctctacgtgtcctatatagaggttagatatatatgccgcactatctagtaatcagaaatgaagagtatgataatactcgactttagacacgcttcataagtgtttttgccattttgcaatctaagtgataaatgcaggtaaaaaccaaattaatggtctttgtcacgttaaaaatcaggcacgcacaccacaagcacttacctatgagtgaggagttcccacttttaattagatctcaacagagggagtcacaacaataatctctgggtcttactaaatttttattgaaatctcactaaattgtttattattgctggccgggactaggatttaaatactacatcatgagaccattggtacttcaacaaaaccatgtgccaagtcaatctttccaaattttaaacatgtacagcttcctaaatatttggagaatacatacgaaaacaaattgcgtgattttgttctggaaagagcattataacatatattttagttttgtaattatttgcaacagagatataaatctgcaatgatatgttctatatattttttctatcctcaagactactaggtacaacctaattaatagaggcattggttcttccttttaattataggtaaaaaatcaggcatagagaagcgatacatccaccttgatgaggagatcatccgtgcccatccagagatcattgacaaacaccagccctcccttgaagctcgtgttgaaatcgccgccgccgaggtcccaaagctcgccgagtctgctgcaaggaaggccattgccaagtggggccgtccagccaccgacattacccacctcatcttcagcacctactctggatgtcgtgcccctagcgctgacctccagctggcatcgctccttggcctccgtccttctgtctcccgcacaatcctcagcctccacggctgctctggcggtggcagggcgctccaactcgccaaggagcttgctgagaacaaccgtggtgcacgcgtccttgtagcactctcagagctaaccctggtatgtttctccaccccagacgaaagcaaaattgtcggacatggactgtttggggatggtgccggtgcaataatcgttggcgcaggcccgttttctgatggcgagtgcccgttgttcgagatggttgctgcctcacagaccatgataccaggaaccgagcacgcacttggcatgcaggccactagcaccggcatagatttccacctctctgtccaggtgccaatgctgatcaaggataacatccagcagagcttgctcgaatccttccaatcggtcggatacacagatcctgactggaacaatctcttctgggcggtgcaccccggcggccgtgctatccttga

SEQ ID NO: 68513 - DNA, 1689 bp, Oryza sativa
atatatacttaaactaagtaattgggatagatcggtcgccatgccgagacaatataaatcacttaaatcgaaatatatattaaaacatgaattatatagaagtttatagcatagccgatcaaatagacctagcatgtatcggctaatactccgataccactctatatcaagatatcgagacaagcaagatatatcaaataataaacctaatataactttaacgcaacgagatcttaatataaagggcatatttaacatatcagtcaagtgcatgaggataaaatagctaaatcaggtaagatcggctggaactccgatacatctctattgatgatcataaaccaggctagatatcacaattatagatagaacttaatagatcgaactcaaccgatgtagcattaagcataaagataactgtaagatctaaacaagatgatgaaaacctcttagagatggtagatatacgatataatctagattaataacgagatctaactctatcggctactttctaacagtaaaaaccagccgatggcaagttatatagcgaaactaacagagattataaagtatatatgataactcgatgaattacataaacaagattagagtatcataaagatggaagcactaatcccgagaacacaaaccgccatgacaagtttacctctagttgaagatcgaatcgatgcagcttaaccagaaagcaagaactcgccgaaatagaatgaaagtaaaagggtggcgatgcgcggaaagttttgttgaacgtgtgttgtttgattacatgggttcgagtcatatttatacctgagattacaaaatatgtccttgccggatacgactcttatttttaacaaactctaagataacataagtctttgcggcagacttttgcccgaacatatctctaaggaatttacataagatatcctaattaatagatacaattgcctatctgagagctttatctccatcgtggcaatccttgtgaagcacatcgatcgattctagaaacagactcagccatcggaatcggctgtaccagctgtatcattcatcctctgaccgatctaactcagtcgatgcatactcggttcttcgaatctatctctttgccaaatccgattcgattccaacgtcgaacctggttcatatcttaccaaatttgagctttatctcaatcgtggcaatccttgtgaagcacgtcgatcgattctagaaacagactcggagctatctccatcggaatcggctgtaccggctgtatcatccatcctctatcggctgtaccggctgtatcatccatcctctgaccgatccaactcagccgatgcatactctgttctttgaatctatctctttgccaaatccgcttcgattccaatgtcgaacctgattcatatcttaccaaatttggtcgttaacagttacagatgacacacatctcaatcgggccaacataaaagcccgtcacggatgactctcatgtaacgtctcacccctccactttgtcctaactcatgtggaaccaggatgaattttccggttagtgactcatcccaaaattgctccaggccaagcacgcttaacctcaatgttcttgggagttcgacttccggataataagttgtaacttattggtatgagtattctattaattctattaagccctgggccaggatg

SEQ ID NO: 68514 - DNA, 2103 bp, Oryza sativa
gctccgatccccatatcgcgagtcgcaagcagagcatgggagcggaggggaggggcgccgtcgtcccgctgcacaccggcccattcctcgcgctgtcctctcttggcccctccgtccgcgacgccgccccctccgcggccgggaagacgtcgccaccaccacctccatccgcgacgacgccacaacctccgtccgcaccgaccccacgctgcgcacgccgccgatccttcgtccacgcgctgccgccgccgctgtcgctgcctccaccgccgtccgcgtcgaccccacgctacccatgctggcggcctgctgccccacatcgtgttaacaccgggatcaggtttctggccatcgtctccacgcagatatgggagttgtgaatttccctcttttatctttcttggtttttctgctctcagttctaataggcctacagattgtctgaatccatttgaacaaggttctgcacaaatcttctgatagaattctgattttcacaaaattaatcgtggtggtattttacgcatgtggcaatttaattaccaaaataataactatttctatcagtctttatgtttaggtaacctgcccaagtaaattgtattaactgattgatgtttgttgttcctggtgatgattctcttctgtttcatgtggtctgcagtgcatggacagtgtttacaaggtagccctatactcctatattcatcacaacatagtagatagtacaaacgaggtgcgtatccatttgctttaattcacatagaaaactccctacaattgaaattcactaataaggtgcatattttgttctcagccacatcaccgtctgtttccgccatggcagcgtgactccgcccgacggctggaggaggcgaggtcaggcctgccctcaatcgacgctccacgccaccgcagcccgcagccccatcggcgccatcgctgcgtcgctccatcgccatcccgacctcgaagttgaaccggcttcgagtccctcgtgctgccactgatcccagggctcctcaaccctgcaagccatcgatcctgcctgcgaacaagataagagtgcttctcgatcccgttcctgtacgaggaggcatacggggcatggtatgtttcatccatagagatgcataatgcctttatctcctttgttgactaaatccccattgttcattattaaacattgttcattgtgcatggatatttgtgatgcaaaactctactccaaaatctgaagtccttagtggtttactgtacctgacaagcaaacatctcaaacatgtttgtaaaatcctctcgaaagtagagtaccacgttcctcaaccctgttcaccgagataagtattgtttaatgatgctaatgtatggtatgttaagctgatatttgatgctactgaaatatgtaacatatggacatgaatgttcacttcttttttatgtaaaatgtatattacctcattaatatgagtgctttcaaacctgacaccatcttaattggaatatttgattatgagaaaacccttataatttatctccactgttcttgagagttagaaaaatctttcaatacattttagtagttttagatgctaaaaattccagaagttgaaggcttatccatgcagttttagatttggttggatggaatttggattcattgaacattcttaaactatggctcttttaccatcaaaactttacattttccatatcgtcttcgactgcttgtagacaaacaactacagaagaatatctcatgctttttatgaaaccagctaatgcgacagtgtcgaggggggtcttggccggatccgttgctcatggccggtaggagtgaggagtacacaggcttccacactacgaggtaatctgcgtgcatgattcatgtgtctgttggtttctctatctaaatgatagttcattttggtatacctccatcattccaggaaacttcaatgctcgagttgtcgagctaggttggggatatttgattctttaatctgtatagggtttggtagcgtgcactcagcccttaggacttaacatgacagtaagtgagaaaaagggaaaacagtgagtttttgcatcaggctggctcaa

SEQ ID NO: 68515 - DNA, 984 bp, Oryza sativa
tggatccctttttgaacgagagccataatttactcttcttttgctttatctttattatcttatctgaggtatttatttgcttgggtttttatgatgccatcttgggcgattcgaccgcaggacgaggtactcctccttccttcctcacaaagtcacaattgtttccgatccaaagtttgagtttcggttgattgaaagacgatgagcctcccgcggcggtttctgaatctgatcgtggagaacggggcggatcctggcatcagatcacttagctgcatcgacttgacacgctacccactctttcacccaccgttaccaacggcaacaacaatggaagcgtgcagcagcagcagcattatttcgcagcaacaacagactgctgatgccttcaatacgaagaacaaacatgcggatggggcagcgtttatggtgcaggagaagttccagcttcccgacccaatcttcagcttcaaagctcaagcggctgatcctgattacgggtggaatatcgactgcttcccgcttgcagatcgcaaggttgtctgcgtggaccagtctggccgcgcattcctcttcgacgccgacacagaccaggtggtgacaatgccaagcctcaacaaacccaagtggaggcccttctccctcttcgtccccggcacggacaacgacggcggcgatggtgaaggcaacagtctctacatcatggagaaaagccccaaatcagaggcggggtgtagcgcgcggtgcatcgatcagttcgaggcctttgtctaccgcaagcccacggtgacagcgtcgttcatgtcgtggtactgccagctgctcccgccaccgccatacgtccgcgattacgcctacagccagagacgccatcgaatcacatcctatgccgtggttgccggcgatgacgacggttcgtggcgcatcctcgtatcggctgaggacgcaggaacctactgtctggacgtggccagcaacatgtgg

SEQ ID NO: 68516 - DNA, 6024 bp, Oryza sativa
  unsure (1)..(6024): unsure at all n locations
ccccgtccgtcgacaaatataaggaattttcaaatgataggtgtgatctttaccaaatgagtaaactctttgtgtacaaagtaattcaacctcaatcttaaactctgctaaacaaactaggaccaattatatatgtgaccagatggagtacatagtttatagtcggacatgcgaaccagccacattacaactcagaatatatatgttattgttataactaagcttcttacaaagtatgttcaacgaacacctattttaactcattactataaataacatttaacatgtttcatggagggagattatggttgtgcaaatgcacgacttaaaggccagtttaaactaatttttttaggaccgaaattgaaacagtgaaaaacaatcgactactgtcaaccacgataccgagccagtggagaatctaggatgtaaattgagggagggctcgtgtttaaatatgaaagtgtgattgaaacaaactaagatatatcaattgacgaaaaatcttaaccgagagagctcttggtttagtaccaaggagcgatggtccagttgctaaatgtggtaaaattatcatttcaagccagagtttatgcaactgaaggctaggttggtatggggtttgtgccaacctattattgtcaacgtgcatgtcttttattcttcttataaaattttctgctaacttatttatccgatctataatctgattataccactatgttcgttgcaactaaatttttataaccaaatattacataattgattttattatatatgtaagttacttttatcatgtattaaaattacttttagattttattaaaaaaaatttcagacattcggtgaacaatttacttgattggttagttctatattatgttgattaaatttaattattagtttgacttatgtttttacccccacaataaattaacttttgatgtcgtgacaagttactttcttttattttgagttactattataatatatatgtaagttaccttttttaggatttattaaatttacttttatatgtctaagaaataatttaatgaaatctaaaagtaatttagatatattatgaaaataatttgtaatttttttaaaaaatataatcatgtaagatcttataaagattaaattattatgaacaaaacggtgtaatcggatcgtaaatcggatgagtaatttaagagaatatcctataagaaggaaaagaaaagacatgcactgttggcagctgatgcatacatgcctgctaggatgaatgtgtaatctcgagccaacaagcttggtagaacggtgttgttttagcaaaagaaacgataagcggcagacggcacgccgtactatttttagcaaggaggaggacggcgcatggtactatttgtggcacagaagatgtcactgtattagtcaatcgtgctcaactaagtattttcggatgaaaccccaaatgcatatgatcaattaacatcccattgctttctccattttaattcgcagctatacaaatatatctacacaaatctatcgagaaattagtatggtatacttacatcatatttgacattggcaacttaattttggcattcagtgcttgagctagctttccttgccagtacatatttacgctaaatgctaattaattagagtcattagtcgctaattagaggaagggaatcatgcagatggggcttgcgcaccaacaagccccaacaatagatccaccactgtaccgagctgtgtttttacagtaaaaaaaaactgcaaattttatactattgagtaaatttcacaaaactacatatactttgcacgatctatcacaaaactatagatttaagaacttattttataaaactatagattcaatatcttcgttgtcacaaaactacatgtactttgcagaatatatcacaaaactatatatttaaaaaattgtttaacaaaactacagatttaatatcttcatttctcacagaactataggttttagcattgttaaaccaatagttttgtaataatgaggacactacacctgtagtttggttataaatgaagacactaaatatgtagttatgtgataaacgaatacactaaatctataattttgtgaaacaagttattaaatctgtagttttgtgataaacggagacactaaatatatagttttgtgaaacaagctcttaaatctgtagttctgtgataaattatgcaaaatacctgtagctttgtgaaatttactctatattatactataaaagaaaaaaatcagtcagttaagtggaagttttatttggtttgttgcgaagtaactatcagtgccaaaattattgtaagaataagaatgattagacattaccaaaacaaaataaaagaataggacatggatggcaaactaaacagacctctttgctggctagattcaacggtactacgaaattgatattatcgtaaacacacaccaaacaccgagatatttaagtatttgttactgttacatgtgatatttaactatcgatagttaaatgttacatccgattttaggttgttaaattatgtaacggatggagtggacgttaagattctcgagtgcacgtgttccacgtgaaacagatagatatcgacccctgcactgaacttcaagcaaatttaatgatgaacgaaattaagaaagattgacgacctagcaagaaatttcacaataattatcgagtgcacatgtcccacaataaattattgaattcacagtatctttcttgttcacctatttgagtagtattttctgtctttttaaagagagcattacagatgattggatttgtggatttaaaaaaaatcctaaaaatatcaccttttagcccaacctctcatccttgtctctctccccgccccggatttttttaatatctaattttatttatttaaatattttttacaattttttaaagttttacaaatttactccctaacgctctctcgtaaaataacttttggtttcaaagttttttaaaaacactttatgttgtcatgatacacacccgttggtgtgttgttacagtcacgcgaacattttaatggcggtccccttgcagactatctatataaaatagtgacatacaacattttataagcgggccacttgccgttctctagagccttcctgtaaatggctagcctatgatactttgtaggtggccccttgcaaaatgaccgaccatttccatatggccgttagaatacaccaatgaatatgtaccatgtcataaaaaatcatttggaaggatattaggggtgtagatctgtaaaactttgaaaaaaatattttttaaattttttaataaaataaaattgaaaacaaaaaactcccctttcaatatgctgcagcccatatcttgcccagattcgtagcggcccagcaacaggctagctgacctaacctaactggtccagaccggcagcaaggccgaagtggcccagccaccagtcacgcgcacgctgacttcgccgcagcgcaccgggcgaaaccggcccacgcgatagcgctggtgcgccgcatttgccgccctgaccgaatcgtggaggccgtctcccgtgcgcccgatcgaaaccgtcttgccgctcccgctcccgctcccgctcccgcaccacactcgaccgccgcgaaccagatcgaaccaatcgccgcgccgaccacaccaagttgccactgtggctcacgtcacccgcaccctattgccacgaatccggcgtgctccaataatgggcggcgcgcgactgggggctgtgttccgttggtagggctgggaacggggtgaataattagggtatgattaattaataagtgtagtattaaatatttttaagaaaataaattaatacaatttttttgaaaaaatttaaagcacaaattttatacgatttagtagtttaaaaagcgtgaatgagaaaaacgagatatggaagttagggatcttagtgaaagaactcagccttcagcggaccacaaacatactgccctaaccttcgcctctcgctccacccactcctgcggtcaagcaccttgcgtgcgtgtctcgtcgcaagctcgccatctgcccttcgcgcgagtccaccgccctttcgcccgccatcgcctacctcactattggaaatgtagccttgcaaatgttaatacagaaaaataagatattaaatatgacatgtgaataaaaggatgatctagtgatagttctaaatatgaacatattaataacaggaatagcatcatctactaacatattcaatactaaagtgaatagaacaacatgctcggagaacgctttggatccagataaggcattgttgttgttgcctccgttgttgtggccgttctctcctcctttgccaccgttttctcattcattgccgccattcctggtactggttgacattgccagcagaggaaacaggggaaggcaagaaagccctcccgtcccgtccccgtccccagcttagctcagcgcgcacgcgtgtgtggcagtcctaccaccaccctatcaataggtgctatccatttgtagcttatttaagtctaggtcccttctcattggttttaagatgatattaatcccttaacattaattttggtttcattaaaaatactacaattaaattgggcctatcccatcaaattctaatactcaccacggctcaccgtctgcctttacccggtacactatcacttctcgttcaccttgagctctaagctcttagctagtccgcccggagctggagccagttcatccagcaccttgtgtgcaacgtcattcgttccatcccttcctggttcgagcaagggctaaggatggggatccataatcggcgcgtgtgcgcccccctctaatccactctgttcctatatacgtatataagtatatacacatgtgtgtatatatattagatataatccattatataccactgagtttgtcataggtttacgatttgccactgacttttgcttaacttctacgacttactatcgtcgtccagttagccttcgttagtactgtacaattttgtccaagtgaccaaaatatccctaggataaaaacttccaaaatttggaaaaatttccgaagtatcatattttaaatttttgatcaaattttaggatgctttaacaatgcttaatgaaagcataaatggccaggtttagaaaggaacaaattaggccaacccggaagaacacgncaggtntaagccaggtgcaatgctgcacagagctcctgggccaaaaactgacttcagcaaatatgaatgtagcaaaagaaaacagccaactttctagaaccattttaggaagtaacagggacgcactgctggagaatcgtttttagtcccagtttttcaaccgggattatgaatccgggactaaaaacgtcgcttttaatattgaaataactagaacaaaagtttttttcctttttttttcttttctggcgccaaatatctccaaatcattaaaaaataagaaatcaaaaatcacagattgtgttcacacattacatattgttcacacatcttagcatcccaaatcatccacaacaacaacccaatatctcaacatcccaaatcatccacaacaacaaatcacaaatccattcacacatcattctcaaatcacagatcaaatcaacaaacaattattcacattattcacacaacgagaaggaaaaaagaaaaaaaatccatggagcctgccgccgcgcggccttccgcgccgggccgccgtcgctccgccaccacctagtcgccatcgttccggcatgggcctggccgccgccgccccacccggcacgcgcctagctacggcagctgccgcccctgcccagcacaggcctggccgccgccgcccctcccctgcacgggcccagctgccgccggctgcttctcccgcatatctgaggaacggaagagaggaaaactcagatgtggaagaggaaggggagagggagagatgagagtgaaagagga

SEQ ID NO: 68517 - DNA, 1186 bp, Oryza sativa
ggctgtgcgaccgaacagggcccctaaaatattatgtcctatatataataatattagaggctttaattttgttaatttgcagttcaaatagtagtaaaacaaggtccaaaacgctgcaaaagatgaaccaatccatcttccatcatactcctgtccaggcgtccacgtcgttgcgtattgccgaagtcctgacgccgcaactgcttcgtctcctctccccagtcccctccggcctccgcttctacctcatcgctgatgataggctgatcaccacgcccctttttaattttactataaaaaattactaggctactagggccccattttaatattttgcacacgaacccgatttggcctggacgcccctggctaactcaatcaaccgggcataggcccaggctccctggttcggtgcagggatgtgatacttggctagtatatgtggttcaattatttttatttctttggtgtttagtctctactattcttatctctttaccacattgagaaagtgctggaaaattccggaataccctcttttatccaatggctgagatttattttatctattttgtcacttcatgaatctaacggctaatattaatatgatgatgtggctcatcctaattgtattttaggattcactttacactagtagaaatttgaccaaatctgtaaaaaaaatcattccgaaaattaacagacatgtcagaaattttgataccccggaatataaaacgaaattacgtccatgatggttaattacacatgccaccaccggaaacatccaatcccaatcacaatttcactttcttcaatatggcgtgcaaaacgccgccttattttattgcaaataacatcacagtatcacatccaccaccttcattttatagctgctagaagtctgccagtttccagctcacaccgtacactcactaaaagccgtagcaatggcgacttggattcttggatggttgctatggcttcccgtgtttctcatctccctctacctcgtcgacatccttgcacactcctgccgccgcctcccgcctggaccccgcccacttccgttcatcggcagcctccacctgctcggcgaccagccacaccgctcgctcgccggcctcgccaagaagtacggccctctcatgtcgctccgcctgggtgcagtcaccacggtggtcgt

SEQ ID NO: 68518 - DNA, 1415 bp, Oryza sativa
ggtcggtcggatttagacgaaggtaatgggaggaggaagcctagcgatagctggcagcaataacagggcgatacgacattgatagttctacctcgaccacgtgtggttgagtaggtggatagtgtactggaattagaagaggggatacttgtcggagtgtaggagggggtgacgatgattgatccaatgaaaacccttcaaacaaaggttaggagatatgggtcggaaagtgggtagttgagaagtaggagtatgaagatggctagccagtgggagagcacactagtggggcccaatgagtagatgggtggcggtactcagggtcaggtcgggaagggtgacggtggtgcacatatgtgtgtgtggctgcacatcgtttggatctgtttggagacaggggaggagggtgtatatacgaagttcgaagtgatcgtaatttacaaataaataaggtgcgattgacaaataaccaacccttatttatctttttcaattcctaaaacatcttaaatgttgtgatgtagaagcaggattagttttcattatctgaaggattatgttttgttattaactgtcaccaccgtttcatagtatatctattatgtaggacttgtttgctgctgggagtgacacaagctctagcacaatagaatgggcaatggtggaattgcttaaaaacacattatcaatgggtaaagcctgtgatgagcttgcccaggttgttggatcaagaagaagaattgaagagtctgaaattggtcaattgccatatttgcaagctgtcataaaagagacattgagattacatccaccggttccactgttaccacatcgagctaagatggcgatgcaaataatgggttatacaatacctaatggtacaaaaatattgataaatgtgtgggccataggtagagataaaaacatttggacagaacctgagaagttcatgccagagagattccttgatagaacaattgacttcagaggtggagatttagagctcatcccatttggtgcaggccgtcgaatctgccctggaatgccattagctatttggatggtgcatgtggttcttgcatcactattaattcatttcaaatggagactaccggttgaggtggaaagaaatggaattgatatgacagagaagtttggattgactctagtaaaagctattccgctatgtgctttggccacaccaacttaagtcaacgagccactgtttgagttagaataatggactgctctttgtcaactcaagcattgtatcatgcacggtattattgatgtgaaaataaaaatacatcatcaatgaaatttgtgggtatttactacttcccaatgtttatcaatagtcctgagaaaattacacagcatatatttgtattagaataaaccctcgtggggaaaaa

SEQ ID NO: 68519 - DNA, 787 bp, Oryza sativa
ctaggtttcaaatcataaatcaacatcatcaacttgcaagctaacatcaatcaacatcaatcaacatgtaaacttaaaaaaaacgccgttgtcgtccatccgccggcctccataggtggcgccgtcgtcgtcgtcgcgtcagcgccgtcatcgcagcagtcgtcgtcgtactcgcgtcgtcgccgtcgtcgtcgtcgtcgtcgtcgtcgcgtcgtcgccatcgtcgtcgtcgtcgtcggcgccgtcatcgtcgcgtctcctctcctcgtcgccgccttccctcccctccactcccctcccctccccgagaccggccagcggcgaggagagccggcggcggattcggcgcccgaggaggcgaggaggggggagccgccgccgtcgtcgttcgtcggagccgccgccactcaaggaggcgtcgtcgtcgttcgtcggcgtccggcgcccgaggaggcgaggaggggagccggcggcggatccggcgcccgaggaggcgaggaggggggagccgccggcgccgtcgtcgttcgtcggagccgctgccgctcaaggaggcgtcgtcgtcattcgtcggcgctcgaggaggcgaggagcggagccaccgccgctcgtcggagccgtcgccgctgctgtcctgccctgccgccgccgctcgtcggagctgtcgtcggccgttcacctctgctgcgcgcgagggagatagaggatagggagagaggagagggggaaatgagtggtggggggagggtggatgagaagataaggatggaaaccgtaagagtagata

SEQ ID NO: 68520 - DNA, 4051 bp, Oryza sativa
gggggctgtaagagtagataaggaagaagatttatagaacgatttttctaggcggaccacgtattttttcgcctgtaaaaatataatttttgtaggcggaccacttgtaaaaattgtttttcgagcgccgacgaatgacgacttaagtggtccacctgcaaaaattgattttcgtaggtggatgatgaaaacccaccctggtttatatttttataggcagatatttggcttcgagagtcatacccgcctggaaaaataaaaggctaacatcgctaaaaatcatttttctagtagagcgggaaatgcagcaatcaagaacacaccacacccaaatcaagaactaatgagatggtttaggacgtgtgacggcagcggcgaatcaataactcatccccacccaaccaagaaaaaaagctcattccccatctgatcaagaactcactaatcctcacccaaatcaagcactcaccagatcgagcaggatatgaggaggacgatgacgaattgcggcgacgaagggaaagggagaaaagaagaaaaccctaaccctagctttggaagaggaggagagaagggaaaaggctgcgtgctcactagagagaagatggtggccggaggagagcgccgtgccgtcaccgtcgcctcgcgtcgcgccgctcccgccgttgtgccacctcgaattgcctccgcgtcgtgctgccactgcgcgtgttgcacgtcgcctcccggctcccgtcgtgaggaatttttccacgccacacgagaagctgattttttcccgggcctaggtgagggggaaaggccgggataggccagggtaaaacccatactgggcttaaccgaacacacaatttcggatgggccgagattgtttcctcgccagggtgatccacggggattgggccccgatcccggccgggaatggcccaaccaaacaaggcctaagggaaacctcaaacatgtatatgaggggattgttaagttataattaattgaattagttgtattagctgtgtttccttatcaactttaagcttttgcttgaagcagcccacctataaatctattagaatttataacaaattaaataaaatggttcaattaactatataagctgattacatctaacagacccaaatttgtaaacttagaataaatttaatggacagtgctccggtactcatctgcaatggaatttatttggcttgtttggattttccatgtattcataagtacattagcatgcatataactatgtttgaaaaaatgacaatgcgcatatctctgctatcgtaaacatgacaatgacaatgaacatttgtgacgagttttatagtgatctctatcggacctaaaactgagcctgtcaccaatgacacacattggtgacggggctaaacaaccatcttcatcgggcctaagttagggcccatcacagatgagacctatcagtgacggacctattccatgagccgaaacataagcccgtcatcaataggtctcatcggtgacgggctcgcaatagatgctcatggaatatgtctgtacgggtatatctgtgtcggtatttatttcagcctattaaagatgacgacgttgtgacagtgcgaaagaccaaacacgggataggctgtcacagatatgtagttttgtactagtgaacactctgacatcttcgtatcatctcacatatagcactgtacattgaggtcttgagaatcagttatatgacactataagtaaaaaaatgtatttgatgtatgtgttccaatgcttgtcagattgatcctctcatctttaatttacacctaccaatcttattatgcaactccgaagacaataaattacgttgtgatatggcaataaacttgaacatcgacagcaacattttgtcagggcggctggtgatcaaggagtgccaaagaactactgaagaagaagggctggagactgaagagcataacctgccggatgatgtacaggaagactcagagatggcactggcgctaccgcgacgaacatcaagtattgtgggccgaaatgggccttgtaatagatccaatacagtcttgcattagcttgaacttgcgtgagagagaaggagagttggtgagatttgtaatacaagaacagagtactctgctcgaagaacttgggcttggcaactcggtggcgatggcggcggcagctcaaacctaatggattggagcaatatatgtactaaatagttgcctaaatcatgtgtgtgtgtgtgtttgtgtgtgtgtaattgtcctgttcttcctcttttctccaatttgactagcgagtagctgacaatctggtataagagccttccgccccaaaaattctcctggcttggttgtaaaattccagagaaggattggaaattgttctttggatcaatattccacgaaaaggcaacttgtcttcttctggttaagtgagtttggagagggagtggtcgattctgtctcctacgtcacaacttaaaacacccataaaaaccatggcgcatgaatggaagcaagatcttctgttgagaactatggaggagaacgagaggaaaagggaggaggaggaggagagggcgagaagtgattttgcaaatctaaagtgatgcctccttgcctttggcaactctggaagcatctaacaaactctttagaggcctcatacattggtggcaaaaagaatccgctctgccaaatcttggcttgtgtgtggaatgcaccgtagtgcccactataaggtgctgatcgtcatctctctacgatattaagtccttcctcggttggcacatacctccttagtagtccatctaagcagactctatataaatatggctcgtcccatatgtggtgacgactttcatactttaatttccttctgttctctctcagtggtacatatcttgataccatgtagttcacaatattcgcgtaacacgggttggagttgttcacaatcatcagcttgtcatctagtacgaaatcatttattagtggttcctgcacattagtgatttgcaacctcgacaaatgatctgctacggaattttctactccctttttgtcgttatttctaagtcaaattcctggagcagaaggatccatcttaaaagacggggtttagcatctgtcttggtgagcaaatattttaaggtagcatgatcagtatagagaattaccttaacacctagcaagacctaaacatatctatagcaaaaataacagccataagctcctgtcaagattttgttagcataacagattgcattatgtttcttctctttggtttggcctaaaaccgcaccaacaggaaaatcacgggcatcacacataatctcgaatgggagtgtcccatcaggaggttggatgattggggcagaaacgggtgcctttttgaggatttcaaaggaattaaggcactcgtcgttaaactcaaagggcacatccttaactaacaggttggtcagaggtctgccaattgtagaaaagtccttaatgaaccttctatagaaaccagcatgaccgaggaagctacggattcccttgatactcaccggaggtggaagttgatctatcacctctatcttagcttgatccacctctatacctctctcaggcacacgatgtctaaggacaatctcttcatggaccatgaaatggcaattttcccggttaagcactaggtctttctattcgcatcgttgcaagactttgtctaaattttggagacaatgaccgaaagtttttccatagacagagaagtcatccatgaaaacctccataatgtattcgatcatgtccgaaaagatagacaccatacaactctggaaagaggcaggagcgttacacagcccaaatgacattctacgataaacataggttccatacgggcatgtagctcaaaagtttcaccggaatcttcttcttcctcaatgaaatctgagacattattttcaagaagtgattcgggagactcaaaaggaataatagttgttacttcctttgcatattcgtcttcaggcagggaatcagtcaaggca

SEQ ID NO: 68521 - DNA, 7233 bp, Oryza sativa
ctttttactgaaataattctgggtgtttccaaaatcttcatcaagatcattcctgaacattatagcacattccagagtttgaatttctttgctctttgctggtgatggtttggaggaggactccttagccgaatctattgatgtaggcggttcagtctcagattcagctatcgaaggttccttaattttacgcatcgatgccttagggagggattcattatattgctctatgaaggaagtattttccataattcgatctagaattatttgtccttccgaaggagttttatgcaggaatgatcctccgacaatggtgtcaaggtataatgcatactccttgtctaaacctgcatgaaaatgttgtaatagcacatattcaggtatgaacaaggttggaccagatcatactaaattattaaatctggactaggctgcaccgatggattctttattcatctgctggaagatgatgatttctcgcaacttttcccagtcaccatttgcgcacttgatggtagatgtgtactgttgtattgcgctctcttgaagagagaacggaaacaatttccaccgtacagtttcttctttaatgcctcgaatattaaagtatgaacacaactgctcaaattcctatagcatgtgtttggttgaagggatatcccgggatgggatgggatcatcccatttttacatgtgtttggttgagagactagatgggataggatggttccaaaaaagaatattccttcaatattcgggaccaactcatccgccaaaaactggcggacagattcatcccacctccacatgcgtgtgaggcgcggtaaccctcatggcccatcccgggtttcaccgcatccctttttttttcccttcgctcttttcagctcctcctcacgactacgttctagggttagcggcgggagcaggggcgaatcggcggccagcgcgcgaggcggcgacgggagcaggggcgagccggcggcgcgagcagggatgaaacggtggcgggagcgcatgagcaagggcgagctgacggtgcaaacaggggcaaggcggcggtgggagcgcatgagcagggagctggtgatgcctcttctcttgccggtcgctactctgctatccttctgtaaatttctctatccaataattggtattgatcagagagactgatatttgtcaattctcatctccgaagcgcttgatcgctatcatagtattatgagtaagtatggatgaagtcaattagttagtagcaattgaaccaacagcagtataattagttcaaaaatgtgttatttttttaggtgaatttcttgacagtagatgatggccatgtgttattttctatgaatggattgatacaagaattgatgtatactgactaaaaatgtagcgatattaacggtatttaattttcaaatagtgtaattttcatgtctaaatgttattttacaatgtgtacactccaggcatcccaccttcatccctccatccaaacaaggcataggatcattccaacccatcatatccttcaaaccaaacaaaaaataggattcgttccatcccttcaaccaaacagaaaatgggatcatcccattcccaaaaacagggatggatccaacccatcccaccttgtccctaaaccaaacacatgcataggtgatggtagggattttcttggtcgagacctaaaaaaggatttctccctaaccatacttattaattcggggcgaatttcgtagtcggttataaaaattggcttcaatgaaggaggtggttcatagaattttcctgtaggagctaacaatttgaagataggttgctccagggtcgagagttgtattttaggaaatttcaacggatagcaggggtagaggaagaagaaaaatcaaagatatgaggatgaacaaggtacggaggagaatagcaattgttccccggcaacggcactataaatgcttattggtatttcttacggtcacagataaaatctgcaagcgcacggatatgccgatataacacttcactcgggagtattccaaggtatcaatttccatgaggaacgtgtgtgctcagctattctctaggttcatccaagggcacgaagcaaagataggcaaatgatagagaggatttcctagcgataaacaatgtctatagaaagcttggtttaatcctatagcaaaacttcaggcgctaacttgctcactgctaccagaacgcgctctactccgtacccggactgggaggactgtggtgctcttgtgggctgtcactatctctataccaacctctaatgatatgtgggatacgcagcaatctctgaaaataactacctaaacaccatgtttaagaaattaatttctactctagtgtctataactcactaaagtaaacataaacactgcatattaaatatagcgaacaatgattagaatgctaaaaggaactaactaagagataattctcacaaagcaaaatcttaattactcggaagaatatttctatgaaatcagagtaattacaaaggtacaaaaagtaagaggagattatcgacaactccgaaattcctccgatttcttcttattctctccctattctagtataccatagggcctcttataattcggctcaagcttggagtgtgtgttggagtggagcgaggcctcctccttttataagctgagtattacggttatggcggttggaattgtccaaactaccctgtaaacgtcattgaggagtgattaggagcgtccacgtagaaagccaggatgaagcctcagccagggtttggccgaacctgggttggcacatctggcctccagtttttccctgggcctccacaattctctcccttatccacttctatacttgttgagctcaatttgtaatgtttcgatgaagttgtgagcccacttcttatatggatggattttccctccaattaagtctagatttcatcccaacttggtgatttattatctgcatccaaatatacaccaacactcgtggaatatgtcaaaattaaaccctaccactatgttggatgttttattatctttgtattatgcaggtattggcggcataaaattagcatttaacagccaccaacactcatgtggaattctagactaatgtccttgtatgtgaaagaagcaaaaggggattagttcagttgataattatctagctccatgttggatgctccgattagcatagccaaggacatgcaaaactaataaaaaaattcagttaaccaaccggccgtatgcaaaatcttgtaccagctacgtgctaatcctagccaaaatttgtcgtttcatgtatacatgccattactatatgtgtgcaaacatgtgttctgtttacttgcttctcatgatgatctagtttacacatgcttcattgtttgacatgtatatgggagctagatgaaatcccacatgttactacggaaagttctatataatagtagtataaaatatggttaattagttccatgcattaaaaatttattggttttgaaaaatatcaatactatttgcgtatttgtaacgatgccactgatatttatttgtaatcttctacctctctcttcccatcttctatctctctccctctctctgcaatctgttgccgccaccgctgctgctgctgccgcgccgccgctcgcagccgcgtcgctgttgctgttgccgccgctcgcagccgcgccgccactgctgccctacatacaaactctagtgcgcatatgctagctgcagaacagcaatcgcgattcttttttctgaacttggttaattttcattttccgcagaactggttccatttccaggtgaaggaactaagctagctggatgaacgagtttccatcaagttacaacacacagttgacaggatcgatcgagttatacatggttttgaacagcaggaggtaaaatctcgtgttgctttgcctacaaccttactgctgccgcccccgctcgcagccgcgtcgctgcggctgctgctgccgccgccgcgctgccgctcgcaaccgcgttgctgctgctgctgttgccaccactcgccgccgctgagaacgaaaagaggaggaaggagaaaggggaagaaggaagaagcggggaaaaatggcagtttggtccaattttctatggaaatgcatataagaggtaagtagtgatatttttgaatatgtgtgaaattataatggcatatttccaaatacataaatactagtggtatatttaaaaaccggtaaatttctaatggcatgtatccaattaaccctataaaataacatgaaaaatagctagatgacataactttatatactttatataattttcatatttaatcgaccatgaaaaaagttataaacaattaagatgacaaggtttataacaatttaaattatatgtagtttgattattcaaaagtaaaactaaggtaatgtatcttaatgacagaaggaaaagattgaagataaaataggttaatcatctaaagataactctaatctaatgtaagataattttattgggaaaaaaggaggaagatattttggagtatagattaatcatctaagggttagaaaaaatgatatgatacggtttattgagagaagagataaatatcattaactacaattattaggataaactttaatagatatttatgacaagtaaactagatgagagcctttggaccatacagcacgattgatcaaccctatctgtaaatttaggcaacgtaggaacttcaaaacctactagatcaagtgaatacgtacgtactcacggcaaagtccaaggggtgccgcagggcagtagggattgtttgcaggactgctgatgcagtagcggagcccacacatcagtgtctgctactgcatcagcagtattgcagaggatgtgcatctgccgcagggacagcaaggaccacagtacaacaaatgaacaaaatgtctttgtaaggccttttttttatttctatagaaaaaacgcttgtgcgttgcaacgggtgaagtttattttaatcttattattgttatatggtttagttaagatgaaattcaccgtgggagatcgtatgtatatatatatatttttagaaaatcatgagctgcagttaggagtccgatcgtctcaagttagcatacgagtttttttaaacaaatttcttatatgattccttttgtattaccaaaagtgaatggtcttaaaaaacagactcaaatacggatatttattcccaaaagcaaacaaacttaaaaaccgactcatacacggatgacgtaccaaaataccggaaaaatatcttctttttattatagtagagataaagacactttaaatagctttgtaatggtgctttataatggagtataggtatttgtgaaaatatcttataagtgacttatggtgaattgtcaatgtaaataaagggggaatttgtcagggttatggataacacatacctaatagtagttgactaaatctcggcaggacccaccacataccatgtcttatacggaaacaaccttcggatataggaggagttccgcataaggaaagataaatagagttctacatgaaaacgacaaggactactcagattgtatccatattggtttttctagttctattctgacaaggggacacctatgggtataaatataaggccccctaggaggagaggggacacggaacaatagatcaagacacaagatcaacattcaagctaacatacgccaagattagacgccgaatatcgacttcagagataagcatggctaatcccctacagtgtctacggatactgtcaggagagacatagcgctgtctttgatctcgccggatgtggattcgaggaggaaggctaccctgttgtcgactacgagtcagcacttcagaccgccaagtcgacaacagttaaataggctactcctggttctcggaccagtaggccgtagcgatctctcgtacctcgacgtcaatcggtcgagagatgaggcttactcctagttctcggaccaataggctgtagcgatctctcgcacctctacttcttgtggtcgagttaaggctacacctggttttcgaccagcggtttagcgatactcccactagctttacttctcgtggtcgagttaaggctacacctggtttcgaccaagcggtgtagcgatactcccgctagctttacttctcgtggtcgagttaattaaggctacacctggttctcgaccagaggtgtagcgatactcccactacctttatttatagtggtcgagttaaggctacacctgaatatggtcatgtaagatctggtcatgtaagagcaacgaccatgtaacgaccggcttacacgaccatcatgtaaaggaagggagtgcttgaacctttaagcacatgcattagtttgaatattgtttctcctgcttattatgctcttatgtgttatggttctgatgcttctactattgatacaatagggaaagtcatataccgtttaaaaatatttatcgtgcttaaaatattatattttataatgtccaaattttctattaatgtgttacatgtttcactttcacatgtaagattctattgaaattgttggttcgcctatgaactgtttcgctaagtggtttacgctacattttttttttcacaggtggtgatcatagcatgatattggtcaaattccgctatgtactttgcctacaccatatattctctggcatcatagaagacagaaaatccatgtatgtttctttactaaaagttttccaaccttgaattattgagaaactcaaagctaccgctgaacaattgtgctctgtttgtagcaatactttattctgggtgtaacatataatctaaactggttttggggtcaactttatgttattaattggtttgtacttggcagattctttgcattggcttactgcattcttttaagtgctaagcatgtaatctaccattaatgggattcatataattatacatcttatttcaatttcagttccacacagggataccacttttgcatagaagaatgaaggtatatgattaccaactatttcctttgtatttcaggaacaagtattgctgaagcaattctgtaaaaatattaacgcacgcttgcattttcgtcagcgagataaattcctggccctctagctgaactattctaattgttttggcatcagattacatgtaa

SEQ ID NO: 68522 - DNA, 719 bp, Oryza sativa
gaaagataagagaagaagaatttatttttgaaaaatccaaagggatctgtatttcaagcttacgtcaatttataattcttcgcttatgtgcacccagtcttctactaacatcagtagcatacaatgcgacaatggtcgagaggttgacaacatcactgcacagactttcttcctcactaatggcgtcgctatgcagatctcatgcccccacacgtctccaaggaacggtaaagccaagcatatacttcgttccattaacaatattgtgcactcccttctgtgtcaggccagccttccaggctccttgtgggccgaggccctccacacagctaccaacctcatcaaccggcatcctacaaaaatcctacaccaccacaccccctactatgccctcatcaacggatttaagattactcaaaactttattaatagagtaaaatgcactatcggtccttaaacttgtcatgaggtttcactttggtccacgaacttgcaaatcatacatcgaggtccctaaacttgatttgttgtatcatctcggtccaaagcgtcgtttgaccatggtcttgcctatgtggtacgccacgtgaacaatgacatggcattttttctttttcccccttttctttttctcctcctcttcttttatcttcttcctctactggagccacctcaagctccctcgtgccgaccaccactgtcatcaccagcgtcgctgc

SEQ ID NO: 68523 - DNA, 709 bp, Oryza sativa
gaagttgacgggcagctaacgaagaagagaattcctgctaaggtgatgtggtatttccctataataccacggctaaggcgtttgttcaagaacaaggggaatgttagaatgatgcgttggcacgctgaagagcgtcaacaagacgggatgttgagacaccctgccgatggttcgcagtggcgaaacatcgatagaaaatttaaatactttggaaaggacgcacgaaacgtacggtttcgtttaagtatggatggtatgaatccttttggagagatgagcagcggctatagcacttggcccgttacgatgtgtatctacaacctcccccctggctatacatgaagaggaagtacataatgatgccaattattattcaaggccccaagcaacctggtaatgacatcgatgtgtacctaagaccactggtcgaagatcttaaactgttgtagaagaaggaaggtgtccccgtgtgtaacgaggacaaacaggaggagtttaacgtacgagtgctactgttcgtaaccatgaacgattggcctgcacttagcaacctatccgggtagtccaacaaggggtacaaggcttgcactcactgtatggatgaaacagaaagtacgtatcttaagcactgtcggaaggttgtgtacatgggtcatcgtcgattccttgcagcaaaccacccagtacggaagaaaggcaagcacattga

SEQ ID NO: 68524 - DNA, 13962 bp, Oryza sativa
aactgaatttacagatgtaagtcctcatgctccttagatattgcaaatatttcatttaagttgattttaacacaaatcatttgtcttttactttccatagctcccgagcatcccttataacgcaatccggttcgatcagaaaacgctgatcaacttatgcatggacttgtgccagttcattcgttgcgacatctgtaaccatctaggagagttccacgatcctcatagtgaacttgctacggaccccaaattcaagaacctaagggtgtgggagagggaacatgctatggtctaaaaggtttatttgtcgcgggggaaacttgtaatattacaaacactatacattctacgtaatttgatgtttataattgagctcggtcaatttttggctaatttataatatattatcccgtgcggtcaaattataccgaccgcacgggataatcgattatcccatgcggtcagccctcccgcacgcgaaaatatcgattttcccaaacgcggcgttgcaggcgggctgatccaccgcatggaaaaatgggtattgtaatagtgtagagaaaccatctttgacgggtcagctaaaatccacaataacctcggtttgtgtaggaatcaggactaaagaatatctttcgtcccggttcaaaaggtcaggggtactttttgatctttagtctaggttggtgttaccaagcgggactaaagatcatttttagttccagctcaaaacatggcaggcggtgttagaccccttcactatttttagttctggttggtaacaccaaccgggactaaagatctatttttaatcccgattgttaaacaaccgggactacaaatcggccccgagccacactctactcgtccgatcgcgtccttccttgatacttccaccttatctcctttctcctcctctcctcctataacgccccgatttacggtcgggattaaaaatcaattaataatgcatcttctagatattttagaaaagttaaagcaatttaatcaagtgaaataatgggaaaattaaaaatttcccttaaaaatcattgaccaagaatattttgtaatattctttgtgccctaatatactctccggatttttccgtgaattttcggagctcaggaattaattttaaaagcataaagttcatttaatcaatttaaatgaaaagaaaaacaaaataaaaactccccttcctccttgggctattttcggcccaagaatccttccccgcggccagcgcgcccctccctctctcgggctctctctctttccctcaacccagctccatgctcggccctctcctcccagaagtctagtttgcctccccagccggcctccctctcctctttggccgacagatgggacccatggaccccacctatcatccccaaccttaggtcggcaactgccgttgccaccatggccgctaaaaaccgcccacgtcgccgccattcctggcctcctcgagccctctctcgcgtgggaccggaagccacccctctcctccacctcctccctcgtttttccccaaaaaccggcgccgatttggcccccacgatcccacgatgcctcgccacttcactggccgttgccgccccactcggccacgattccccctccacgagtgtatataaacgatccccggagcatcctctctcgtttcccccatttcgcccgaacccactgcactcctcctcgctctccccacgctgctccgcgcgatgccgcccgccggcgagctccggctgcacgccgccgtcgccgtagccaccgccgcgccgcaccgttggttccttcggcttcgcctcgccgtgccgcaccccggcctccgctctgtttccccattccatcactgcagccatcctcccactgcgaacccgagccgccatcgccatccgccgcctccagccgcgcgctaccgccgctcccgccgctgccgtactgcgccgcatccaccgccggtttcgtcgccgcctcatccctcccattcaccatccggaaccatcctcccctaccgcggaagcccgagtctacactccactctccatagcagctccagtcgctcctcgccagtgagggggaccttgcccagccgtgctgctgccgctggcgcgttcgcagtgctcgcctgcacctcgtccgctgctcggtcgtcgtcttccgccgctcaaacccatccactaagttcgccggtgagctccacctcttgtcgtcgtcatcgtccttcatttccagtcaccccgcatcggctcctcccctccctaactccctcttctccttccgcaggtcaagggcaaccccgtccgccctccatcctcgcaagccgccatcgggcaatcgtcgtcgccatcatcatcctccgcgccggccgccgcttccagtgaggacctctcctccctccccctttttttcctgtccccctttcttgccggccgccgcctcttggggtgcgccgccatcctccgtgcgcaccgctgtcctctggccgcccgctgccgttccgcgtcgccgggtgctaccgccagtggccgcgtgccgccgccgcgccttggcttggccgggccggctttgtgccgcacccgtgcccctggccggcgctcccctcggccgcccgatcggcttgggccgatctgggtcgtccatgtggtggacgcgcacccgaggacacgtgtggacttggtccaccgtgcgccgcccctttgtgccgctgacgtgcggggctcgcgtgtcggcgtcggcctccccttgatgactcaacgcgtcccttgtcctttgagaaattaatcaatttaatgcgcaataaattcgttaataattctagaaattcatttaaacggttcagaacttctaaaatccatatcaaattcattcgaactccaaattgagccattcaacttgcaaaattcatctaaaattgggctctacatgtttgtttacttttattgtactgtttgcttggtctttattagagtttttcctcgttttgcgtgccagcgtgtagatttcactgtttcggaagttcgtggtcacgaggataagagtttggaagattgtttgaagaagcaaggcaagtcacacattccccttgagcatgttgatcccaatttataaatgttttattgtttgcaaataaatatgcaccgttttgctaattacatgggaatagggtttacctatctgcttgcttgtaccatattatttgatatctgtcctttgtcaactgtgggtgataattcgactagcttgtgtcacttatgttgatctagctagaactatatgcttaccatgcttaattatcactagctcagttgatgggataattgcagaattagaccttttagtatcattacgagctgcgtgctcgagacatatgaccatgtttcattggtcgtaactatccaactaaaatgcgactgaatggtgggctgtgggtgcatggttttgctggtcgcacccatggcaattaaggaccggttcgcgggatgcactggaagacatacagcgcttgccacaaccgggaatgggtaactacctgacttgaagtatagctttccgctggctgatgcatccaggcaagggtgagcgtgatggagttcggatgggccctgcgacggcctatgcggctttctgattcgcctaggcacgagaggggactgcctgttgcctgctgggggcaggggtgaaacctgaggtgtggtgtgcttggtcagagggggttatatgaagggtcttgtcacaattactcgacatggtgacgtgtctggcctggcacggtgacatgccgatggattgtgtcatgtgggtacagtagtgcacctctggccagagtaaaactattgaaatagccgtgcccgcggttatgggcgattgaccagattcaccgtgattagtctcacacttaataaatcgacccaatgcactgtagttcaggtgggatggttgggcctgttcaacgtggtgtagtgttgatcagtggagatttaatgttactctaattagtcaacagttttaccctttttctcaataaaatgttttacaaccgcctttatgcaaatagcaacaaactgtccttgtattcccttgcacgtctgcatcattggtgtggcttgctgagtacggtggttgtactcagttttgctattattttccccttttcagaagtgtagtgcttctgagctgaagacgaagttagaagaccaaggctcaaaccccagttgtgttttgcctgaggagtggagctgaagccccgctaggatcgcctttttccgctgctgctgctttcttttcggtgtgaggactaagagcctcttctgtaagtatttactctttatttacgtttggaactgtttattacttgtcttttgtgtaccctggctgattcctggacagggatttaatacacaaaatagtctggaaatttgggctaaatttctgggcgtgacacctcccgtcattcactcaccctcatctcctcctcccctctcctcctctcttctcctccggcctcctcccatcccctcccctcctccactccgctcccctcttcccctccggctcccttctggcgggcggcggcggcggtgtcgtggggacgacatgaggggcgcgagggcagcagtggcctcccctccgccggatccgggaggggaggcggccgtgcggtggcggcggtggcgccggggcggcccgaggggcgcgagggcggcggcggcctcccctccgcgggattcgggaggggaggcagccaggcggtggctgtggagttgattcgtagatttttttgtgaattgatttgtaatgaatgatttgtagttattttttattgatttgtgattgatttgtggattgtggatgggcatgtgttgtggatgattgtgtatgatttgttgatggttttgtggatgattatgtatgatttgtggggatttgggtgtgacggtgatagtcgaggtgcaaacagcataaaaacaatggaaataaaaagaaaaaaaatcttttactcccggttggtaggactaaagatactaaagattgatctttagtcccgaatatttgaaccgggactaaagatagcgatatttagtcccggattcgtatccccgatttgctatctgggactatagggggttgcaaactgggactaaaagggtttgtgcagcagtgtactggactcttcatctcgatctgtcacaaacgacgcaaaacacatactagatagctgaataaaaagggtgactgttaatagtgaaatttggtaagcccggagtagtcatcggcttagagtcagcatcggcttcgaagtcctgagattagccgatgagagttgtcaagtcgtcagttatcggattcttactatattcggttaaggaaattgatctacttaaggaggcttatgcagaagagactgagttcaaagagaatacggtatggcaagttatctattaattaggaatagtttgttagtttccttttaacttaggaaagtgtgtttagtgtcctataaggactttatcttttccttttatctttaggaaggtttctttcttgtccgacaaggacttgtatcaacccatgggtataaatatgtacacccggggtctatgtaatctatcgctacgattaatacaattcggcgcatcgccacccttttttacttctacttttgtttttacgttccgacggaacttggcacccgacgcggggctgcatcgtcttcgatctccagcgaagggataagtccaatgttccgccggtccaggcaattgtatcgtctacgtcggcgtcgttcaaggctgcatcaggacattcgacctcttggattactctggtttggataatatatttgcctggctatttatcatatgtctatgttaatctagtcctagcatctcaatttagctctatcagctgtctctcgctttagggtttatgtcggtatcggctaaatcgccttgctagattagattagcctaggcatctaccaccttgaaaatcagtcaacggcttgattgtctagatattatgtttcttttcacactcagcgctgcatcagttaagtttgatctactaagtcgtgcttagaaccataatctctagcctgcttcttgattgccaataagggtttcatcggggtttcagccggtgagttatctggatgttgcatcggctcataagaattgcatatacatataagttggatttatccgatgacaacaaaggtttcactgtttaatctaatcttgtggatttcatgacatcggaactccagccgatgtgtgctttaaccttcagatcgatgcttatttatcatatcattatttgccgattggtttatactggattatattgttattttattacatcatcatcaaccgattgtcttcatatcattatctacattagacatacaaccgattgtttaaaccctatcactatcggctggtatcggcatcggcatcggctattatcggctatcgactggaactattccatcggcttgtcagccgatcggctgttttgatctactatttgcatatcttgtcagttgtaggatcaaactgactggcacgccctcatctcactaagatttggacctgcacatgagcttagcaaatctcccaggccggtgtgttcattttttcgtcaacagtaacatatctgtaacttttttcatatcctatcttactgtaaagttatcccccactaactccttaagcttaacatgcaaagatgccacatcatcatccactaacaagatgccacatcatcatccactaacaatcatcacatttaaacatcatgcaaacatgctatatctttatagttttttataatttaagagcttttcaaatacaaacatgttaaattatcatccaacataattcacaattcacgtaatgtttcaatgtatatctttattatgttttatgatatcatatatatttatatagttcatcctcacttagttagtgcttaaatgattaatctatggtccaaattatctttctccttttttcctctaattaagtcatatcacatcaattgttttttgcctttagatgattaatctacggtccaaactatctccctactttttttttccataaagtcataccaccttactttttacgtatactatttaaatttaaattatcataaaccacattaatttacttaatttgatgttacctagctatcttacacgttattttttttattgttatcatactaaattcccgcagcaatacgcggggtttcaccttgtatattcaaatgacatgtcttgttttccctcatactagcaaatatatatatttcccccatatttatgctttgaaaatactcgcatattagatatcgctgtaaatgactcgagtagtcgggtctgacaaggggctttacattgtcaaattacaggatttgtgcagatcacccaactactaaataaacttggaatttttttgtctttaaccgacaaagattataatttgttaactagccaatctgaccgagagcaatcgctagataaaatcctataacgtctggataactcgaagagtttgtggtaatgaagatgacttattgctggtctggacaagagaaaatattagtttatgatgtcggacaaatacgcacgggtgcacaatttttattaggtgttttatatgcatttagtggcttacgtttaatgtctgtatgtggagctaaccgacgctgctcgacgactttaatgtttgctgataagtctattcgagtatttcagaaaaaaagaaagaataagcaaaacaacaacatcgagattctaatcacacaattagactgcttaagttctgaactttatacaaacactactaactactacaggattgattttcctggacactacctttttttccatgctgttcataactggaaccgcacagaaaaatagggggaccagcgtcgggttgtcgcccgcacggaaaaataagctgattttcctgtgcgaacctattaagagagccgcacgcgaaaatagtactctctcttttcccttctacccacttcaaaatttcccctttttccgcgcgcctcggtcccttctctctcttttatccggccccattgattctcctttcaaagtcttctctctttcctcactgcctcacgccaaagtcttctcagccgattctcctctcctcactcactgcctctcctcactacctctctgtggcggcggcggcccatggcgatggctgcgtggcgacagcgacgatggcgctttggtggcagcgcggcgacaacaatgatggtgtggcggtggaggcgcgggatccggcgagcagcggcggtggaggcggcgacagcgacgacggtgcggcggtggaggcgcgggatccgacgggcggcagcggtggcggcgcggcgacagcgacgaatgcacaggattcggagggcggcggccgtccccgcacggatccggcggccggccgccctcccccgccatggatctggcgcgggatctggctcccctcccctccccttccttccctccccagatccggcggaggggaggggcgtcggcggcggtgcgatcggaagggagcgtggatgggaggccggcgggaggtggcgccgacgacgatgaggtgggtgccgccgtcgatgacgaggaggaggcggtggacgggtgctgcggcgccgatctaaggttttcatttttttttgaaattttattttattgttcggatttttgtttttcagtgcgggcgacataagcacccgcatgtgaaaatcgctgttttcccagacaccttggggcgtgcgggccgtccatccgcatgcaaaaatcgtttgacccgcacgagaaaatgggtactgtagtagtgaaattttagacaccgaacacatgattttcccgtctgatgatacgatttagttgtcggccttaactttattatcggctaactatgtcgactatgccgactaagttttaagttttatattttgagaactctgactcatgtgatataaatatggtcaacataatccctccgtcccataaaaaaactaacatagtactgtatgtgacacattgtagtactagtagtactacgaatctgcatatacatcacatcagttctagattcactttttttttttacgcagggagtatgtttgaatagagtttaattaggagctattgtcagtgttccaaaaataggataccctatggatctgtgcttatcacagcggttgtaccatataaaatgtcctatatgaaaataaacattatagatatggataaaaatctgaaggggataaggaataaaccccaaatatgaaaaaaaaacacagatcagttctacttaagcccaactaggactacccgtttcgtactgtacatatctccctaattatacgtggacaagggggaatcgagagtataactgaaaatcccttgtgtgcccatgaaaacttacctaatctctttaataccccctcaattttacttgatctctttgtacccctgaattttcgctttgatcccctccgtacccctcccgttagatttccgtttcatctgtaacgtattctatgagcaacattgtcagtattttcaaaaaataccaaaatggcaggctatgagctacattgtcagtattttcaaaaaataccaaaatgccctgccagtgccaaccctaactaaacagatccaatccccttctcttctcccccatcctctccacgcgagcggctaccgtgcaccgccagtctccaatcgtgcaggtggtgcctttgccatcccaccgccctctcgtcgcgcacgccgctggccgccgccctccatcgcacggtggagcaccgccggctatagacccgctgcatctctaaccgcccccggctctgctcgtacgccaccaggttggcgagcatggcgtggttggcatagttctccacggtggggatctccatcacgccgtcgcgctggctgaacgtgacgtcgacgaggctgcacggcaaccccttggcgtggaacgtcaccccggcatcctgcagctccgtcgccgacggcatctgccatgccacccgctcgtggatcggcttcgccagccactcgtcccagtacgcctcgtcctcctcctcccccttgccgctcacgccgccgctgttgctcgtcctgtgctccggtggaaagaaccaatggtagtagaggtcgagaaggtggagatttaattgagatatgcataattttcgatttggaagcttcggttatcaccgtcctgtcgctcgtcctgtcctccggccgccggcaacattttccaattctttaccaatctacctactgttgctcctccatctacaagggcattatagacatttgtaaccacacataactacaaaataaagaaaacctaacgggaggggcataaaagggatcaaagcaaaaattcggggtacagaggggatcgagtaaaattggagggtatagaagagattgggcatgttttcatgggtacacaagggattaactcagagtataaattcaaggcttctcacgaggagggatgacattgatggcagactcgattaaggttatctcctgatactttgtactcccttcataaaaaaaactcaattatgggtttcaaaggcgtgtgtacaggttcaaacatagaattggattttttttgacggagggagtacatatgagattgatatatgaaaaagtgttttcatccctcgaggggatattcccttgtttcgtgcatgtcacataaatatttataaaaaaatgaaaaaaaaatcacaagatagattaatatgaaatgtatcactccacaaacatgcatgttaaaaatcaacttccacaaattataacaaaaataacaaatataactgcgaatgtacgataactactttcagtctaatttgttcttttttgttgtaacttatagaaatcaaattttgcgagtggtatatttcatattaatctatgttgttattttttttcaatttttttataactatttagatgacatgcaagcgatgaggggatatcctctcgaggaatgaaaatccacatcttgatatacacaatgacaacactggccttcgctcaaaatgaatagggctattacccatctcggtggccttaacctatataaataaaccatgtccctcttattcttcttactgcttcatttttatcctcacattagtcgatctctgtgtcctcaaatacattacatatgtacggaacctacggtcaggatgttaccggtataactagttgaagaaacagaatatgcacaaatataatttttgtacttatccgattcgatcagttaaataacatacccagaaatttacaaaactattcatttatttgcaccaataatcacattcctgatggaatgtttccatttgtaaaggcaatctattactttttacccacaagagcctgattgacttacgttggtgcggccatcgcacataaatgattggcttttgctaaagtcacaccaaacttctccgtcatatcaattctatttccttctacctcagctgggagtctccatttaaaatgaattaacagggatgcaagaagtacatgcaccatcctaacagctaatggcattccagggcagattcgtcgtcccgcaccaaatgggatgagctccaaatctccacctttgtagtcaattgtcctttctaggaatctctccggaataaactttcccgcttctggccatatatcttcgtctcgacccatggcccacacgtttattaacactctagtacctttaggtattgtataacccattatttggatcgtcctcgtagcttgccgtggtaataataacggagctggtgaatgcagtcgaaatgtttcttttatgacagcttgcaaatagggcaattgaccaatttcagattcttcaattcttcttcttgacccaacaactcgtcttagctcatcgcatagtttagccattgatattgggttctgtagcaattcggccattgcccattctactgtgctagaacttgtgtcactacctgcagtaaacaagtcctacaatacaaagatatacaatgaaatggtaacggaaattaatagtacaccaataactgtggaagagcatccacataccacatttttatgtttaaaagttatatatatatatatatatatatatatatatatatatatatatatatatatatatatatatatatatatatatatatatcttgtcgtaattagtaactatttgtaacgagagccatatggggcatcatggtgcctgggcaccgatggttgaaatacacaaattgactcaaattgatttttaacttatgactataaacccaggtgtaacaattatattcatacctacacggctacacctaacaacaaattgactcaaattgacattatttcacaattcattaagttatatgtttggatggtacagaatcaaaatctaacaaagaaaaatgttcaatttagtttaaacttgactataaacaagttaatttcatacctaaaagtttttgaaattttggacccccaaaattttcgtaattttattcttttgtgattttgttcaaaatatgttaaattcagtcaaattttgtttaagttataagtagttccgtatcaaatttttttgaaatttctgaaattttggcttttacgaaatagcggtttgtatgcgattgaaagcaacatatttttggtttttttatcgaggagatccaatcagggttcactttatcggttaggccgatcgtgtcggaggtcaccgaaatcccaaaatttcggtccgaaatttccaaaattttgaacaaatatgaccaaaattcatgaacaaattgaaaaattgaaaaattttggccaaagtaatatcatttcggaggggaccgaaattcggaaatttcggtccgaaatttccaaccttggatccaatcatgcatgtcacagtaaaaataaaatcaacccatagccccccggcactgcacaagttgtaaacggaaaatgaaaatgactggaactgaaaacgatggttgttttccttgtatttttttcctttttttatacttttttattttttagttttattaatagacctttacgaaaatatttccgaaaactgaattcttttaccatgctaggcacggtggcgctgcaagatgttgttatggcgcatgaggtgacaaagtgatttgactacatcagacgggttgacgtggccaaaagatttagatttagaaatacagttctattaataaaattttaaaataaaaaattctaaaaataaaaaaaattcgttatccttaccgtgaacagtgaccggagcgtgtcgccgtcgagcctcgccgtgtcgtcgtcccgcgcggcgagcctcaggagcacctccaggaagtcgccgtccttctccttcattccgtgcagcctgcgatggtccatctcggcgtcgaacagccggtgcagccgcgcaaacagcccagacagccgccggcgccagccctgcaggtcgacggcggcgagcgcggggaagaagtccgacaggttcgggctgccgactgcctccatgacgtccgtgatcagtcgctggaactccttcgacgcgccgtggtcgtcgaggctcgtcaggtcgtgcgagaagatggtgcgcgcgacgaggttcaggctcgtggtgaacgccacgcggccgatgtccaccgccgtgccgtcgcgcgccagacccgccacgtggtcgacgagctccgccaccttctcttgccggagctcgtggagcgcgtcgagccggcgcgtggagaacagctccgtcgccatgatcttgcggagctcgcgccaccgcggcccggggggcagccaggcgacggagttcctggcgtggtcaccggtggcgtcgggggttgaacgggtggcgaagacggcgtcgtgcttctgcaggaactcg

SEQ ID NO: 68525 - DNA, 2007 bp, Oryza sativa
agaaggaacgaaaaacagaaaaatctggatggttaatattttaccgggcctattgatgaagcacaaaagaaaaaagaaatacgaaaggtgggtggtaaaaaacgaaaaaaataaaccgagaaaagatgggatacggaggaaaggcatgggtggtaaaaaagggaaaaccggacggagagggcgttgtggagcgctcgaactaatattccgcgttgtagcgtgcggattagcactactgtaaaaacatattcattattaattattattaacataaacaatatataaatatatttaatagatggagaggccatagtcgtgtgacacgacttatgttgctagttggtctgaagctaggagccggtatcaggcataatagcaccagtcacaagggagagagagaatcattggacccatctgtcagacaacacaatatctgattctcctttgcaattcaatacagctaggcccaccatatggagcctatgctgggttctattatggcatgtacaatggagaccacatgtactagtggtctcatgataccacataggatagaaccacataaaagtcacactacctacagtggaaaccactccaaaatatattttgcattttagttcctatctatttgtgtatcttagtatcaaatctattaaaacttaataatttggtccgtataacaaccaaaagaagtatatatgcacccctcaacaccatgcggacccactatcagcctgtccctgtccactcccttttttattctctctctccctgtccctcccgagccttctcgtcttcttcctctccatagagaccgtcggcactctccttctcccagtccaccccgccgacgagacccctcccctaccccgtgagctcgccgatgagacccgttccctcctgtcgtccccggttttaaaacacgggagaccacttgtgttaacaatactaaatccctagatcaataggttggcatacacacaatatgttactggtacagtgtcgtctgcagcgtattggattacaatacttaatattacaagggatgtccgagtggatccccaaataggccatgaggccgatacattaccaacatagaagcatagagtagggtagcagaagcgaggccgcgatggtatggctttattcccacaggcaatgattgggaattagtccctacggcatcaccacgtgttcttcttcggggagggtcttagtcgggtcatccacaaaatcagagtctagaaagtgatgtaaagcaagagtgagcacagaagtactcaaagacatcactacaagattcctaacttttaccaagggtgtttaaaccgtcggccacctattaaaactgtcggccatacatattactgagtgtcaactgtcggcaacttcccctcagccacatgtggtcggtaattgatcatattgctgagggtaccctcggtaactatgtacccgagggtttacggtcggtccttttttcagagaccacgcatggttctttcttgccgaccacatttcccgagcgtataccatcggttattcattgagtgacagtataatataccgtcggccttattctcacagagaggtttattttcccgtcaaattgtgattaccctcggcaatttagtaacaaatggttctacaagccttcggaaatagtatttgccataggtttttatataccgtcatccattcattaccctcggaaatagtattgccgagagattatttaggttacttgaaaaagaaaatcaaaccctcggtgatttgatattttctaaaaaaatgcaaatttaaattgtacccatttttaattaatcttataaaagtaacttactgcacatagtcacatcaaaacaaatttcagcttaattaatccataaacagatccacgggaagttcaaccatagatatataaccaaattgttcaaaaatatttatcatccatcaccatagcaaaactaagtaattcctgacatgtcttgcatgaaagactttaat

SEQ ID NO: 68526 - DNA, 3428 bp, Oryza sativa
ctgagatggaggactggacatttccagattagaaacccaggacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctcccggagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgatggggagccaaacccacgccgtcgagctcgtactccaccgccccctccacgccaaagtcctaggcgggagaaggcgctcgagagggccgaaggatccgcgacttcgacatccacaggaggtggagaagggcggcgagatggggagcatcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctgatgggcggtcctccgccaccaaggcctctggtgctgctaccaccggctccgcgtcgtcaagacggagggcgcggcgagcggcagccgctgttcgccattcggccgccactccttcgtcaacgcctccgacccaggaagatctgtgtggggaaccggatgctcgcatcagtatcgagcgccggcgtaatggccgacgtgctccccacgcaacggagggcgcctcctcgtccggagtgtcacctcaccacggacgcggggatcagccctccgtacccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgactgggtcatggcgaatttctttcccatggccctgaaaggacaagcgcagggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacatttagcggttctgtcaagtccacaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatctcctcgccgtcgagggcgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggcttgggccaaccccgcacccccccgggcgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccctaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaaggaggcccgaaggcctcggaagaagaaggaaaagaagaaactatttaaagattggcgggtgcctgggggctcactccgatgcacccgggtcgccagcctcgtcgccactgtcggttttcccttgctgatgcgcgcgatttgcgaccgccgggattctgcccgaagagagagagagcagggaggagaggcccccgagccgaacggcggcccaaggcccccgacggccggagctggctctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcggccccgccgaaaggtgcagcggcccgtctacttcgttagcgaggccctccgggacgccaagacccgataccctcatgcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgtccccgaggccagctcgagcccatcgctgctgcctcacaccgccctctgggtgatgtagttcgacggcacctgt

SEQ ID NO: 68527 - DNA, 1477 bp, Oryza sativa
cctaaccacatttattgcggtttggctgagcgtgtcacgccgcatgtaacgcagtgcagtgcactcgtttatccggtctgtgaccagtcacagaccggtcagatcgcgggttaggtggcgataggcgatctgacacacgcctcgccccatcccgtcaggacgagggcttctaggcgctcgtccccagctggagctagcgtgttacctcccagagatggcacgttagtactggtcagatatatgccaggcttcatcctaaccattacaggcaagatattgtatgaagaagggcgaacatgcagatggataaactgacgcgtggtggacaagaatgaccgatttgtgaccggtctgacactggtcatgtcgtcagcagacagccatgttcccacgtcgcgcctgcttccggcggaagtggaggtaggtatgggccgtcccattagaaggtcattcggacggcaaccatacaagtctccatctgtttatgaaaaggtggggtaagtccccacaaaaaagagagaaatggtgcatgtggtatccccttaagatataaaaggaggaccttgcccactgagatggaggactggacttttccagattagaaacccaggacaagggagaggctggctgatactttgtagctccttcatacacagatctcccaaaacacaggagtagggtattacgcttctcagcggcctgaacctgtatacatcgcccgtgtcttgtgtgtttcctgtctcgcgagccttccacatacagagagcttagaatctctcccggagtccccggccgaaccggtaaaggggggcctgcgcggtctcccggtgaggagccccacgctccgtcatacttcataattgttggactgtcctaaccgttgccttgacaaccaacatcaccgctgccgcacaaaatcaccatgaggagaatgtggattggggactcaagtagaagatggtggaggggaacagggagaaatggagctgggagaaagaggaggacgccggagctgctgctccactcctccggcttggagtgatggagtctcttcaccagccgccactagggggagaggacagggaggataaagagtgggttagggtttttttgtgtgagatttgctcttttatactagggaagatacttgagggctgttttggaccatgggctgggctgaaaattcaaattgggccgaatttttttggccggtttagtgttgtctcgggctggaccgaaatgggcgaatttcaccgaatttcggcccactcggtccgtatcccagaaccctgtccgaggtagctcagttttgtcctgtggtggaagcccggattcggccacaggagcaaattaaaggaagaagatagatctaactattggagtagaggaaaagaatggacggtaggcttgttgcaattcattgtattatattggtgcactttgttgttttcgtgtgttccgtctttttctaattgga

SEQ ID NO: 68528 - DNA, 1179 bp, Oryza sativa
aacaaggagttaaaaaacctgatactgacataagctcatcaaactcagtattcaattcatcacggaaataccaagatgtaccaagaccttaaaggaaaattctggtgggtcaacatgagaagggaaatagctgaatttgtcgcactccgtgatgtttgccaatgagtaaaggcagaacatcaaaggccagcagatttgcttcagccccttcggattacagaatggaagtgggaagaaattagaatggactttatcaccggtttgcctaggacatcatcggggcacgattctatttgggtagtcgttgatcggctcaccaaagtggctcagttcattccggtgcatactacctactcagggaagaagttagcagaactttacttggcaagaatcatgtgtctacatggggtacctaagaagatcgtgtctgatcgaggaagccaattcacttcaaagttctggtagaaattgcaagaggaattaggaacccgattgaatttcagcacagcctaccatccacagactgatggtcagaccgagcgagtcaaccaactattggaggatatgttgagagcctgtgcgcttgactttggtggagcatgggacaaaagcttgccgtatgccgagttctcctacaacaacagttaccaggctagtctgctaatggcaccatttgaagcactgcatggacggaggtgtcgcactctgctcttctgggatcagacagggcaacgccagttgtttggtacagaagttttaaatgaggcagaagagaaagtcagagctgccagggaaagattaagaatagcgcaatctcgacagaaaagctgtgcagacaaccgccgaagggagctcgctttcgaagcaggggattatgtgtatctctgtgtcactccgctcaggggagtacactgcttccaaaccaaagaaaagttggcaccacgctttgtgggatcataccagattttggaacatagaggtgaagtcgcttaccaactagagcttccctccagcatgcttggcatccataatgtgttccacgtctctcagttgaagaaatgttcgagagttcctgaggaacaggcaaagtccggatcacatcaaaattcaggaagatctgacgtatgtggagaagccgactcgtatcctagaaaccagcgagagaaggaccagaaacaa

SEQ ID NO: 68529 - DNA, 7347 bp, Oryza sativa
catccgcgacctctaccgctgccgcgccgcgctcgtcaagctccgctgccgccgcccatctccggccgcgcgccgtcgccgctagggccgttgccgtgccaagccgccaccgctgttagcttcgcctccgcaagagctttaccggccaccgcctcgcgttgctggaatcccaccagagtgcctctcttctcacacgccggtgagtcgcgccatcctccccatcttcggcgctgccgtcaagggttgcctgtggagtagagtcgcccgctgcagaagtcaagcttccaagttttagctcgttttatcttttccgctgcatttgtaatcttttatatttttgtatgatgtggatctgtatgtcaagaattgttgtttgtgtaccctggctggtcctagatagggatttaatgcacattcagcttcaaaattctggttcgtgaatttctgggcatgacatctccactgctgctctggttgaggaggagtgcgagcagcttgtcggggctagcggacacctcgcagtagggggcatctccaccatcgccaaaggtcgtagacgcgcgagctccgccaccggtggatacatgggtccggctccgtcccactcggctttgctttgtcaaaacggcgagaagatggacagaactacacgagggaagagagaataatggaggaagaaaggggttattaggtccaaaaaaattagaaaatagagtgaaggggtaagtagtggtatatgtcaaataaccagtaaattgtaatggcatgtctccaaatagatgaatagtaagggtatatttcaaaacagtgaaagttataatggcatggttccaattaacccataatatattatagatgccagtttcttaaagaaaaccggcacctatccagcgagccgagctgatcgagacagagaacccgagggtgtgaccaatcaagtggataaacatgtccttatccactcacccggtgccctccactcactcgtccctctctctccttctcctcccccattctcttctgcatccacaaaggcggcggcgttggagctgcggggggtggaacacaactaggtcggatataaccatgactaccttatgtattaatgaaccaaatgtacatatgttctacattaaatttacttgttatatatttgaacaaacattgtacacaatgagttttgtgtgttttcgtctgcagaggtacttgcttgggcggaggaaaagagaccaagcgtaacaaatgcatgtatgatcaaagaaattgattgtggaccaaaccaagaccttctccaagtctacttctacctcaccacgtcacttttggtccatagaagacaagagataaagttctacacgttttggattcgaattcgggcctcctagcagcatcaacatcaaacggacctagccgctgatctagaagtaattcagggcccatgagtacttgttcgaaagattatggagtctactttcagatgggtttggtcccacgtcaaaattcctatcgagctgccagcaataggcaaaacaagccacatatctcatccagtccgaatctgatttgggttttgggctttataattgtgtcgtgggcttagcccaagggggtgtgcaccctagggcaaccctaggacatccctaatcatattagtcaatagccgcaatcgtttaaagtcgggttttgcttagattaatctgtcaagaacagtttcgccgctatatcggtttgtggaatcccaaattcgagtgcttaatcattcatatgcaattatgttgcaatctatcttgttcttgcttgtgttcttcgattcgcatatagggattatccttctcggcgaggtctaccgggtttcagcatggtttataaccagaggagacgtggtgctgtgactgcggggctcagtagcatgttcgttcagaagaaggatcgaatttcgtcacgactccgtccaaatcgtctgtttatcaatacatatcggaagatcaggacctaacatcctcatcatttgttcagtcgcgtgactaccgtgggggaaaggccgccatcatcacgatccggcctcctcccctctagatctggttaagaaatcggtcggatatatctatttagtaacctccgcttagggttgaaagtgattcggataatttccatccgaccggaccttttttcggattcggatagtttcggtcagatatatccggaaatttttgaattcggaaacgaatttggatatgaaaacgaatatgatataggtgatatccatcggaatcggatatccgtcggatattatccggtaatttccatcggatatccaacttacacataaggctgccatagcccataagctagcccaacccgtgaggaggcaaatcagacttattggcaaaaatgaatttcgtgatactaaatgaactcatatgaaaaagttgtcaaaaacaaagttgtagaactcattaagatctgccaattttatttttttcatttctccatttgagtttcattgaactatataaaatctgaattttaaaatataagaaatttaaagaattcttcgggtagtaaatgatttcaaatggaaaaattgtcaaaaacttataaagatctacaacttttatgttggccatttttctatatgactttctttgaacagtttgaatttgaatttaaaaatatgagaacttcaaacaacattttcaaatactaaatgttttcaactgaaaaagtcatcaacaagaaagttgtataactcatcaagatctataactttatccaacaaaatgacagttttgccccttctcttcttccccttctgcttagtgcgccggcgcctgccgcatctgcgtcagtagtagtagtagcactgccagcatcgttggtcactcctccatgttctcgctcgactcagccgccaccgccacgttccaacgattggtggtggtcagcgtcaccgcctggtacaaggaagtgtccatgcatgaagtgcgggtgcaggatgaagaagtgcccatatggtggaatcggcctcacgttggctgatctctctagcggcggtggcggcggtggtggtggcatcgggctagcggctgggctcaccggggaggtggcggcagccttagacgaggaggtgggcgggcacttccgcatggcagacatcgcctgggggcccatccgcgccactcggcccgcgggacttcaccttcgtctgccacatcgtgtaccgcatgtccagcagccgctccggcgactacagcttcgatggcggtcggtgagcccggcggcaacggcttcgatggcggcggcggtggtggaggctacgacttcaacagtggccagctgcagagcaacaagttcgatggtggttggtgagtagcacgacgaagcgagcgggcggcggtggcgatggaggtggttgcggccaggcagtggcgagcagcagcggtgccgtcgacgacggtcggtgagcgcggcggcagcagctttacggcggcagatggtgagcggcgctgagaagcgggtgccggcagtggggattagatagtgctgagggcaatttggtctttttgaaatttctctcccatgttttgatcagaaatgataaaatattgtctcgggtgtcctatagcaaattacatgaattttgtggtgtccattagcaacgacacgattttacagtgtcttacagccaattacacaatttttaggtgtcccagggcaaattttgccaattatttattgcttcaaaatatcatttgaagttttgaaattcaaatttttaattgataaaacaaagtcacaagaaaaatggccaaaataatagcagtaaaaacacaaaaacaaggttgagcatgatttgagaaacatttaggacaaagaatcatccaatttggagtccatacgagtgagataaatgtaacatcctgaaaattcaagacaataaaaatcactaaaattttgaactttttaaaatttttgcgtcatgctggttgttatgattgctattgcttgccaaaccgtaaatggtcacaaagaaagtaaagtaaggatctaaaatttaagtaatagataaatttacgagaatataatatttaattgttaaccctacaaataattacgcacaagaaaacaaagccagacaaacggaaggttaataactaatttagattatgtattaattactaaatacttgaaccatgtgttgcgtgccatgacatctaaatacacatgaaatgatgaccatttataatggaactctatctataacatagtttcattaggagtaattaatgggatattactaaactataatggtctatataaaggtaaaccaattcacatgaaataatggtcatataattaaattaagctttataaaattatgtgaggttttaattaaacaattagattaatactgtgccgagtctcaatttactatttatagaataaatagattgaacctatccgtgtaaaatatattgctatacaactaaactcgaccaatctgctaatgtattaatcatgacaagtcgttatattaaattcaatattaccccaaagtcttcaaaaatatataagttcgccttagggccaataactcaaattaatctaaaaagaattcatttgtgcgataaataaataaatatgggtaataattttggataaattttgatgagtattcagtgcttaagtttagttaacatttaactaagtaaatttagagtttataggattaaaattgtatcggagataggctaaataggggtttaattaaggatagcactattcattgcacatgaggtgtttgatggagttcctagccaccctagccctcttcctccccactgccacgcctcgcactttccctagccctgacgcgccgctgccttgcaccccacgccgccgcacgccgtcgtgtcgccgtcgctgtcgccatcgctcagacgcgccgcgcgccgtcgcttcgctctgcgcgtgccgctgccgcgccccctcgcacgccgtcgtgccgtgcgccgtcgccgtctccggtcgcatcgcctcgagccccacccctccgcgcgtcacgtcgccgtcgcgtcgtcatcattaccgcgccgcgtgccgtcgccatcgccgtcccgccgactccactgccgcgccgtgcaccgtcctgtcgccgcgccgcgctccatcgcgacgccgtcgcccttgagccccgcgccgctgccacgccatcgcgtcaccgccgttgccatcaccgcctcgagccccgcccgcgccatcgtgctcgccgtcccaatgctgcgccgcgccgttccatcgccgcgcgtcgccatcgccccgagccccgcgccgccgcgccatcccgtcgacgattaaaagccggccacccctcccccgagccctataaatgccccctcccctttcccttccctccccacgccatttcccactcttctcccctttttcccctttcttcacctccaccgacgccgcattccgccgccgcgccgccgctgccgtgccccggcgcctcgcccccgctgcgccgcaccctgccgccgcgtccccgtcgaccccgccgtcggtccggtgagccttcccctcccccaccgcttgacgccgcgccgcgccgcccgccggttccagcagagccgtgtgaagagagagaggaagcagagaggtagcagagagagagaaaagagaaaggagaggagagattagagtgggccccacgtgtttagtgaatagtaatccccttcttaatctttattagttgagtctattacaagtgggttcgggttgttaaaaatctaattatagaggttttataatctcgagtctatgacatgcgggccctaccgggtttaatggccggtttgaccctagtcaaaggaatcgggcccacctgtcatttgcccatatgattcctttagaaagaaaaataaaataaaagaaaagaaaataggaagaccccacctgtcagtcactatagcctgtggataaggttgtattaaaaataactgaattaggaacagtaccatttcgcaattattagaattaattcaaatttgaatctttacactagcataacttattcattttagctccgatttgagtgaaacttgaacctaaattcatctaaattcacaagctttccaatggtatataattcactatttaataaaatatatttataattattcataattaatatcaagatgatgcataatagttaacttaaaaatgtgctaataataaaattgatattgtactttaagtagatgtcaaataattgtctttaacatgctttctcactataaaacctatgtaaactaactaggagcattgtttcaaattaattaaagcataggaaatattagtgacatttattagtctatgtccaaatataactaaacctatgacttataaattatttacataagtttagcctcatactttgtaactaaaatataaacacacttagatgaaccttcaacttgtctaaggagaataataactgagctagttgtaattggaccacttaaaagttagtcggtataatgtcatgtgaagtggaatatatatagttcggttgacatccattagttaacaaaacagagccatcttaatcacatatatcgtatagcttctagtaaatagcaactattcagtaaaggatccaatgattaaatattgttgcacacacatacattgtacatcccaatttagatgtacggcatatcaaaaacctacccttttgtgtatagtaaactaatgagtctatgacaaacatctatagtggataaaatactagttataaatcttgacctaatataattgtaaattaggattattcattgtaaaattatgtgatgggatagtccgtaaccataatatgattaacctaaacaattctaacatacaaagcatgggtaattgttaacctttataatttattttgacaagtaaaatatgtacataattaaaataaagcctccatcaataaaataataatacaaatgattcacagtaattatttgaccgatccaaatccatccggcaacagaacctctagtgtataaccgttctatttagatagatgcatgaatagccatttgctagactaaaccacatagtagccagatacgtatctcattcatactacattggttagctcctatatagaccatcatgacaacataaagattaagaaactttagcccttagcatgttggaatccattagcaagcgcgaataatatgagcaaccttaggttcgacctcaacaaatatattttgtttgtgcatatttgattgttgcttgaatattggtttttttttctcgcgtattctagactgtgtatcg

SEQ ID NO: 68530 - DNA, 9658 bp, Oryza sativa
  unsure (1)..(9658): unsure at all n locations
nnnnnnnnnnnnnnnnnnnnnnnnnnnnnnnnnnnnnnnnnnnnnnntccactcctctttgctaatcctgttatccttgtcagtgtcagcatcctcaaatgtctgcagaataactcaattagagattcctagtgctaggtgaataaacaaaaaagggctcaaggagaagaaaatgttaataccttgtctagtatggcttccacaagatcatcagacagctgcacctctgactccaataaggtagcaacaaccatttgttttacctgaacgagaaaaaaaaaaggagctttgtggttagttttaacttcacactggaagcatatgctgcagagctggcttgtctacatttcagaattccttacatttaagagtcaagacttattatgatttatttcatgtcgtgactttatatagtttactcatcaagtttcacaaggaaactacaagaattacaagatgatagcgtggttcctgaagatgacaaaagctgtcaccagtttcagtaattcgtgaaaaggttcaataagaaactcgaaggattccaattatttagcaattggcaaacatgcgaacagaaatgatcaaatgatgctgcctcgaagctgggggatagaaagactgacactgatatggcaaagtcttgagtaccaaaagttctcacacaataaacttcatacaagattaatcaatggcttaacatatctgttcaaaagtcaaactgatgtatttgcaaaacaatagagcatacctcttcacgttcaatgaaaccggtttgcctcaaatcatataatctgaatgaaactgaaagaagcacaaaacccccaaaagaattaatggttgatatataattcaacatataaagaaattcttgatgatcaccgagatgaagcacacttacaatcaattttgtcttcaagaggagtattaggatgaaatacacttattgcgtgaataaactcttcaaattcaataacagaatttttcttttcatcaaacagatcaaaaacctaaatggagaagaaaagctaactcaaatggtagcaaaaaaaaaatcaaaaattgaatttgttttaatcataatatgtaatcagagcttgtgtcttgacattaccacaaagcattgcctaacaaataatacagtaggtaacaagaacaacgggtttgaattaagatctttactttgcaaggaacatcattccctatttaattctttgcatcatacgtagagctcaaagtatgtgttcaaagcaagtaaaatgatgaaactatgagagtctgtcaattagttggtcatcctaggaaactcaaaacaaaacaactcttaaaatgcttcagtggccaaatgcccaaataggtaacggcggtatttgagcggagaggagttcgagaataagcctttttcacttactctatctagaaaaagattctttccagccggtgttctaaacaaggctaattgcagctcttcctgaaaaaacaagtacaaacattcacagttagtgaccaaaaaaaggtaacactataacattttccactgtaaaatcttcacctggaagatatcatccagttacaagcgtacaattatagaaattctattggggctagtcgcagcatatctttctatctctgatgtttacatgtctactctccatgtaaacatttgacatttcggtcattttttccttttctgctctccgtaaattactaactagcaagtccttttcaacatgcatgagggcaccatactaaactactggattgcaacctggttaacccgtcctaattggttcaaaagacttgttagtttattttttttccttgttgaataactaaaatgaagaattccagtgtccttttcctttttgcaagtagaagagttacagagtttagtaaaccgaaatctactagcatcgtaaccatagttccaattctgcagtatggatcgaccaaactgaaccaatgggctaaaaagaatcaaaggagtacacgtctcaccaaatgtgctgtaaaagaagaagaagaatagtttatcattaaccttatggatcaggccgtcatcgacgatggagcagctgatcttcttgtagagctcgtacagtgcctccacctcgttcaccgagactgccggcgatcacaacccgatgataccatattaccatttaaggccacggacgaaacgcagaagctgaacaggggtgggcggctctgtacttacagcagcgggactcgtcggcgaggtcggcgagctcacggaaggtgaggcggccaccggcgcggcggcgcgcgcgggcggcgagtgtagcgggcagcagccccggcgggcgcttctggaagcattgcgccgccgcgaacacgaccgcgtccaccagggcgagcaccggaatcagcgccgcgcacgcgagctcccccagcgtcagagagctccccgaatcctaccaaatcccgcaattccgcagacgacgacgtaaacagatcagaagtcagaacgagcacgagacccacaagaggggaaaacagaagacccagatgaaatgcagcggcggcaagccgcggggggcgcgctactacgacttacgagagagttggaggagcgggaggagtccatcggccgtgccgccggcggcgaaccatcgagtggcgggggcctgcctcctcggcgtacgtcgttgcagctcgcggcgggcgcggtaatgccgtcgaagtggggaatttccggattggcgggtctggggtgtccgtgaaattgctgtggatggatcaagttcgggcagatgcgtgagtgggttcgatacgatttgccgcttggcgtcatccaatcaatcattcacagatccaccgtggcaacacgccggcctcgctgcaaaatgattggctcaccggttttaatttggttggttggtctacgcatgacctgcctacaccgtgtttagttccaaagtttttcttcaaactttcaactttttcatcacatcaaaacttttctacttacaaacttttaattttggtgtgaactaaacacagccttaaaacaagtttaatagtatagccaactaccggctccaaatcatttatagtcaattttatagctaatttatacaatagttacctatacacatgtactacataattagtatctggtcccacatgtcatacacatgtatcttggagtctgtgctatagctagctacaaatctacatcatgttgctcttctctctcctattttatatcattaaaatatgtttatagctggtttgtagtctgctattatatctactcttaataaatatactctgggagtactgccatctttttggaaatatactctgggagtactgccatctttttggcaagaggacaggggatcaatgcattaagaagactagaaaaggacagagtcaatggcaaatggccaaaactaagagaaaatggagggcctgccaaaataaatcttgccaagttttgacaatgccaaaattttggcaacatagcaatattatcaaaattttggcagaatttcttatgtattgaccaaatttagctacaaactaaacgtagatatttttttggcaactttatcgaaaaatggtatggttgaaaatgacatcaaagtgaacaggcccggagataaacatgaagccagtttggatttataccaaaacttgccttaatagcttctaattgtttggattaaagccaacatttgccaaatcaattgagataagacaacattatcctatcaaaatttgatagcaccaaaatttgtccaagatttatcgctatcaataatttggtaaagtagcaaaccaaaatggcccaatgtatcccatcctatccggacttcgttttggagaatcatatttctttcctttcaaatatttgagcgtttgtataaatcacattgccgttagaaattcctacttcaaatttggagggtttgtttgtttttgttgttgttgttgttttctcaatatgttggtactaactattccctctagtcaaatatatttgatgtcggaagaactacttttttcttagttggaaggagtacaaagttagtatgtctaaaaaaactgccatgaaaatattttcaaataaggatcaaacagtactaatgcgtagagctgatcgattttcaagtatgaccaagtttaagtctcaaaacatatgaacatcttaaagaaatcatcaaatgagagtcattcttgtattcttaatttctggtttggtagacttgtatttatactgtgaaacagatggaatcaagtacaaacgagtagttgtgcataaatcagattgtaggaggcgataggagacgtctagtgctatctctgtaacacaactattcagtactatctctgtaacacgactattcagtagcatcttgatgagtaatacaatcctgctgtttagtactttaacacttctgcttcttctgtaaagatgaagcataagtaggcccatatgacagaactgcctcaactggtgccactcattctccgttcaataggaaatgtcatcactcatccctaaatattcataaatattcttatggatggatacaaaagctaatagagtaatagccaccattttctttcctatttttctttttatttccctatatggatagagcgcatgcgcaagatggatcataactttttttcttgtattcagcagtgtagcaatgctagtcaataaagctaatttcacctttgaacgggaatggggaagcaatgaagtacagaattacaggagaaggtggcagctgaggagagaatcaggagctgtcacaactcacaaagctatatacaagttcagaagctgaacgagaagagagcatgcttccctcctacaggaagcattatgacttcttggtgctgttttacaaatctgggtgattattggaagatcatgcggtagcagctgcagcttcttctgcgacttgggatccctgttgcagagtgcagatgaggttgcgatccccatacacattgtccacgcgacctggtaagagcacagacacggcagaatagagattaggttggtgtcaaattgtgttgagcaaagagcaatcttttggagacacagaagcaagcaagtacatgttgttggccagaacttggcgccccgaagccacgctgcagggaacgcagcgtactccctggagtacggcttagtccatgagtcgctcatcagaagttggggcgggtgaggagcactctgcaaaacaacgaaacaaaacaagaatcacatgtcaacatcctggtgatgcaagagctatgcagccacctgaagttgagtttagaccatgctaatgtatgcatctccaaaattgcaaacagcatgaggactaggattgaacagggtctactaacatcttatataacctataagaattgggggtaagaatacaattgcccgtatatagatagataggtgttacgaacttgcaatctaatataagaaaacagatagcaatatactggtattttaccttgaggacattgttgttcacatctgctttgccactttcgatttctgcaatttcttccctgattgagattagagcatcacagaacctgtctagttcggcctgcgaaataaataatgtgacattaagttcatataaaagaatggttggtacaatggcaaggaatatagtaggtgttttagtgttttaccttgctttcactttcagtgggttcaatcataagtgtgcctggaacaggccatgacatagtaggtgcatggaatccatagtccatcaaacgctttgcaacatcctctggctctataccagcagtcgtctgcaaaaagttccaatatccaattaacaaaatggaaatgcataactcaatgtccaaatgccaaaatacctatgttggataccttaaatcctcttaaatcaatgatgaattcatgggcaacagttccattgactccacggaaaagaactgggtagtgtttctgtacaagtaacatggtaaaacttagaaaactagttcaaacacaatcaaactaggtagcaatgggtaagtgatcacgagtaacaaatatacctccagacgctttgccatgtagtttgcattcaagattgcaatctttgaagcatcagtgagacccttagaacccatcatggctatgtatgtgtaggaaattggcagaatcaacgctgatccccatggggcagcagaaatggtaccaagagggtcggttttctcagggagagggaagccaccagtggtgatctgataattacagaattagtctggttaatgaagcagcatctgcttttttggttaaaaagaatgatggaattatgaacgaactcttctggttttagtaccaaatgtggttttgtagttttatcatcaacaaaaacttctacagcagtttttacataatatcaccctactatgcttttgatatgaaaaatgatgcaggcaactcttgcttcaggagtttaggttaatatgaaatgaaaataaggtggcacttagcatacccatctaagctaatgtggcaccaagaaagcaagaaaataaaaccagcaatagttctcgagttgcaggagttaggattacaaagaaactagtttttaaagatcaacacagcattgttgatgacatagggaaatgtatgtttgtgtggaatcctctgaaaaatataaaagactcgttgttgagtgtaacatgattacgtataatttgcctaattctgtaagaaagtaaagatggaaattttctaaggtcgcctggcattatgtgctatatcaatcttgtctaatatttcaaggtaagagttgggcattgatcattagtctgtttagattatcagcagattgaattcagagcacctaccactggatgagatggtaaaaatggtgctaagtgcttcttaacaccaataggacccattccaggaccacccccaccatgtggaatgcagaatgtcttgtgaaggttaaggtggcaaacatctgctccaataagccagggcttgtcaatccgacctgtaaaaagacaacttctgttagttagggagtgtattgaatatttttggctcgacagatggggttgtttgaaattactataacagaagttctcaattgggatcagatgaacttggagaaagcttatcatattttattgaagataacatagctcagcataattaattggataagggtcatcaatcaccatcattgaaagataaacatgaaaatgaaagttggtacttatgtgtttgtttcaaaacaaggtatacttgtgtttggaactgaattaaaatagacttgttactaaacatgtttagtataattcataggcacaactaattggttttttttaatcaacaccatgtcaaaaagccatctatacaatttatatagcctcaccacaatgcgttccaatccatcaaaattgtaaaaagacttgaagagagcaatttcagaaagagcgtgctagtctgatgacatgataaactgcaaagaactaacctgagcattcatgttagccccatccatgtatacctgcccaccgttctcatgaattatcctgcatatctcatcaatgccttcttcatagactccatgggtcgaaggataggtaacctgacgaacagagcaaccacgcaacattctgttactctacgcacaaggccaacatatttcaaaaacttgttttataaatcaaatcatcctgagtgaactattatgtttctatgcccataataaaaatcttattcacaaatcacctgcgggctctagcctatatggaaatagataaactaaactaaccggggatttgtttctattatatatgtcaattaacttcaaattattgaatgtacacagccactttagggaccatgttatggagcagctatctggtttctatcttaatatatattagaagcaacaaaaagtacagaaatagccttatgactttaagcaacacactaaatatagcgaaaaggtgatgcagtgatagtatagtattagaaaactagctctaaatttaacagtgaatagttgaccagaaagaccataggcattccacattactacctgaagacctgataaatgataacatttacagagcaaaaggaacagtaccataagagcagccaagttgtccttgtttgcttcagcagctttcctcaactcctcgatgttaatgttacctttggaatcagttccaacagcaacgatcttcattccacacatagcagcacttgcaggatttgtaccatgggctgacacaggaatgatacagacgtcccggtggtagtctcctcttgcctgcagtttttataacatggtttgtaaatataaaatgtgaaacaaaacaggagagctatgccagcttatttatgatgacttaccctgtggtaagcacggataaccatcaatccggcatactcccctgatgcaccagcatttggttgcaaagagaaagaatcaaagccagtgatcttgcacagcagatcgcccaagtcatcaaacatttccttcatgacaaaacaagccatttcagatcatctgatgaacagtttgcatttagaaactaaataaatggtgaattccctcacatgatatcctgcggcttgttcagtaggtgcaaatgggtgcatgtttgcaaagctggggtaggtgacgggcatcatctccactgtagcatttagtttcatagtgcaagaaccaagagggatcatactgtggcacagtgaaagatccttggattgcaacttgtgcaggtatcggagaagctcgtgctctgtatggtacctggaagcccacaacataagttcagtttaatcttaacaccgcaagaaatcagtgaagaaaagcagcatgccttttaacatcacatacatgttaaagatcgggtgtgttaagtaggggctcttgcgcacaaggctactcggaattgagcttgacacctctgatgcgagggattcagcagtgaagttcacctaaaaatgattataacgacacgatgttttaatatcatgatccaatttcacatcaagcacacaaattttgcgccgattgaatgattacttactggcttgccaccattgaacaccttgaacagcttgtcgacatcctctaaggttgtggtctcatcaaaggccacggttatctgcaacatcacagcttgaatttaatgctcaacactcaacatcaactaactcggttgcaatagaacggaaaatgtcaacagaaagcgaaccgtggttgcatcaacaacacgaaggttcatctcgttcttgcaggcctcctgggcaatcgcattcgcatcagcgaccttgaccttgacagtgtcaaagaacggcagttcctgcacagtcactgttccgagcttcttcagtccatgggcaaaggtaccagccaggccgtgtacacggtcggcaattgcctttagcccctcgggaccatggtagacagcatacatcgctgccatgttggcgagcaaggcctacagagtataaaccacaggcatctttatcactactgactcctctacgaaaaagtgcttgtttactaaattcatcgtatctcttatcgtctctgtcgctatctggcaatttggtcaacgcgtggcgtgcgttgcgtgcgtgtacctgggcagtgcagatgttgctggtggccttgtc

SEQ ID NO: 68531 - DNA, 14528 bp, Oryza sativa
ggatgccgttgcacatggccatggcctcggcggcggcggtggcctcgtcaagcagcgaggcgttggacatgggcaggccggtgaggtcggcgaccatggtctggtagttgagcagcgactcgagacggccctgcgcgatctccgcctggtacggcgtgtactgcgtgtaccacgcggggttctccatgaggttgcgcagtatcaccgcggggacgtgggtgttgtagtaccccatcccgatgaaggacttgtaggccttgttcatggccgccaggcgctgcatgtggtcaatcatctgggactcggtaaacccggcgtcgaacttcccggagaagtgcatcgtcggcgcgcggatggcggccgggacggtggcgtcgatgagcgcgtcgagggtgttgaacccgcactccgacgccatcgccgcctgctccgccggcgtggccgagttgtgcctccgcgggaacgtgtcgctcggctgcagcgccgacgccgacacgggccgccccgtggtgtactggtggggcgccgggcgcggggcgcgcgggcgcgaccccgccccgggcgccttggccagggtcgagatgccgcgggacggggccggggacgtggtggacgccgccgccgcgaggaggcggcgcagcagggcgcggttggcgaggcggcgtgcgcgctccatcctgagattggaggtgggagaacacgaggagcaggaaatggaagtcccccggtgagggcctccactcctgccgagaagagcggctgtgtggtttgggtgctcggttacggagtgatttggttggctaatatatatcggcgcattgtgagagaggggaaaaaaaaacaggcgtttttctttctttctccggtgacgagcagccgccaagttattgtggagtgaggtggagaacacgggagatgtttttcccctccgaccggtgatgacgtgggcgctgacacagttatttgcaacgggaggcggaggaagcggatggcgtttggatggacgaggaggcgagccggtgccggtatataaggccccgccacagaatcgagcacgtcgctcgcggcgaccgtgggaacatgcggggaggagcggtatcagggggtgactcgagggagagggagagctgcgggcacgacgcgcgggcgacgccggtgcggcgggagccttatcgctttccccgcagaaaatttgtgcgcgcaggggaaatcggcagcgcgcccgcgaggacgcattttttgcggcgtccgttccaccgggggtcggggactccacctcacctcggtgtggcagcggcaaacgcccggtacgacggaactagtcgccaaaacagcgcggcgctagcgaccgcgaccgcggacggagcgagggatctagctaacgtaaccagattcaagcatgggcggggacgggaacacgtgggtcgcgggggtgggcgctgcacagtgcacccagcagcgcggctcgtcggtccgatccgcccactgacgcgcggggtcgctgagtacggttggcgatggtgcatcggtgagtcagcgacggccgtgtgtggtttggtggatctgcggggtggggcctggacgacgttggttgggatcacctaccgccaaagaatctctcggaacccgtggggtgggaggccgggtgtcgctgttccaccaaacctccttccggctgctcagttgctcgtacatagaaaaaccgtttttctttgctaaatttgattggcaatactgcgtatagaagtgcattttttttagtacaactatggtcaggccagccttacttgtaggtgatctttctctttccgtttgagttcctcccttggctacaaagtaaaaggagcaaaattcaaccagaccacaatagcgcggtttaagaagcaagctattctacgaaaaagtcattgccactgaaggaaagcattaatagaatcaattgttttccatccctgatgggatgaatcgcatctaaatattaggatacacttactattgtaggatggaaattggtcaattatagctagcacagtaactgtttggcatttgcttaagtacttttatgtttctcacctaaaaatacttgcctcgcaggtgccctagaaaaagcacaaccaaattcaaatttttttttcatattcgtgtagaatttgagctatgatttgtggcattgtttagtaacttttttctagtaggctcataattgtctagcgtggcaattgttgggtggatcattttcaagaggaattttacggtacattatactacaagtatatactagcagtataaacgatctaacggtgaagattaatctgatattccacccggttagctttgcaatataaattcaaaaggggtatatttgtcttttcatctttctgtgtgggggtatttttgtatttttcgcgtttttgttacttggtcagatcccgatcgagagaaatccagtcgatttgtcgttcgaaagaaatggcgaatcgagagaaatccgctccattccccttccttcaccacatgggctaccgccgccgccgccagccaccgtgagcacgctgcgccccgggccaccgcaagccgggattgattcgatttcctgtcctttccttctcttctgtcattcccgcgcacctaagaagcagcagcaacagtgtagggcatccgggcggcggcagcatataccaggggcaaccgggcaaggcacacagccaggatgggcaggcagtaggaggaggcaagcccaactcgccgtctctccatgcaggattagaactggcaaatcatcccgtcatgaactaattattgaatgagaaattttgaagtaatcaacatagtagatactgagaaccaactggatatatctggcaaaaaaattatggctatctcagtaattatgatgagatgatattcccacagtcaagtgatcaaccgttagttatttttcatgactgaattaaccttgcattatgaccggaaagcaccattatttctacatatcgggatcatgtacaccaaacataagtaatttagacatcgatcgagccgtcgccacacgagatgtctccagaacaaacgctaccaaatgcacggacgacaagatccatgacaagtacttccgattgaaataaattaatttgaacttcacatgactaaatagccatttccagttgtttaacaaataccaaacatacccttctatatactgctagtatatacttgcagtacaatataccgtaaaagtcctccatttttaaacctttttcatcaggaatgttgtgtaatatagttgtgtgattccttccaatataaaatatttcgtccatgttaaaatataagggcatccacaatatctataaaaagttatccatataactcaatatggcatgcctcatcattataaaagtgatcatataatagtctatatgataagctattcatatacataaaacttggctttaagaaataaataatgataatttctctctctctctcgcccccctccctcattgcttcattggttcctaattgagtgggactaaagctaatgtcttctcttactccctctatcctataatataagacatggtcaaaattggcacggtcttcaaaactaatctttagcttataatttctcatatactataaggtttttagcaatacaattataaccatataaaagtaaatttaaatctcaatttaatgatataatttttaacaaataaagtttatttcatattatactaagtgttggtcaaatgtttaaaggttgaatcttcaaatgcatatgcaccttatattatggaatggagggagtactatatacctaattcattgcagcaactgctttatgacctactccctccgtcccataaaaaaccaacacagtactggatgtgacatatcctagtactacgaatctggacggaggtatgtccagattcattgtactataatactccctccgttccaaaaaaagacaaaccctggattccgtgcccaatgtttgaccgtccgtcttatttgaaaaaattatgaaaaaaattaaaaagacaagtcacgcataaaatattaatcatgttttatcatctaacaacaatgaaaatacgaattataaaaaaatttcatacaagacggacagtcaaagttggacacggaaacccagggtttgtctttttttgggacggagggagtatgtcacatccagtaatagattcactttttttttttaggacggagtgagtatgggatattatatattgaacatatcctatgaatttttttatgtattttttaaaaatgtatctagacaccacttgaggaactattttttcaactaaaactaaatatacattataacctagtttcatttcatggtccccgactccccgttgtccatccttgtatctgcagagaccatgtactacgcaatgcaagtggtttgtgcacatagcatgtccatttgttaatggaacaaacaaacaaataaacaatatggtcagtgggactgagagtatcaagtgcttccacaaagttatttatggaacaaacaaacaactttgcccagtccactgtacctagtggtgtcacaaagcgagaagccatggcacacaaaaaaactaaagaaaatcacataataacaggaaaagattgcactaaccaagtggagtgatatgattctcaataaaaacgaggaagggggaaaaatagtgcttggccccagataattatggacgagatgaaaacaacatgtatggtaaccatacttcgtgggaagatttttcttcgtttagcatctgtagaacctacacaaatatttggctagattttcctggagtcttatcgtgccaaaaaggaattttcaggttcaagtattttctattgagttccatgtgtcaaatatcattagctcaactatcacatacgtatcttcaggtactcagtaaggtctaatcgtcaaagatgtggatcaaattaatgatcaatgcgagtgaatcctattccacgctgggggacagaatattctcatacatgcataaatgcatcgagttcatcagaacttgcagtctgcagctactggatgaacaagtgatcgatataggaacaactgaaaaatactcacatattacaaatcgaaccgatcataagaaattaagctgaaatttttgttgcaacatgatcagcatcttgagacatatattctctcttcttctccgctggatctgctcgctacacggttacgcatgcaactggccatagttggtgatctaacttgagctcgagtggccaacaaattacaaggcggtcgagctatgaaaacgcaagttcataaatcacaatcgttgcagggattctgaggctgtttggttgccaccgtgaggaggataagcctggctggacgtgcgcctgtgtcacaccggaccccggcaggtgtgtggtgtgagtgtgtgactgacatacgagtgtgaggcaggggaaatttcgggcccaaaacgtgccaggcggatccgggcttctcgtcacgtctctctccctcacagccctgccgcgcatggccctgagcgacgcagctaataaacttttgggccggggttgaaactgatactctggacgaatcgctcgcgcgcacgcgcttccagtttgccactcctgtcttcgctaatgcacagacgcgccgcgcggattggcagttcatccagactactcgagtctgggagtgggagcgagacgtaggtgaccatttcgccgaaggcattcaagtattcaacggacaacttttcttcgccggtcacggagggcttaactttacatacggcgaaaattgcatttcaccgagagacctccgtgcaaaatgcacaaacagcgtcgcgtgccacatcaccttgctgccctccacttgggtggcagggtatatttttgcaaatattttcaccgatataatatttttgtaaatattaaaaaaattaaaaatgaaaaaaaatcgtctctctttgacgcaccactcggagcggccaaatggaccgtagaagaaggctgaatagaacaagttcactttaggtctctctgtttgtcgtcgagtcctaaaattgtccctgaaccgcaataccacatataacatgtttctaaacttccaaaaccggtataaataaggtcttaaagcggtttggatgacggctgcagctgacatggttcatcacgagagagatccctttctagtggaggggcagggggatcctagcattgagggtccctatgatgaccttattgtgacacatgctcggaatgatgatgccctctctgctgctcttttgtcgcgactcctcgagcaacaagggccgactccagctgctcagattcagtcgtcggtggtggtcggatgcactccgatgatggatgttgttgttccaccacgactgggtgctcgcctttgagagccaacaaggtgttccccttccatccaatccctcattggaagctcccacctgccaacatcgggccctccctaaggtagcattgcaaggaaagtaacttgcaggaggtcctccgcctactcgccactcgctcggcaccggggcaggcctctcctacagagcacttcggctaggtccttgacctcgttgccgccaagagggccgttttggaggggtaggcgggtgcacgcgcacgcggtggccatgggctcattgggcgatgacgacctccaccactaacgctgacttcctccttcgtgccactgccggtcgctgccgcccacaccttgtgtcttcgcgcactgcatgcagtgcctactgcctcgtcgtctacgccctgctcccgccaagaaaaagggagagaaaccgagagaagaaggagatgatgtgttactggcatgtgaggtccaccaattttttttaaaaaatagattgaattgtcctgacatgtgggtccctgctaactcagccaccacatcaactgaaactggacattattccgtctgggatctcgagtacaccggttttgtaaattgagggacacgttatatctgttattatagttcaggatgaatttcaaacttggcaacaaattcatggacctaaagggaacttattccctgcatgtttgaattgtaatacaaacttggccctgtctacgttcgttggacagaaaacaaaaggagttgataatttccattgatcacaggtacctgacatgtcacatgccacagaatcatgatggcagaaaactaacatctaaacggcagcacctcttgttaacaacatccattggattttttgggaaggaaagctggaaactgtcaccacagcttcaagagcttgaggcattggtggacctagtggtgtcctccgagatggaaggggatgactcgtaggagtggccaacctgcgacggcgacgccgagtacctgctcctcttgctccccctgtccctgatgtcctcgatcatcttggccaccaccgccatcctcggccgctcgccggggtcgtcggcgacgcacagcagcgccacatggaggagcgccaccatctcgtcctccgcgccgcccctgctcggcagcagctccacgtcgaacacctccgaggtccactcctcgcgcaccaccgtgcgcgcccacagcgccaggtccacgttgccgtcctccggcgaccgccccgtcaggatctcaagcaggacgaccccgaacgcgtgcacgtcctgcttctgcgcggcctcgtccgccgccggggccgggacgagcagctgcagcagggcgaagtcggagacgcgcgcgttgccgccggcgtcgacgaggatgttggaggaggtgaggtgccggtgggcgagcttgccgccggacacgccgtggaggtacgcgagcccctgcgccgcgtcctgcgccagcttcagcctcgtctgccactccagtggaacacgcgccggtcctcggttctctgaaagaatccgttgccatcgtcatcatgtagacattgatgagaagaagccatgagaggagtcaggagagagagggttacggaccatggaggaggctgtggaggctgccattggggacgtagtcgaagacgaggaggagctcgtctgccgacgcgtagaaggcgcgaaggctgacgacgttggcgtgccgccacgtgcccatctcccgcgcgagcttccgcttccgccgctcgtcctcccgggtcgcgccttccctccgccgcatcctcttcaccaccaccacctcgccagccttgccctcctcgacgacgctggcgtcgtccacgatgacgttgtcgcctcccatggccacgcggtacgtcgtcgccgtcgcgcccttgcccagcatctccgcggcgccccgcatgagcgtgcacacgtcgaactccacgcagcagccgtcgaagcgcaccgtctcctcccgcgccatcgagctggtgcgtgagctggcgcgcggcctctccggcttcttgttcttcagccacagtacgccgcagagtgccgcggcgaccagcgatgccactgctgcgcccaccgccgccatgatcatcgccaccatccaccggtcattgctcctcctcctccctctcttcggttggtgtgacgtgtcagcgccgctgccgccgccgccgtacaccatgtggagctgctcattgcaccggcggcgcagaggggcaccgcaaagttcggggttgccggtgaacgaagacgcggggaagacggcggcgaggcgcttggggatccggccctggaggtggttaccggagacgttgagcttggcaagcctggccattgctcccagcgaggccggcaagggcccgacgagcgagttgcgcgcaagatgcagcgtcaggagagaagggagccggtgtcctatctccggcggaatcgtgcaggtaagccgattgccagagaggtcgagacggcgcagatggcgaagccgtagcacggactccggaaaccgcccggagaagccattgccggagagatagaggagcttgaggtgcggcgccaaggtggagaagtcgacgtcaccgagagagcccgtaaacgagttgttcttgaggctaaggaacgagagcatagggaggccagcgagcgcggcgacggctccagcatccccgccgaggcggaggccttcgagaacaacgcgacggacgcgaggaggtgacgacggcggcggcgaaggcgaaggcttccggcaagtgatgccacgccacctgtcggagcaggggtcggaggcctccgtccaggagacgagcgcggcggcagggtcggcgcacgccgacttgaaggcgagcaatggcacggcgtcgggactgatcggagcagcgacggcgaggcagctcgcggggaacgccgacagcatcaagaagagcacgcgcaacgccattttgtagtgcgtgcgtgtgtgcaaggcagatgatgcaaacggaacgtaagggagaagcaaattagttcatgtagtagtatgcagcagaagaacgcagcgccattgttgtgttctacccagaagcaaacgggactttgttcgtgtatccagcaaggaagctgggagcagaggagttgatggtgcaacgtgcaagtgcgtgagcgattaatgggcgcgcgcgtggctgcgtggggaagagactgcgggagaggggagaggagacggagcgcgtcgcgtgcggcgtgagcccatttgcgcacccgtgcgcaccggcccgtgcttggttttcacgggagccaaaggatttcacgcattcacagtttccttcaccggagtcgcgtacggatggttctgcttaaagccggtagcgctcgtgtcttttctgccattaattgcagcaacgaagcaaacctaattcttcagcgtttcctagtcaggtttcccaaaccgccgggaccggggttaccgcgtcccgacggtaagtacggttaccacgtgttaaccgcggtaaccatgaaaaaccgtataaaatttattaaaaatttaaattatttttttaatttatttgaatttaaggaggttaccgtagtatttatattatcgtacccgtagtaagctggtaaccgtagaaacgacgcgagacagtaacgtaaaccctgtttcctactgggttattggtgcttgttttgcgtgtagtatctgagagagcgagcagaaatggccgggagatgggtgtgggtgatcggtgcttgttttgcttatccgagcgtcagtctgaacgagcgagcagaacatggccgggcggccgggcgatgctgctgctgcatggctctgcgcctctgccccatgtatatttaatttacttggggaaaaggagtaatttttttctgtcaccatatgttggctcactggtctcattggtctggccttcagctgggggccttcctggcttcctgcagtgagcagcagcttcagccttcagggcatgcacaaatattaagggcccttcagtcaaaggaattataaaggaatttcataggattgaaatgctacaggaaattttactatgtagccctttgatttaaaggatttgagtttttcaaatcctacaaaattcctatggaatggcttgttgcatataggttttaaaggaaacttagcgagaggtccaacctcttggtaaaaattctttgagtatatctctctcatccgattcctgtgtttttcctgtggtccaatcaaacgatcattcctatgttttgcaatcatctgttttacatttacattcctattagaatcctatgtttttcctattcctccgtttttttcattctacgattcaaaggggcccttagacagataccattcccataaacctgtagagagagaaatagcttaatattcaatatacaatactagtacattatatcatgcatttcacgcgactatgactactcgctccgttcttaaaaaaaggtaacatagtacaacgaatctggacatagtacgcggttgacatttttttatggatagaatatcactttattaaatatataaatgtttacctatataataattattagacaaaatttataataaaaaataacaatgtaaacaaagaacatggctaaggaaagacggaaagtcaatggtagaaaataaaatcagcaggaagtctagatagaatgaaaaatctattctctttattattacatgaaaaacacgtgtgagcacatatcactgctctatattcacacacccttaagatacacttaaagaggtggtttcaattcaaagtgtactcgtatccatatgtgtgtaatattcatggtcatggtaccaagatttgattagtagtagtaactggagtcatgcatcccaccaccacaataccggcacttttccaaaagtatatttattttgatatgtaataaacaatattattatgacaaaaaaatcacttaaggtaatttaatgcaaacttttcattcacattttaaagtaaaaaaaccaattaaatttatatagttgctaaatatttgtcaagaggaagtgcgggaggagtaaaatttaccgtgcgcgcatgggaattgaacccccgacgtcccattcacatgcctcactaatcacatgtacccttatgcattttttataattatgtgaaagttttgtactccctccgtactcataaaggaagtcgttttgggcagcgacacggtctccaaaacacaactttgacttcttgtttctataaaattatttattgagaagtgatatatgtgtacttttatgaaagtatttttcaagacaaatctattcatataatttttacatattcaaactcaacaatttaagagttattcatgatttatattcccaaagtttgacttaaacattgtcctaaacaacttcctttataagtatggaggaagtataagttattacattgcaattgcgtaagttacccttatgcattcctaacccggtctctacaatgtaggaacttagctcatggaacaacccaatatgaaattcactcctttgaagatttgaacttcctataaaggtttgaactcaagatcttcaggtgctactcaagtcactagaatacatgtattttcacaatgtgcggcattgttgtgtgtaatatttgttatatcgtactttaatttagcgctaaaatacgtttttagttggaaaacgaatatgtgggttagggctttcagacaacgatggcccagtaaatatccaagaggatatgtggaagaatcaactttgaccactcctttatagttttactgccttctttatatctaacggcaggtattatatgttttgttgcctcctatgatccatatttttctaatgatgtggaaaaacgaagttgcaatttaggtttcaagaatagatattaaacaaccaacagcgtaatttttttttcaatctcttctctcttctctcttctctctctctctctctctcgtccacatcagcaaaaatgaatgccacattgctactccttttattctaaaataaaccaatcaacaaaataaatgctactctctattctaaaataaactataaatgaatctcaacatatttatataaaattggtttattttaggtcgagagagaacagaacattttttagttaacactgcaggtgtacttaaatgtgttgtgttcagctgtacctcttttgtctggccttttggttatgtcaagtttcttttcttttttatatttagaattttgacgcaattgtatgctaagaaagtaaaaggtgaacggaaggagtttacaatccgaacgaagggagttatttgcaaataaatagagaacatctaacaaataactaaaatgcttgatgcttcctacgatcgaatatttcttgggtgagcttgagttactacaacaacactaccaggaccggagcttcaattattctgtgcatcctgcaagaacgttcttgaactaaattcatcatccgagtatgtatgtgagcgaaaccaactaagctccggcaaattcgtgagcggtcccactgcagctagggcgatatcctgaagattgtcaaacaagtcatgtgagtgcatgaatcttccgtatagcttgttgagacagcaatagcaaagatgcactccagattattactaggaagatgccgagttttaccttgtcaattatgaaatccttagctgtttccattactgtatcacggtcaacagcatcaatgcgagcaaaaagctctaagaatggcattactcgcccatacgttagcatctgatccagatggtcgagggaatatacatagttaggaaaaatagtagcaactgcaacatgggcacttaagaaaatatttcattcaccatacctgacggccgttattttcagaaacagcagtggatccgtcaatgtgaagtaaaagagcagatttcaactgaaattaaataaatgttagctgttatccatccacttcactgaatgcagttctccttaacagatacaatacatagcttacaggcaggccaagaaagataaaacagaaaagctaccaaggcaccagaactgacttttaggttggtgctaaaatgtaggaaataattcaccacttcacaattagtataacaaatatttctagatgcaagttaattggcatatattataaaaaaacatgtatcagccatgaaactatgcagagttcgtacttaatgattactggtactgcataaagacatatcatacatataaatataaaactaaccacaaactatcagtgtcatttaagggaaagtgaaacaggtctagtgaagttacaacgactgatcatcaggttgaaatcaactttcttgctattgtcctacatcagagcaacatgagcatagcagatatcatggtattgtctagtgaaaatgaagatgagttattgacaaaacaaaaaggaaagagcctaggaatattaaaaaggcaaaattttgcctactaataatgtaggagaatctactgtctgatttgccttctagaaaaatgttgtctaacaccacaaattcacagtagaaatgactcaatgggtaaaaactctgaattagcaacttgagatggataagcaacctgattacgagcacgagcaacctctgtttccgacacttcaaatgcaagtcttctaaattcttgcattattaactgtgataggtcatatagggaatccggctgcaatcatatttcacaaaatgtaagaaaacattataaaagggaatttttgatccaatgcatacctcagtttttttataatgtatgtgaaattaatagtgaacatagctagtattattactgattggcatcaagaagtaaggaaaatgtagcatactttactaaaactaatttaatgttccagctagctgaacaatttaaaagattgataaaccaaatttacctgagcaatagtgcagatgccaaacaatcctgtatctcggtagttagtgttgaatgcaatcatgctctcagctaaattaccgttgctgataccacgagctaaagcagaccttgcagttccaatagatcatatgagccttatgcagcagattagcaacaacacaacaaggcaagaaaattgttggtcaactaagcataatca

SEQ ID NO: 68532 - DNA, 5377 bp, Oryza sativa
acacggacctaaggatgatatagaaaagtagggaataggtccaaaagataaaatcaatccaaaaaggctaaaaatgactaataacatcttgacagctgaaaatggacctcagatccagtaaaaatagctggatttgcttcaacaagttgatctacagtagttgggtcagtagagaatcctgtaaaaaattctctcacttgatcaacaacctcatcatgattgacagctccagcagcagacacaacctaaaccaaccaggcaaaataaaacattcagcactagaatgctcggtgataacaaatcaatgcctgtaaatttcagaactggctgacaagtaccattcgaggacaggtatagtgagttgtaatgtattgctccaaatctttcttagagatcgatttaatattctctacaggacctaatattgtgtcacccagcggatgaccttggaatgctgcggcatgcaagtgatcaaatatcacctcgtccatcattccttgcacctgtctaaccataaacacatgtaagcacagatcaagcatccacgaaacacaatatatatattgtatattagatctgataagctaattgcacgggatcgagcatggatttgataagctaattgcactaaaccacagtatgcattcaggaagttatttaaaaactaggaaccgctacattcagacaatcagtgttcaagcatacttatcatcttggccaacaccacaaggctaatataaacaataccaaccatcacactatcagagcaggaaacatattttctttaaggaaaaaaaaatccattgtgcctaaagacaccagcctctacatgtacactgtaaaacaatgctgaaatagtgaaatatacaatcatccatacccataacgtgcaacctgagagttacggtcactatccaaaccaaatgcacttcctttgctgcaatagccgagaacaataccaaaaatgcagaagaaaaacatttgccacctacaaataagggtgttctacactcgtgcgacaaggatatcaagtttcacatcgactattaaattaaggaattgcattagacggcaaggaaggggacaaagcagcaaaagggtgcgacagctcacctcctccatctcgcggaggatgacgccgcgctcgcgctggagggcattcgcggggaagcacgggtactggaggatatcgcttaggacgtcgagcgcgatgggcacgtcccgcccctgcacatcggcgaagtaggtggtctgctcgcgggaggtgtaggcgttgaggcgcgcgcccatgttctcgatctccacctcgagcgcgttcgcggtgggccggcgcgtggtgcccttgaaggccatgtgctcgaggaagtgcgccgtgccgttggtgccgggcagctcgaaccggctgccggcgtcgacccagacgccgacggaggccatccgcgtggcggccgggtaggcctgcgtgacgatgcggaggcccgtggggagcgtggagacgcgcgcgtcggggaggcggaggaagggggagtggtcggggtcgcggggcaccggcgaggcgtggcggaggaagcggttgggggaaggggtcgcggggccggagtggaggaggcggtggaggtagggcagggcgagcctgcgcttcgatcgcacgatggaggtggccgccatgtgctcgcgccgccgcccgccgccgccgccgaggaggaggggggtttgggtttctcctcccgattattcttgcggcgggggaagggggcgaagggcggaaagctagcggaggaaaatatcaaagtctcgatgggtttagaaggaacggagtttctttttttaaaaaaaataaaataaaaagtaataataaaagaagcagagtcgaaaacatagtttgtgctttactgctttggttcggcaaagctgtttttaagcaaagaatcgtcgattcgtcgtaggctacatataccaaaatactataagaaagatgaaacaaaatataaataaggtatctcgttcgtaagtaagacttaagaacgatgttcaaaatcgacttcattagaaactacaacctccttgcccatatttttgctgacctttagacgacttgggacctctattttaaccaatacttgacgacttaggatttataggttggtgccatatattttctctggtttcacatataaggtttaaccatttatcttactagaaaaaaatactcgtgcattgcaacgggtgaagtcactgcgggagtttgtttggatatatatatttttagaaaattataagctgcagtccaattatctcaagttagcatgcgagttttttttaaacagatttcttatataattctttctgtattaccaaaagtgaacgatcttaaaaaccctactcaaatacagatatatattttcaaaaacaaacaaacttgaaaaccgactcatacatggatgacgtaccgaagcaaaagaagggaaggaacaaagctaataagaagtctgcattcttctccatctttccatccatttgtcactgattcctggtactgctagcttgtgtgtgtgcaaactccatcgtaagtatgtgtgattcgcccatgatttgcttgttcttgcttatgttctgttgtgtgtgtgtttccttcatttgttccacgcggagcagtatgccgtatgcttgcagaattattgtaagcttccttttctattttcaaaagcaagcaaacttaaaaactgacttatacacagatgacgtaccaaaatacgacaaaaacaacttcaatttttataatagtagagaagagatagagatatagaagagaagagatatagattaaaaccaaaacataaaattaaaactgactcaaacacatataacgaaccacgaaaacaccttcaatttttataaccgactcaaacacggatgacagatcgcggaaacatcttcaatttttataatatcagatattaaaaaaatacataaatatcattttattttaatgacttttttatcactagaaaaaatgcccgtgcgttgcaacgggtgaagtctattttaatcttattattgttgtatggtttagttaaaatgaaattcactgtgggagttcgcttggatatatatatatatatatatatatatatatatatatatatatatatataaaatcatgagctgcagttaggagtccgatcgtctcaagttagcatgtgagttttttttaaacagatttcttatatgattctttttgtattaccaaaagtgaacgatcttaaaaaccgactcaaatacggatatgtatttacaaaaacaaacgaacttaaaaaccgactcatacacggatgacgtatcaaaacaccggcaaaaacatcttcaatttttataatagtagagattaaagaatctacaatcttaatttatacttctatatactaaattataatataaacaaatgattaaatatttttttctatcaacatatggggtccaccttaaagtctgtatgatcatcaagcattgtggaacatgtagtaagactacactgcaacttaaacattgagcatgcacatggcaaatcttagtccttacagagtccctgtttggaattattcggggcaaatagagcgccacagttcatacacgaagatctttctttttgagtaaatttcagaaaaccgcatttacattgacaaaactactagtttactgcaacattagcgacctatttcagtttgctacaataatataataggaaattttcataaaactgtaacttttacatagcccaaacttattgttgtcacctagatgttttgtagcaacatatgacataaaagttgtagttttgtaataatttcccatgcagtattgtgaaaaatttccatgttatcattgtagatcgtttttatgctatagttgtagttttcttaaatttactcatctttttagctgggcgaacatgaaacaaagttcacatggatggatcttaacgggctaaatcacaaacatctctgtgcacaaagacacgaagccaagagggtctgaaactcaattgacaggcgaaaaccatgaggcaaatggcttatttcattgtgttcttacattaaccaaatccctagctcactcgtcctcacttattcatttttccacggcaagaaaataatacattttcttccaaaaaagaagataaatatgatacatggtgtgcttgggacaacaatgatggaagcccacatcactagataattcgtgttttttacacaaaaaataatgaatgcattggtggcaaaaatgaaagagaagaagtgggagtccgggatggttttttttcttattacacacgaccctttgcagatcagtgggaggcatcacggctataatactggtcaagggttttcgctggtatacggtgaagcagctctcggggaaagatgcgcagtagtgaccaggcgaggtcaagcgactggaagatgttgcgtgtgtcatatgctccttgtgtcacgaacttccgctcgaacttgtcaagaaactcgaggtacagctgtcatttttttcatagatcagttgattaggaggttaaaacttaaaataattaaggagtttaagaataacaatgtcaggtcatgcatgagggttaccaggtcctctgatgacagcgcttcctctccaaccactgccttcatcgcctgtacgtccttgcctatggcgtaattggcatacagctgaaacaaacacatccgagtaaatactccatatatatacttggttaaggtagtttgtgcagaacataggctatgaacgcccaaccgacctggttcgagacatcagaatgatccctgcgagtcatgccttcaccaatagcactctgcaagagatccggtcaagttataagcaaattatcaaccttatattgacgatgtcagtccctgcaaaactctaaagtaggatgtagagtgcggcagctttctttattgccaaaaaccttaccttcatgagccgggagagtgaaggaaggacattaatcggtggatagatctgccaaattgaaatcagcaataagatcagagagaactttttatatgccaactatttatgcttttactataaatagctaattaagtcttatcttattcttttgtcgtaatcaggaatccaaattttcggtttagaagtcatcaaacaaagtttagcaggaaactgtggaaatgtggaatacctgtcgattatgtagttgcctgtcaatgtagatctgtccctcagtgatataaccagtaagatcaggagttggatgtgtaatatctacaacagcacgacttatgagtcagaaagttgccggcagcatctaatatcagttatccatgtaacatttattctattaataaaactg

SEQ ID NO: 68533 - DNA, 733 bp, Oryza sativa
atgacagacaaaatagtctagagcacaacaaacaacagatcataacttgctttagatctaaccatctaggttctctgtataaacctatgttgtgctcgttttcccccttcaaacaggtaaggcaagacaacatttttcagaattatcatctttcaaaacgtccattttagctcaaagtgatagcagagaattcccaccatgtttctaatgtaaacactaggaaataacatatagcaagataaaggcccttacttcacgaagtgcatcggcatatgagctcatgtcagtcaggatgacaagaacatgcttcccgcactcatatgccaagtattctgctgtggtgagagcaattcttggggtgataatacgctcgatagttggatcatttgcctatgaacaaaaaatacaaaatcaaggagtaagttatagatcttgcaaattccttagagcagcatagtgaaggaaaagaaagaacaaaggtaatgcagatataccagattaagaaataaggtaactctctccattgaaccattttcctcaaaatcacgcttgaaaaattgtgctgtctccatgtttactcccatagcagcaaagacaatcgcaaaattttcatcctcggaactctataataaattgttatattagatagataatattaaggaagaagtgtgaatgtcaaaatgttattcagcatacagcaataacagaatagaaaactgcactaaattgcaat

SEQ ID NO: 68534 - DNA, 2568 bp, Oryza sativa
cactgccatctaagatggttctgacaaaatacaggcaattcagctaattatctgtaaaatgcttaaaagattgcataaacaatgtacaccatctgctttccaatcaaattgtcataatatactaatagaattttgaaaaacagttatattaataagtgatgaagaaggaatcaactttttttaataacaatataaccacacgaatgaattggcaacatgttaaaagaatgcatgctatcttaattatttattgccactgtgaaacaaatatgtacatacctgaacaacagctttctccccatcgacttcaagcacttgaccacgcctagttgtgccatctcctaatcgtatattgacaatttcttggtatttaggaccctgaaataccaacacattatatggaatgtgaatgtgatctgaaataatcaaaattatatttgcatgtaaaacaatatgaaatagccatcacaagatatgattaccttcactttatcaagaatgactagaggaccagcaactccagagactgtcctgtactctgcatttttaaaagaaaaacttacaaagtgtgagtagttcaacaatatcaatactaggctacttacaagctagactcagtccatatatggttattgtgaatcaagcagaagatccgtacccatcccaatctcaagagttccttcctccgtgtcgacattaccatttgcaacaaccatgtttgagattgtagaagaagcctgctgtaggtaagtatttgagtcaataaaatatactcagaagaatattctatggacaatctgtcgtgtatctgttttctcaagttccctagataaatggggtatgcatcaccattaaaccctttcttcactggccgcatacttatcttctcttttagttttgcgatttagattagaaattaaaacaacaaattcatggcattaactgtcacttctatatttcctaaattaccagcaacaaaggccagatactttgccaatctaaaatcaatcagatgctgacaaagctaaagctgatatcaactacaaggtgaaatgtatagttagtagatatgccaaataggcaaacactatcctgctattcgaattagcaaaagattaactctagaaagattatgttgttccaattttctggaaatactagaaggatctagctccatgagctactattctagtaagcagtaaaaacataaaaggcagtgatagaacatcgccaatcgaatcatatgtacttcaccagaaccctttctagtccaaaaaccaaccctacatctctgaaaaaaaaaatcatgtttcagacacattgatcattacatgtaagctccctagaagaactgaggcagaaacgagctttgtactgtatctcacttcttaaacaacaacactacgaagatcctagtcctagcgctctcgacagaacactaatcgacaaaccccatctcctcgcacgggcagctctgcatacctccacagtggaggtagcgggggtcaatctacccaacaaactctgaaaattcggcaacatcggggaacgtggagcgccaattgatcctacacgctacgcacgggtctgaagcgccaaaccacgatccggcggcggcgggggtgccgggcctcgtcgtaagcagatccccgcggcgagcggaggagctataggatcggggccggaaggagtgaggaggaggaggaggaggaggagggaggcgtgcgtaccgcagattcgagcggaggagaggagaggggagatcgcgcaagtttcgtcgccccacccccagcgaagaaggcgatctgggtttccagtcagattagcggttttgttttgggcgtcgtcgtctcgtccccgatttgatccgccatgttcgagagaccagggggtttccgtcgtccacgtggcgggatcggacggcccggatcggcgtgacagcgtgatttgttcctgtgggccccaccttgtcgaagcgtctgggcacgttggccaacgtgcaccgccgtccagactacagcatggccaaggcctagtcggagactcggagtcctcctcggcttttggttgggcttgaagcccaacgttaaccaccattttgggccttaggcccatatgcacataagagttttatacggtttctgtgcgtgcatatcatatcatatcatatcatattaaatctttagttttcctgcccacagtaacaccctacgcgagaacgctgcattctgctacagggtaacagttccatgccatgcgtgagccgttggatctttgagagctggtatgatctggccgtccgcctgcttgcttgtgcagttgtgcatcctcatccactcgtctccccaatccccatccctcctgatccccaatccccaatccccaatcgatcaatcctcacttccccagccagcccgtctgcggagaaatcgatcccgcacttcctgcagccgccgccgatccgcatcgctccaccggctactgccttttctcatctccaaccttcgctcttcccccacaatttctgcctgtctacggctgtggggttgcctgctgctggttgtcgtt

SEQ ID NO: 68535 - DNA, 7870 bp, Oryza sativa
ccggacaatcttccttgctatgacaactaagatgttctttctgtacatctatgttctcccactgtactttagttcgttgttagttgagttagatttagtgtgaagcaaatagacccgactctctgtaaagttagtattgtatatgatttcctgtttttagggcattcagcaagtgcttatggttaagaactacactacattacaaagttgccaagaaaatgcaaggtgacaatatcttgtggccatcaaaaattgagattttcagtgactgtcaattttttcttgtgttctacagtgtgctacattgctcaggactgcctcaggtaaatagaaaactataatatagcgcaatatcgtcttacgtttcccatgaggccatgactgttttctgcatgatctgctgctacctaccgggcaagcactggtgttatgttttggactgaccatttgtaaatctatttaacctttaatatgtactaaaagagaggattcttcagcggtgttttactgtacatctgtattaatatatttctttgtgcatagcatttcaggccagggacaggctgcccaggacgagtggaaataattatgtaatatttgctaggtattacttcctactcttacttctacgcttctcgcttcatttcagttgaagccatcaagacattgtccagaccgaaatcatatattgttattatccagtagattatcaagattactgtctgttttagttcaagatgttccctgaatagcagaactggatggtagctgacagattcggtaaagttcaatactctaatcaaaactggatatggacatcatttagatcaagttgctttctaggttcaggagatcaagctgggtgagaacatcagagtataatggttgtgatggtgagagcaccatagtatggtggatagggctaggtgaggtttgtacaattcattctacgatgcatatcttgcagttgggagtcatgatctttctttcaaataagtatcattgcttatcgcaaaaaaaaaaatgcagtgtttattgccaaatcctgacatgaaaagggtgaagagaattttggtaatatagttgtaagcaacatagtgagaagcactttattaagttaaaaggatcgctctacattggattgagtttgatgttagaattttgtaccaatctttctctgttaaaatttccatcctcattggctaataaaaagaagatagtctgatttgggacagtgatcaatgtatgagaaggtcaatcagatttctaatgttggtccatttgattcaaaatatttgcaattatacatggtatatgtaatgcttatgtctacgtgtgggctatgtttgcacccgcagcaacgcgcggggtgccagctagttttcagaatattctgtctgtctggtgtcaaccggctgggactcacataccaactccgattaatccgttggtgattgaactcattgaaggacacggcaggacaagattcttctaggtctctccgttggtgattgaactcattgaaggacacggcaggacaagattcttctaggtctctgatcacttcacttgtttggttgctttcaactgctctatataattgtccgttaggccatagtgacagtgcggatgagacttaataatagtgctcctggggtcgttagtgtgtaacgttgatcctggtcgatcgtccggggttacctcatcgctgtctgtggggttaccttatcgctgtctgtggcaagttggaactgtcctacggctgataatgggcgttcggataatgaactaggggaagccacacatcggttttgataggattttgcctccgaagaatagtagtaaaggacccatcttgtttggagttaatttggagtactatattttttttttgcaggaaatttggagtactatagttggaagtcggaactcgaaagatcgccaaaagattccagacaaagggtgtgtttagttgacgtcaaaattgtaagtttggttgaaattgaaacgatgtgacggaaaagttggaagtttgtctgtgtacgaaagttttgatgtgatgaaaaagttggaagtttgaagaaaaatttggaactaaactcggccaaagaaagcagtagcactgttttagaagtatgtgcggtttgtgcccagtaagaagaagaagaaccatgaactcaaattttatattcatgagttaaatcaaatttacaaagtttaaatatgtccatgtcagtacatttgttatagtaaactcaattttactatacttacatcggtgcaatgaaagcgctatgcgggccttgggcccgaactgtcaccggccgacgttaatgccatgccgccgcgtacagtttacacgaatggttttaatcacacgctgcacctctcccgcgcccaccagtccactcacgcggtcactctcctccagttgtccagtctccgctcgctatatccgctcccgcgcgactcactcaacccagtacacacactccacctaatcttcttctcctcacacattcacacacacacaccccgcagaccccggcaccttaccgagcggcggctcagcacgctgctgctacgcacatggacaagagccagggagtcctactgtccagcaacgtcggggccggctcccggccgtggccggagctgctcggctccgcccactgggacggcctcctcgacccgctcgacctcacgctgcgccgcctcatcctgctctgcggcgacctctgccaggtcacctacgactccttcaactccgactcccactccaagtactgcggcacctgccgcttctccaggtccacgctcctcgaccgcacgcagttcccggccgccggcgacctctccgtcgccgcctacctctacgccacctccgacgccacggcgttcccggggagcatggtgtactcgatgtcgcgcgaggcgtggagcaaggagtccaactggatcggctacgtcgccgtgtccaacgacgccgcagcggccgcctcgggccagcgcgtcatctacgtcgcgtggcgcggcaccatccggtcgctggagtgggtcgacgtgctcaagccggacctggtcgaccacgacgacatcctccccgaggggcacccggggcgcggccggtcgcgcgtcatgaaggggtggtacctcatctacagctccaccgacgagcgctcccctttctccaagtacagcgcccgcgaccagatgctcgccgccgtgcgcgagctggtggcgaggtacaggaacgagagcctcggcgtcgtctgcacggggcacagcctcggcgcgtcgctcgccacgctctgcgcgttcgatatcgtcgtcaacggcgtgtccaaggtcggcgacggcgcgcacatcccggtgaccgccgtggtgttcgggagcccgcagatcgggaacccggagttcaagaagcagttcgaggagcagcccaacctgcgggcgctgcacgtcaggaacatgcccgacctcatcccgctctacccgagcggcctcctcggctacgccaacgtcggcaaaaccctccaggtcgactccaagaagtcgccctacgtgaagcgagacaccagcccaggcgactaccacaacctgcaggggatcctacacacggtggccggctggaacgggaaggacggcgagttcaagctccaggtgaagcgcagcgtcgcgctggtgaacaagtcgagcggcttcctcaaggacagcaaccttgtgccggagtcatggtgggtggagaggaacaaaggcatggtgctcggccagaacggggaatggcagctcgaggggcccgcagaggagaacctgcccgtgccaccggtggtgaccgggaagatcatcgacgacgacgtcgctgccgtggccacctccagcagtgccaaggaggataagaagacgggcaaagggtctaagcttctgtctggattgattgatcaactgctttgtgtgtaagtgaatttattacatgatcaaaccatttacttttgcaattgtggtaaataagtagtctgttacatatcaatagaagtgatgatgcatgatgctattacaggctttacagcaatgtggttaattattaaaggcgagacaagtttgtataagaaaaaaaaaattgtaatagtgaatcatatgcgatataatctgaagtaaaatgaagtatatgagcgcagatgacgctctatattgtaagtagtcacgtgtactccaggttactctgaaatgcggaattatcgcgaaatacaataagaactttcaaatgtcataaaagtaatgctagtttcccttttaaatttattggtaaattggcttcctttgaaaataaattgactagtgacatgaaaataggctggcaggagcaagaacaagcaaattcagtggcaatctagtactctcttcgtaccataaaaaccaacctacttaatattggatgtgacacatcctaatattacatatacctcagtccaaattcattgcactagagtgtgtaagtccaaattcattgcactagagtgtgtcacatacagtcctagattcttttttagatagtatgtatgaacgatagaaaattaatattgtttacttttagctctctgtctcggcgcgtcgcattatgtatgaattcatagtatttgaaactaatttttgctttacttgattaacatgataaattaatattttttaaaaaactttgtaaataacttaaaacaagtgacctaaataatgctctaagagtttcttttaaaagaaattgtatttttaagaagcgtgaagcagataatccgtgacaaaaatcagaaaagaacctgaaaagaataatggggctaagtgcgccgagctttgttaaaatcacgctagctttcttttaaaaaaaaagacataaatttgatgattgttggctgaagagtgatttgttgggtccaatgaaaatacagaaagtaaaaaacacagacacacaatcatcttcagaaaattgagtttatctaactccaatacactgatctttcaagtgtgtcattggttgtctttctaggcctgatacatgtaaagccggagctgcgtgagttgttgaagaccacatcagaaaaagactcgagagcggtggcgtcgaactgatatgcttgtgaagtagctggagcttgggagttgggagcgagctagattacaacaatgtcatttatcggtttttctttggaataaaatgagttgttttgttaggagaaagtagtatttttcctttctgcttttagtgtctcttgagaaagaataaaatgagtcctggcatcataagtaggtgggttagtcgactaggttcgagcctcaccacatctcaataaatatcgatatgtgacccctcctttcatatccagtatcttttaagtgtgccttgtctcctagatataatttctgtttaaaacagccttctacctgaacatgtatgatagaagcataaactgagcacaccaatttttcccttccagataaggtttcaaaaacctttcagatatttatgttatcgtcatcgtgtcttacgttgtctaacaatatgtgagagcatgtctaatagaccaactgggctggcgatagcacgacacgttggcttcactgctgtgctagaggagagaatggtagagagaatgcgagccgacgatataattatcgcccggctgtagcacgctgtacaatgaagaaataaataagtctgatggagattggttcatacttggaacaacagtgaagaatgcagtaattagtgagacccatatcaattaaaaaaatatatcagttgttatcgtaaatgatagtaataaagaccattgttatatgagcagcctatactaacagactatagatgatgtggatgttttacagctagcaagttgacgatattattaaacctactttgatgcccatgggtgatatctaccgctatacgttctctaaaaaaatatagcctccacttcataatatccaaccatactgctcataaaaacaaatacttttgtgctgcacacaccttatacaattcaaatcctcgttgcagtactgcagaggacccttactccaccatataacgttatctgtcactctatccagttccctgcatacaagttatcttttgtgctagaagcgcgagtgccgcgtcttttctctttcaagaaactaagcgccacgttaatgaaacgagtaagatgcatgactctatagactacagacaagaaggggaagtgaaggttgtccctttgcccctttccttcttggcaaaatttgctacaggatatccaaaatatgtataattagctggtggactcacaagaacgtgaatttgctaaaggccaccacaaaaacccagtaattagctgttggacacccgtcggattattttattatatttggaggaattggagagagaaacacctatgtaagtacagttctacccttcaatttttttttcttttttcttccttatcttttctctttctctcattctttctctctttctcgttgcattttcttcaaccgagggcgccggcgcagcgaggcgcgggccagtgcggcacctcagctggggtggcgctgcacggtcgtgcgcaggggtcggggcctgctgcgtcttcctgtggcgcaggatgtaccgcctcacgccaaagcacccctgacaggacgagctgatgtgtgggaacacctgatgatgccgccggagtgttgccatcgccggggaaatgatgcaaaaatgcggcggcggctgccatggagatgaagctcctccgtctgaaggcaactggccgccgagatgaactccgcgacacgatccattaggtgctagcgcgcgccagccggtataggtggaagtagtggttctcgccctccgactcaccaacgtcacctcgcgcccaccaccgccgccgcgaagctgggcggtgtactggcggccgcgttcactcagtatgtccttctcagcgacggcgaccagcgcgcggcagcatggaagcaacgacacatcctcggcgggagggtcgatccgcagggcgtcattgccggcggcggcgctcgtcacgtacggccggagcgtgtccagcctgtccgcgcgcgagcatcggcggctcgtcgtgccggctggccgcctcctcctccgacggctgccaccgcgcgccccagaagcagggctatagcagcgccatgccctcgatgtcaatgttgtcgccttcgggtccatgctgcgaacgccgcgctacctccgtccagccgccggcgtagccactgaaagtgcattaatccccctagtgggttttggtgattaatgataaatgtggttaagagactaatgagtttattgagctacttttaggtgcattagtccaaggtgtggaagatggatgcttggagaccccccaaaagtataaaatcaaagcagaccggaactcgaggagtgcataggatagtttatttattgcaatcgagtttttaggaaaaaccgtattattaaggggggttccaggtggtgctctaagatatgtcaagtgttcttaggttgaaccaagtgacaagtttccctaggagttatttttgcaaatactccatctgtccaaaaatgcaagtccggaacttcctgtcttccaggtccggaacttcctgtcttgtgaaaaagattttcctaagtgtagtccggaagttcctgtcttccaggtccgaaacttcctgtctagtttccaattcaaaattgtgagtaacggctagatgacgtcacctagccgttatacatatccagctcgtttccagctcgttctttggccattccactttcacttttggaccctagagctgttgctagcctctcccaagtgtttcttgccttctccactca

SEQ ID NO: 68536 - DNA, 6977 bp, Oryza sativa
agaaagagagattgagagggagagaagaagatttggagaggtgtgaagattaggatcttgggtgagcacttggaatatctcgtgggctgtcatctcggtgcttattactcttggagatgatctcctagacggttaggtgtcgcccgcgagaatccgttgcatattgtggatgtcccgggtaagtttgtgaaggatctcctctcctccgaaagggaacgaggtaagttaatgaagttcttgtgctgagattctagaggctttccaagtagagcaacctacacttgtggcggatttctagaagttggttgagttcgatcttggtggtcactcaattctagaaatttgcctaggagtgtttgcgattgaaagctgtggatttcctctgggtttttgcacaagtgaggcaagagattaatcgagacctagctctttggagctcctcaacggagagtaggatcgcaagatccgaacttcgggaaaaatcgctcttgtcttttctgtgatgtttctgtggatgtttctgtgatctatcctctgcttagaatacctgtgcttcatcttgtgaagattggcttagtctcttgtttcgaaatttgaatttcatccttgttctgttactcggaagttccgggcctggcagaccggaagttccggtgttccttactaggaagttcagggtctgtttgaattttaccgctgtgatttgtttttaagttttcagggacagcctattcacccccacccccctctaggcttcatcagcacgttcaattggtatcagagccttgtgctcctgattcaagcttcaccgcttggagtgatccgatgtcgcatcaagagggaaacggagagatagatgaaggggacaagggagacgcttccagcaccgaggagattgcatcaaagggggctactattcactttgattacagcaaacttaatgttccttctcataacttcgtctccgtgccttccgggcgtgcacctcattttgatgggacacactatgccgcttggaagcacaagatgaagtggcatttaatctctttgcatccaagtatttggaaagttgtttgtacaggtattgatgtaccccatgatggcatggagctcacttcggagcaagagcaactcatccaccgcaatgctcaagcttccaatgcaattctctccgccttgagtccggaggagttcaacaaagtggatggacttgaggaggccaaggagatatgggacactttgcaattggctcatgagggatcacccgccgttcgtgaggccaagattgaattgttggaagaaaggctaggaagatttgtgatggatgacaaggagacaccacaagagatgtatgataggatgatgattcttgtcaacaagattaaaggacttagaagtgaggatatgacaaatcactttgtggtcaagagacttctccgtgcttttggtccaaggaaccccactcttgtatcaatgatacatgagaggaaagacttcaagaggctcacctctagtgacattcttggaagaattgtgtctcatgagatgcaagaagaggaagctcgtgaagtgaggcaaatggtgaagaatgccgccatgatcaaaaatcaagaagtggctttgaaggcaaaacaagaagaagagtcaagttgtgaagaaagtgaagatgaagagatggctcttattgtcaagagattcaagcactttcttcgcaagagtggctatgggaaaggaaggaaggatgatgacaagggaaagaggcaatcaaagagagcttgcttcaattgtggcgaatatggccacttcattgccgattgccccaagtcaaatgaagctaaggctaagggaggcaagaagaagccggagcgtgctcatgtggcggaggcacacatggcggaggtgtggtactccgaagatgaagaagcttccgaggccaagcctaagcccaagcccaagccaaaagacaaagttgaaggagagggtagtgttgctaccatcgccttcaagtcatcctcttcaagcaaggagcgtctcttcaacaacttgagtgatgacgatgacgactcctaccactactcatgtttcatggcccaaggccgcaaggtgatgactcaaagccctctcacacttctcttgatgatgattctagtgatgaagaaagtgataattaattagatgatatgcttaagagctttagcaaacccgctatgcaacatttggctaaattaatgatgggagggtgacgatgtgaaagaggaagatggaagagtgacgggagtggcatggttccaaatacgtgaattgtaatgatatttttctaatatgccatatttataatggtatggatccaattaaccctaaaaaaatatctacgtttagtttgttgctaaatttgatgaatgcataagaaatcctgctaaaatttcagcattaccaaaactttgtaaggtttagtttagctataatctaaacaggcgtaaaatctgtatgctagaggaggagggagtagaggtcggaggttcggagcctgcgccatcatcatagaagagcttggagctggtcaccgcggcgatgaagacgtcgtcgttggtttcgtcagcagtagcagggtacaacgcagcacaacgacagagttgaacggcgagtgatcctcggtcccgtgatataagagcatctccaacagcctacccaaatcacactctccaaatacctatatagctaactctctaattaatttagcaagttaaacctgttgctcactccaataggctctccatccaccctctctattctgagtgtatgacactgggaccgtatgtcagtctctcgctccttcctcccccttcactttcctcccaactacatcaccaacggcaggccacgagaagggaaaagccggcggggggcgacgcaggcgaaggggcggcgcggaggggcgacgccggcgaagtcgcggcggtgtcgtaggcgcgggcggcggcctcggcggagtcgcggcggcgtccctcgtaggcgcgggcggcggctaccttcccttcccccgaccccagcccgccgccatcgcctcgaggttggcgacgcaggcggagggccgactcgtcgtcgccgtcgccgttgttgtcgccgttgccgtcgccgccccgctccagatctcggagagtcgaggggaaggcaaagggcggtggagccggaaggatgacggcggcggcggcgccgggaggatggcagcggcggcgacgggaagacgacggcgacgacgctaggcggaatgggcggcgggcaggaagggagccatgatgggatggggaaagagggagagagaggagagaggggtgggacccacatcatatggccagccgtcctggctggccaactttggctagtgaggtgggaaatttagccagctagatggcttggagagccatttggctagtctattggagtagatttttttgtccaaattagctaaaatttaacttagagagccatttggctagtctcttggagatgctctagaggcaaacacaatgttgtatttagaggaggttctataggagagagaagggacaagagctaaccatactcattaattatatggttctactccctccatttcaggttttaaaatgtttttgacttggtcaaagttaaactattttaaatttggccaagtttataaaaaagataatattttgatacaagataaattattataaaaaatatatttaattattaatttaataaaactaatttggtaatttaaatattattatatttgtctataaacttagttaaacttaaagcagtttaactttaaccaaaatcaaaacatcttataacctgaaacagaagaagtagataagagagaatatatctggcccgcatgtcagatgcctacagctatgaagaagaagagatccgtgctaatatcttggttttcgcaagttgaacaacatgttatattcaagaatgagggacctaaagtaaacttattccctgtcaaaatcgtaaaggaagcccacgtccattggcccaatttgtgatcagggtatagaaggaaggggtaaacactagatcccggtcccagccgcccgcgtcgttcctcttcttcctcaaaacgcaatctctccgaattctccccatcatcgccatcgacggcttcccaggccgggggaggaagaactccgtttcggacccggcgtccgtgtccgttatcgtccgtcggtttccgtgtccgattctgttcttctccatatgttgatatagatagatcgatcgatcggatcccccacccacacaccacaccacatccgccgcgacacagcaagaagaggagagcagaggagaggaagcagagtgttggaaagaaacaaggaataagccggcggccggagatgaagtccggcaagccgatctgcgagaaggtgaagcccgcagtagcagtccgcatattcggcgggctacgttacgctccgccggatggcctggtcgtcaacaatcctctactggctgccttcatccgagctgtttacgtaagtgttttgtttcctccttgcaatatatatatatttatatatatgctgttgcaagattacaattttggttctgcctttgtttcatcggacaatctatggatcgactcaaggaggaaaagggagtttccaaatttttatctggtgcctactgcctagtactgtgggaattgattgtggtttgctactttttaaccatcacctagcatgaacctagaattgcgccaagtagtttattatatattatagatgatgcatattcaggtcggaacctaaagcactctatctctcattctaaaacagaagaaatcgtactatcaattcggtaactaaccaaatgatgaaatagttgcgggtcgttgggtctgacttaattaggagcatttccattgtcatttgctgattcatattgctatcttatttagttggtagtttaactcactccagtgattaggccagcagatggagtgacagaatgctaaatttcatcatctttcggtgctattattattgtgcaccaggaagtttgggtgtcatcatttttctaaaatctttgatgtggtataaccaatttttccttgttattatctagtgctagttgttttgttggtacttcaatcatgtataattttctttgcatccagaatttcttatcttgtagtcccagtgaatggtcgctcactttacctgttatttctttctttgcagaccttatacatggctacgacagtgtttctctacatttttggcatggttactgctatcaaggaatacgaaatgttggtggcactgtccataattgtagtcatgcagcccttcttcatattgatgtggattgcagcaccattccttaggactgtagcaattgtgaaatatgcgatgggactccctgatagtaataacgtcaacagaattacaacaggaaggatgtcagccctagcctgaacaaagtatgcctaagaagggttgttcaagtttatcataattgtgccctctttagaaatagggcactttaagttgctgtcttctttagaagaccttttagattcagatgtgtatttcttagaacatatgttaacagtggcgtagctagcttatagtccatatgggcacaggactaccctagattttagcatagagaccttaatccctactatcaaaattcatggatcatttgcaaaacaaactatacatacttatcatgcttcttaaacttgttagttgggactacctatacatttgtcgacaaatttttccccaaaaatttgacagatgtaattatagtacaatcgtagtgtaattacactgtaacttatatgtaattacactgtaacttgcatgtaactacagtgtaacttatatgtaagtttcacataattttgaatcgttagatctattacaagatttgttttggtgaggaagaaaacaaatcatagcacacacatatatgaaagaatttgttcccacgacctccattttaccgaaataacatgttacggagagatttttgaaagttacatacaagttacactatagttacagtgtaattacatgcaagttacagtgtaattacactacgattgtactgtaattacatctgtcaaatttttgaggaaaaatttgtcgacaaatatatagcaaaatcgtttgtgtttgtttatacgattagattggagctagctgtctttttttttatcatggtgtcttatattacgatgatttatttgaattaggtggtctttaacaattttgtaaatgcatattatattgtatggtgatattaaaaattgtagcataagtaggcacgaccaaggacaaattttgtaaatttcgtagtataatttgtttttgcattattatatttgctatctaccaggtacttggccacacctaaattttttcatcctccatgggaaataggactgcccaatgaaaaattcctagctacgccactgtatgttaaagcaactttgtatgtttatattagttatatgatgcttcatggttcttttgtggcgagtttcatggtttctgctttctccattgtaatatgtgttgattattttgattttggagaataaaaccgcccgttctttttatttatttgtgcaacacatttgtacatgcgtagaggcatttttgcagacgtatccagccatcggggcttctctattcttaatcctaaagcttaacatgtaaagatgttacatcatcatccactaataattattatatttaaacatcatacaagcatgctatattatctacaatttaataatttattaaattttagagaattaaaatgtaagtatgtcaaatcattccacataattcacataatattttaatatagtccatcctcacttagttcatgctatttttcttctctcattaaaccatgtcatctctttttttctagcccatagatgtatagtctaaattatc

SEQ ID NO: 68537 - DNA, 16222 bp, Oryza sativa
aaccttatattccgagatagggttagcagtgaacacatgggacagtttagcccacacccaacaccaatagtgaattcatttcaaatcctgatctgaactccacaaaataattgaaataggaaaaggtatcaattttaatttaaagtataccgaagaaggtttctttgagtttatcataattgtgccctctttagaaatagggcactgctagttaccgtcttctttagaagactattagatttaggtgtgtattctattataatatatattaaagcaactttgcgtgtttatattagttaaatgatgcttcatggttcttttgtgtgagtttcatgtggtttctgctttctcccttgtaatatgtgttgattcttttgatgtaggggagtaagatgtgtggcacgtttatgtcaagtgacatttcatactcaaacactactccctccgtttcacggtttcaaattattagtcaatttgatttggtcaaaataaaactactttaaatttgattaaatttgtaaacaaatataccaatatttataacacgaaacatgtttcattaaatctaaaattaaatatatttttataatatatttgtcttgggttaaaaatgatactccctccatctacttttgatagtcatattatcaaatctgaaaattttatttttgataggtatatttcaatctaacaacctatcatattaatgactttctcggatttaatgcgtgactctccattcttccacacaagattggctacatgggtatcgagaaatgtaaatattaatgaatcgtttgtttacgaggaatgactagtagcatgtttaaatagatgataagtataattatttatctttggtctgtgtgccaagttgaaatatgactatcaaaagtaaatggagagagtactacttttttctacaaacaaaaagcaatttgactttgaccaaattgcgggagtaaggggctgtttggctggtggcctcagtatgccatgttggaatttaggtggttttccttctgattatatctgaatgaaagtcacaaatgatgtttgatggttgttcagattttatctctttggttctgttcattttgtaccagtgattcgtcagtttggttcagataagatatctgaacttttgccttatcttcagattttggttttcagttttggtcttgttggtttgagctgtacgtggaagataaagtctttatcattctagatattcagtccggcgaaaatcaatctattgattgtttgttatccggcttagagataagattttcttgtttctatacaaggctatataagccacgtactgctgctatatttgttacacaaagtttttgcccacattcatcggcttgttttgcatagagagagttacatcccacgaaagtctgctggtttgttcttggtcgagtgcacggctgaggatacgagatcattgtatcttggaggagagccaccgtccgtctcgtgcacctcggcgagggcgtgaatctccttgaagacagcaccgctggtgtgccttgatcaagctgaagctgttgttcatcgttcgccaacgagcgacatcttcagaacctacaaagctgctgcctacgacatagacgaactctaacatgccacaccaaaccttaggcgtgccacaattttttaggctagtgttatgtactggaccgaaggcgaaccagagatgctgggggacggcaggcatgatttttatgggggtttgctgctgggggtggaaaaaagcttgggctcgtgagctcaactcaggcttggctcgagcttggttggctcggtgggctggtaagcgcaagcctttttttcagctcattgctgaattgaccaagtccgagctggctcgtgagcagcttgtttggctcatgtgtctaggcgattatgtgtttatatggattattttatttggttatagagttattatttgccaacttacaatttatcattaagattttgaagaattgaatgtataaacttatttaaattttacttttgttttttttgcggggttacttttgtttttttaatgattataaaatatatatgaagaagtatttcaaccagaaaggcttgcaagccagcttagactggcgcgagccagaaaacgagctgagctgaactcaagttttagcttgtttccctaactgagccgagtcaagtcaaatctagtttgttgcgagccactgctatgctatttgcagcgctgtcgaccacacatgcgtgtgtttttcttaattcgtgccagcaagtatttgttcggatcttcaggaaggaacagtacccaggtctcatctttcctttttttttcccttctgcgaaaacggtgaccaggacacactgtcacactgagccactgacaatcaggccatgtttagattcaaactcttttattcaaactttcaatttttccgtcacattaaatgtttggacacatacatggagcattaaatgtgaacggaaaaaaatcaattgcatagtttgcatgtaaatcgtgagacggatcttttagcctaattacgccatgatttgacaatatggtgctacagtaaatatttgctaatgatagattaattaggcttaatagattcgtctcgcagtttacaggcagaatatgtaatctgtttagttattagtctacgtttaatacttcaaatgtgtatctgtatactttaaaaaaaattgacacacgaactaaacacagccttagtacagtaggagtagcatcaggttagagaaggctcattttcttctttccccttcaaacccctactcttctttacctttcccttctttccccttccacctcttcacttcctcacagggatccagtggagtatggactatcgaggacctgaggttctctgcacgtacgttagatccactcatatgtgccaacccaccagcgccagccaacgcgacatgctttaagttaaaaacttgcatggcccattatttttttaggtctgcatacactgcagcattagtttgttgtgctgttcattcaacaaagtttagtacattagtataagggtaattttaccatctttgaaaaaatacatagaggtatcatatttttttagtgcaaaatttgatatatctagatactaaatacctcaatgtaacaatttttttatgtaaaatttaggtatcttaagatacttttctcaaggattgtaaaatttctcttactataatgcttgtaatttacagtatgaacaatgtaatacatatgcatgccttgcagggatgtttcgagtttaatttacttgatcttatatgataataaaaaatgtaaagtaacagtaacaataataacttagctataacttactgtacatgtaaacaacgttaataaaaatgtgtttagttcacgctaaaattgaaagtttgaatgaaattgaaacgatgtgacagaaaagttagaagtttaaagaaaaaaatttgaaactaaactctgcctaagctgtacttatttaggtacaaaggcagtagtacttattttttgtaccgagtagtactacttttgtactagtacgcgctagttccacattttggatagggctcctatacttacaaatgtcgattatgtttttttttcttcaaaaaatcagaagcgccacttggataaaagacaaagcattgtgcatttcaagctgcttaatttaaaatgtgtttacgtacgattatactataactaaacaaacttatcatcacagactatggagtaattaatttgttgcagggtaattaagcaagttaagaagcagcgagtaggtaaatcgagtagagcatccgacacagatgggtgttgtaggcttcttaaacgacaaagaaggtcgacgtcgtttcttttgatgcgagagccgagagttagcaactttgtcagccgccgtgcccggcatatacttattgtacatgcaaacaacgtcaataacttagctataactgtaagtatcatgcaacactggttcagcagcgagtgacaacgcgatgaggtgaacagtgcgacatgttcctacttttcccctcttcttttcagaatcggcatcagatttagtccttacagtaagtaggagtaatttgttctgtggtgacatgtgaagaataagacatgttcttaataattggcagcagatttactcatgtcgtacaagatgtaagaacagtctacatatatacggaggactccactccgtagcttagcaagtttaaacatgaccgaaggctcggagcctcggaggctgagtcttttatagctggcgtacgcaagtctagacgtcgatgagaaagtaagcatgcatgaccatgacgaagacaagtagacaaaccgtccgtccttcggtccttgtgtcactggatctaaacagcaggtcttcactatgcacctgcacattgtagctcgattaccgcgagtccgctaggatcatccagccggccgcccggtcgccaaccaaccatggattcgtggagtcgtggttgcacgagcggcggtgcccggctcggtacacggcgactcaactaggacgaaattaaagccgccacagggccccggtgcatgtgtgtctaacgtaaccatgcatcattgagcattttaacagagaaaccggccggtatgcggattgctatccgccgtagcagtcactaatcaggaaaccacaactcgcagattcgcagcagcttaagaatgaagatcccattcgaaatcaacacaaccgcatccgattccatggcccaaccgcgcgcgcgcacgaacgtacgccacgactcgtgcgcgacgcgcgcgctaacacgacactttgcgctcaaatgcagccggaccgtcacgttgcttgcgctgttggctgttgcgcacctaagctatgtcaagtgtcaacttgcttgcgttgctccactcttctgtctgctcctcgtttataacagctggagtgttggttggctctggctgcatcgacgcgcgcaggcggttgggttttgctacgacgaagaaggcgtagccgcacacccgtgcgcgcggtttcgttcgcgatggtggcgaagaagccgagggttgtggtggtgggcgcggggatatcgggcctcgcggcggcgcaccggctgtgcggcgcgggcggggacaggttcgaggtggcggtggtggaggccggcgaccgagtcggcggccggatcctcacgtccgagttcgccggccaccgggtcgagatgggcgccacgtgggtgcagggcgtcgtcgggagccccgtgtacgctctggcgcgcgacgccggcgcgctcggggaggaggagggtcgtggtctcccgtacgagcgcatggacggcttccccgaccgcgtgctgaccgtcgcagagggcggcgaggtcgtggacgcggacacggtggctggcccgatcgaggagctgtacaggggcatgatggaggccgcgcgcgccggcgaggctggtggtggaggcggcgtggaggagtacctgcgccgtggcctacgggcgtaccaggcggcgcggtctgccggcggcggcggcggcggcggcaaggagcttgaggaggtggacgaggcgctgctcgccatgcacatcaaccgggagcggaccgacacctccgccgacgacctcggcgacctcgacctcaccgccgagggcgagtaccgcgacttccccggcgaacacgtcacgattcccggcggctactcccgcgtggtcgagcgcctcgccgctgcgctcccgcccggcaccgtccgcctcggactccgtctccgccgtctcaagtggggcggaacccctgtccgcctccacttcgcggatggcgcgccgccgctcaccgccgaccacgtcatcctcacggtctcgctgggcgtcctcaaggccagcctcggcaacaaggacaccgccggcgttggcgcggccgccatcgccttcgacccgccgctcccgcctttcaagcgcgaggccgtcgcgcgcctcggcttcggcgtcgtgaacaagctgttcatggaggtggaggccgtggcgccatcggaaccggaggacgtcgccggcgtgcagccggcggcggcgggcttcccgttcctgcacatggcgttccggggacacgtgtccaagatcccgtggtggatgcgcggcacggagtcgatctgccccgtccacgcgggctccaccgtggcgctggcgtggttcgccggccgggaggcggcgcacctcgagtccctccccgacgacgacgtcatccgcggggcccacgccacgctggactccttcctcccggcggcgccacggtggagggtgaggaggatcaagcggagcgggtgggccacggacccgctcttcctcgggtcatacagctacgtggccgtcggatcgagcggcgacgacctcgatcgcatggccgaaccgctgccacgtgggccagacgccgccgccgacgagcggccgccgtcgccgcggctgctgttcgccggcgaggcgacgcaccgcacgcactactcaacgacgcacgccgcgtacctgagcggcgtgcgcgaggctaaccggctgctgcaacactaccgcggcggagcgaatcacaccacgtagcaatttttttcccttgtgatcacgatttgcgttgctcatctcaaacaatggtgtgattcacgtggttggatatggcttaatttgccggtttggcgatccatgttgcttcaggtatggagataaaattgagatatgaggaggtgatgtgttcttctagtacatgtgtaaaacgtgttctctcttcacctcttcgggaatcgagagaaattgtcaatccatgtccgtattggtctagggagactggtgagttcagcaaaacagtgtctactttgaaatttcccgccgtattacggcgtcatttggcgccagaagacacgatggcaacattgagcgttgcttgctcattgtcatctcctttgtctgtttctgacacgtgtcaaaccggtgagttgtaagaccacgacatagtaacatggatcatccctccattgacatttgacagagtatcctccgtcctccccaagagctgtctatcgtactagtagtctatagtactcgattgaaccacctttggccggacctatggcttaacaagacaatttcttgcacgtcgatatcggtgacgttactaacactaataagtaataaccaaacattagtcgagtgacataatgttagtcttattctcttgaaggggataagatgcaaacgagtacacctaattaacacgctagatttgttctgcctggatgaagtttcatgattccacaggctgagatcgatactcgatgacacaatgttcgatctgttcgggcttcaggctgtgcaggctccagtgttgctcatgatcgaataatctataagctgcaaataatgtggatgcaagaagctatccagattactactagttcctgcaaagatttgggctgtttgttaattatgaaattgcggagaattttctgcaagattcctgctatctatacttgatcagaagatgaaattctaggaacatcaacatggcacaaaacagtacgagataccctacaccagcagtagtgcctagtactacttgtagtgcatgaatgacagcaatttgattcggctgctgcagttggtccggggaagggccggccaaaggttcgacgacagccatctcctttcccttgattgaccaatccatgacagccataactttgcttcgaatcacattctgcgacgatgcaggaagcatgcattggttcgattaataatacaggaaatctgttgcgacgcagaaagcagatgacaggggaagatcttggactgatctgatctttcgtcactttgctaataagatccagatcttgatatgcaattatgcatgtctagccttcgaggcctaccgaccattggtccagcaaatttatgttagtccagatggaagatgaaacataaacaaaaatatactcctgcacaaaaagagatgtttgtttgtttatgagaaagaagggaatgcgtgacctcctttcttgactactttgccttctagtggtgtaagatccaatgcaaagaaagacagcaagatagaaaaggtgatgccgtgattacgatatttctcccatattttttttaacgaatcggtgagccgccaatttctcccacattgtatcactcatttcattgagcctcctggtcaagtttttctcctcggatgagttcctttttctttctctaagatcttttaggcaaacttctttctttctttcttttttgaaatgaggcttcaattaactacttggaccgttacaaatctttggtgtgtattgcaccagaactcccgtgcgttaaccggcagcacattaacaccataaagcagcaaaacaatctgctaccttgtgacatgatcttgtgtagaccgagattgaacaagaatcaaactgattatacacctcctgaatctgcttaaaaatactaccttcaggtctttggtccaaatcagtactagctgatagagctagccccatagtgactgcattccgtttccaggatagtttaggcaaacatgctactgaaacaaaataaaattatattatgctagtattatactgcaagtagaaatgatctgaaccgtttgttattaaggataaattagtaatttaccaatagagtgattaggggtaatttttgtcatttacatttcatctagatcaatttgtggtcatccattccactggcatcggtcatattccatcgaaaaagcttaaaaaagagagaaaatgtccatcgctactaaataacaattataccccttcacattttctttttacaataatatctctccacatttcttctaccgctaattgggtggtagtacaaatagatttaaatcctttgatcaaatgagatcaaccgatgagtttttttctactaccagtagtagtagtagagagcaccatagtgagactctagggtctgggaattgaaccgtctgtactgatccaatccaggcgatcgagatgtgccggaattaccatccttgatagcattataggctttttatgccggtgcagttatatcagagacaaccaatggaggttaggaacaacaattggtatggttccagggggttcggagttttattctccgaactccgccaaaaccatatttccgagctttctctcgtctgactgcctagcctacgattcctctcgagtctcgcctccctgaattggccgcaggcccgtacctaccgccggagttgatcaaggacgatggtcttttgctaatttgcttgctgtcgccacggcgagattggtaccggaaatatgagaacgaggacgtcagcactcagcagccactgtatagttggtagagatttcaacaattattcagacgagcccataccatatatactcgatcgagtagagatgcgaattgtgttgtttcggacagagatgtggctaactaattaagttgtaatctgtgccttgcactatatactctccctttcttaataaaactctgccggctttcgccggcccggcgagtagatgcgaatttgaaccgtatgtcagatgcgttcgtgactggatgttcatcgatcgtactagtcacgaaccatacaattgagcaagctcgtgttgaagattcgaagtggaaaccgagagacgataatgatcgtttcaatttggttctaaaggacaaatccgaacaggtacactgaatttgcatgcaagcagccggagcgggccttggttactagtcgcgctcacgctggtgaatgatgatatatgatacagctccctgtttggaaaaaaaatgtcctacgcaacacaaaccgttcatccaacagctcgtacaactcctttccgtggcaaaagctcgcgtcgaccaagccgggacatggaaaagctctggacccgtatcaagattagtccgagttggatcgcttccatgggtcaccagatagcagcagccagcaggtcgcagcatctgttccccgccgcctcatccgccggagctcctccggcttccgtttacccgcgatttatgagaaactgcactctgcctgtagctgaacgattatcccaatccaagctatttatgcggcccggttatttcggtgacaagcaatgcagcccgaaagatgggctgccgttatttggaccatgagaacgattgggccgtttgttgaactggataggctagggaactgggtgcaagggattcggagttttctactccgaccccaacgaaaaccttcctcttcagtttcctctcgagtctcgcctgctttcctgtcctgcctaaccagcgattggccgcagccactaactcactaccaaagtttatggaggatggtccagccttttatttttgctttcggttttagtcatccgagttctgaacccaggtacatcaagcgtacgtgaaaacggtgaaagggcccaaacagatagaagacgacgttctgaagccttaaccaaaagaggggaacgggctgttctgccaaacacatcccatacttgattgtttcagtgagactttaatctagactttccgctttgaattatacacggaacagattcagacgctgggcgcctcgttaccacgactctcgagtcgggcaaattcgagtactacctgagtcgaacatacacgagataaatgaacttcaaaaacacccaaaattgaaaactaattgccgtttacaaacaacgcgtacacagtgaccactctaaacgcatgggtcgccgagccgccttttgcatctgcaccggcgccgcggtttgagagcgcgcgcgcgcgatcgagctacgtgccgcggttgagcatctcgttgtagttgagcagcgagttgagccgctgcagctgcagctgctcccggaacttgttgatgaagtcgtccgccctcgcgtccacgctgctcgcggtggcgagcccaacctgcgcggtctccacctcctccctcgccgccgacttcacggcgcgtgccggtgccggggccggcgccctcggcggcggcggctgcgcgcgttgcacttgcagtacctgccgctgtgcctgcgccggggcgcgctccagcttcctcacctccgagctcgacgacttcttgaccgccaccttcgctctggcggcgccggcggcggcagcgttctccgccttgcctctcttctccaccggcggcggcgcgggccgagcagcaggctccgaccggctccgggtgtactgcgcctgctgcttctcgctctcgtcgcagatggcgttggcgccggcggcggagaggttgtactcgggagggaagtcgccggagcggaagcggtagaggccgaaggagcgcagccgctccatgaccgacgacgtgcgctcgagcggcgcgggtggcggtggagcgtactgatcatggcagcgctgcggctcatcatggtggtcatggtggtgctgtgccttgtagtgctcgtcgtggtggtgttggcggcggcggtgggacgcgcgggaggtgagcgcgatggtgccgatgaccacgttgagcaggaggaagagcgtcgccggggagaagtagccgcggaccagcgaccaccccggcggccaagctgtcgcgtctgccgcgacgtccatttcgtcgagatcgccgcgcacgttctgcctaccacacgtgcacgggaagagcttggtgcgttgaggcggatgtgactgcgtggtgtagctgggcgttggcctgctcggcgtggtgcactggtgcgtggtaaatatacagggaggctgagggcacgcggcgcgcggaggcgggtggtggatgggagggaggaatgcttgcggagttgcgggggatgggagaaacggcgtgcgtatgagagggcctcctcgtgcgctcgcgaccgaccaccccgtcacccaccgtgacaggttggagatccccaagcccatgagccctcaattcattgcgacgcagggaggggcgtcaccgtgcgtgcgtgcgtcggttgcaccggccacggtgctccatctccagggaaataatgccgtgtacagcgtactagtattttagtaatactccgttatccaatactttactgttgtattttagtggttgatcgtctcaagtctgccaaaacagaaacttctcctgtggcaaacccaaaccgtgtcaagttgtgtcatgaacaaatcacaagattactactctagactatagaacaagcatttcggggagttggagtactgagatttctcttgccgactactgcgatgagctgatgaacaatgcgtcaagcacatttcgcttcatcattttgacgcaaccgcggcaatgagttggcgttgaaacgtacgctcgagcaggagaagcaggtgagccaccaccaagtctgcacagtcggatgaacatccgttccgaggcaatgaacaaaccacgtggattgaccgtccagctagtgatatcagcccacctggtgcgagactctgcgcgccttgcttcacgtcacgtgccggtgtgccgcgagacctgctctgatccatccagtggccagatcggaacctaagcaggtcaacctgactcaaccaaccgcgcacttattaacgtcagtagagctgccgagacgaagtcccgcagcatatgagctcccagcataatattcataggcacatgtcgggcacaggactcccatcaatttaaatgcatccatccgagacatgaggtgatgaggcaattatcggccgtgattgacaattgagtaaccaggataatagtccaaattaaagctcccacgtgacgttgtaacatgactttcaagcacacttatattttggatttgtgaccataccaatgaactcagatgcacaacgcacgacgtcaagaacaacgcggcattggaccaaatgttcaaatccgacaagatttagaggcgggaaaactgcttccactggggtatccagtgcaacgatataccacaagcaaggaatagcccaagcagacgtattcaaggctacattactattggacagatctatctgaagaaccatctgattaagtcaccaagtcaggctaacaatacaactaggtccaatacgagactccagaacaatgtttagcatccaaataatctgcccacagagattctgctctgctgtgtttgcactagcttaccgatttgagtcgatacagtaaggtaaaagagtcgcacaagcacttgaagggtacaagcctgggttccgcaccagaggatataaccaatatttgaaaggaacattctaaatggacaagaaattagaaacctactagagttattacaggactgggttacacagatagtcacacgattcagctccttggagcacagctggccaagtgagtcttgaagttctccagctctgcaagaacttcatcttctggacggtatatcaggtcactcatgcgccatatctacacaaataaaatatgcataagaacaactgacgtataatatcagataaaagacaacatggtagcagtcactattccaatgaaatatgagtacagtcccattttgtgtctggcactataaaaataaagaaacacacctgcaatgttccacctccaccagtactctcaccatcatcagacacactcacaatagtccaaggatccgaagaattccagtggaagtctacaatcttatccctgccaataaaaatatcacaaaatacgttatttatggaatacatacaatgaaaatcaacagcaatcactttgataacagttgtatcattccttaagatctaatacatcttcccctcaatttattatagtgcccagttcatgtggaaactaaaaagagctaacattgtatgcatatgctgtagcataaatctattgaaaaactgaaatatgatctacttacaaatgtactgattatccatttgttctgaaccataacagttattccaaaggtggagaaagcacaggctgactttataatggccttaccaactaagatacagagtacaccataatcaagatttatccctctaagtcttaggcttcttaagttcaaatttgcaattgcacaagtgtctctcagcataagtcaaacaccagttcaaagaggattcaagtcccatcttcaattttgcaaaactaattaatgaaaatatcttaggaaaaatatctcattgcagaaacagaaaagcaatgcacagtgatgcaacctaaagttgtcgtaaaaacgaatgtctcgtaaatgtgacaggaataaaaagccaactgatgtggtattaagcatttgaaggaatatggtattgagttacgcatattacaacacataaggaaaattttacatttcatcatacgatagcatacctatgaccagcatgttgaaagaaaagcccagcaggtgcgttgggatttttcttatttccaacctgcatcaaaagaattttatgaatctaaagctattaaaaagtacatgaaatgaaggggacaaatggagcatgaactcccatcccaattccaaactttctgcagggccatgacagagatgactgaaatggtaacgaattgtatagaaagataccttctcatgatcccacacatttaagaagccgtcttccgcagagcttccaaatacagatgccttgtcaggtgaccactgaaacacacaaggtttgaattatagcataaaggcacaaaaaaaataaacgacagtaaccaaatgtgcataaaaaatatagtaacaataaatatctgtacatgcctgaacacaaagaacagcagctttatgaccctcaaatttgtgaactggaatgccagctcctccagaacccagatttctccggtcccacatacggacagaattatccgcagaactgaatacgaaaagaaaccatcttactcaaatgtgtaaatagctaaacccactatcaagaagtgtatccacggcttcttgtaccaaatgaacactaaagaacatgttacatattatttagaatttagaaacatttcatgccatcatacccagttaagatatagttaacatcatggaggttccagtcaacacaatgaacatcaccaccatgagctttctcaacctggaaatgaagaataaaccagtttcaacatggtgcatagaattgagctgctcattttcacgtaaagcatcattaatctgcttaaaatggagaagagcaccaccttaacagctgggcctgtaccactccgggcatcccaaagaataagacaagaatcatcgcctacactacaaaactcctgtgcacttcaaaaaataaaaaaaaataaactgtgaagataaattgatagaagtatagatcatacaatatcaaaatatagcatgcattccaagttcccagcagatgttcacaataatgatagctgctattgttttatcatcataaagaacgactattagccaagacaaaaactttaggccatgcaaaccactgaagctcatagtccaaacaacatatacacatgctagagagacaacatttaataacatgaaggggaaggtgcaatacctagaagggcagaactggacatcttcaacagtactgtcgtggccaagaaagataccacgaggatcaactttaggactatccttatcatttgcagtttttcccttgcttcctgatgcccctggagaagattcagttttcgaggaatctcccagtgcagatatgtggtcttggatgctccaccatacaacagatttgtcttttcctattacaattcgtattgaagtccaagttatcacagcagcacattgagtcgagagaaaaaacgtgtcccctgaacttggcaacaaaacttccaagtctataaactttagcaagtgattcaagttaggcccaaacccaagctagctagcagctggtttacatagtaatcaatatgcctaatttagtgattggcctctattctttttgttattctgcacgttaaaatggtgctgtcacctccatctgcaagctagtttaggcatggacctatcttgactcacatgtacaagatccaacagaacaaaacaaagccagttctcaacttcaaggacccttgcacacatcaaaatcgaacactgaagaggtgaagaccatgaaaagtcaacaatatcaaccggaaaataatttaggggtaattgttaaggataacacacatgcgcacacaaaaaagtcttgacaccagaacaatatgtgaataaatacaaaaggtgtg

SEQ ID NO: 68538 - DNA, 5437 bp, Oryza sativa
attcctgcagcccaaatgagaacctgcaaatgaacaaaaaagccttcagtctacaaatccatcacagaaatgcttagggagtgatgatcacaagaaacgggcagcactacaaagttctaggcatacatctgggctgtcggtatgagtggcaatgatcttactgttctgcggaagctccctaatcctgttcacctgtgtccatggtaaaacagaaacaatacatcaacgattgggttaaataaatgttgacggggacacggggttaaacaaataaaagacacatctcaagcactatctccaaaagaaaagcaagccatctaaaccactaaagtttatagccaatatatgcaccacacaacatggaagatctcatacagaggcaatgatcctcaagttaaggaaagagaaatcaacaatcacgattgaatgagcttgtacctcgcctggatgaattatagtcttgtacttctttacaaaaggtgatcgtgcttcctcattgaactgcaacaaaaaataagagacatccggtcagtttcattgtaaacagacttcaagttagtgcaaggaattcctaattcaggtctttttaaggccaatgtaaggcagtctcatacaccgctatcacaagactgaagtcatgcaaatctagatgttcgagttatgacatttttattaatttaataagacagattaggcatagtaaactatcagttggtactacaggtccacatctctgattaatgattacattaagatgggaagctgacacctcgggtcaattaaatctgcaaaaaggaccagctatgtccattcatctcaaacgtagcatgattctgcattttacaaactcaaatgggtcactgaaaaaagtggaaacctgagatatatgttcagcagctgcaacccttggtttgacaacttcacaatttgcaataaccagagtattagggacagtcccatccgtctgcaacaatcacatggttagcaaatgctaaagtttaatatccaactaagaatacataaattttctagctaagaagacccatctgcatatctgaattcaaacttcaccataaatttgagcttcaaaacatccctacagcaaaagaaagaaaaagaacaacttattttgggagcacttgcctgctctgaaaggtaaagacgctgacgattcttgtaggtagccttctcaaactggggtccccacctgttaacaattaatgatgagaagatcaaatcgttagttgcagaaccactattgaaggtcaaaagcacgacagaatccaacatgcacagctttaaaccgaattacaagatgatatgtcacaactcaacacagaacaggcacggataaagcatgacaatctaactctaaaacataacaggtaatcatattatcgactatatactatatagacaaaaatggacgagcagcaacccagtagccataaaatctcgaaggtagactcgcatcagcaagcattacatgaacacggaagaatcgaccctattatatcgactatatagacagaaatggacgaacagcaacccactagccataaaatctcgaagggagactcgcatcagcaagcattacatgaacacggaagaatcgacccacacccccccccccccaaaaaacacacacaccaccaccaccaaactcaaacaaacagtcgcatcccacaaaacctccccgtcccaaaaaccctaacatcccaaccggggccgggacatcctcaccccactgccatccccgccaaatcaccatgcaagcgacagatctggagtcaccgaagcagagccacgccctaaaaccctagatacagtcccccaaaaaccctagcccgaaatggatctccacggaggacgatggctacgagacgcgcgggaaaccgccggaagggaggaaggaagggaggagatgcggggaattttaccggcaggagagggacggccagacgaggttgtggttggcgaaccagtcgtagagcaccgggatgagcgacttccactgcgcgtagcgctcgtccaccgccgccctcgaccccttctccttcatctccagcgcgcccttcgccgctcgctggcgcccgccgccgccgccgtcgcccgctcccgcctccgaaccccctcgcgctgtcacgctctctctgtcgtatgaggagcgtttgctctggacccttgcgcgtggctcccgctcagagatgccacccctcttgtgcccgaatgcaagggcagagcagagcatccaaggcttgaagcggtcgaaacaaatgcggcgctgtgggctgggcccatttgtattgggccaacggatgaatagtgtgggataggcccatttctatctgggcgtaaaatgtcggttagatagaactgggtttttttaagaaaataaaggtggtgtttgaatctcctgaagatgaagatgaagattaaaattaagtgtttcacacaaaatggagtggtaataatgtgtgattaattaagttttaattattacaaacttaaaaaacggattgatttgatattttagaacaaccttttcacacgaaacgtatcgtttaacagtttgaaaagcgtgccacgagtatccaaaatttaatccaaaagttgttggagaaaagaacagggcatacactcacagctatcatataaacacgtccgaaaaactaaaccagtatatcttgagatagaactgatattgatagtactccctccgtcctaaaatataagcacaggttcttagctaaaaatgcttatattttgggacggaggtagtagatggtagcataagctatctgtactaaggttgtgtttgtttatttatgatgacgctctctctcatggcctgatcttctggtgagaggataactctcactttgatcagtgtgacgtttgtgacgtagctatcaaccagagcaagtcgaggacgccgtgcaaatcggtacaccacaaacgatgtcatactaaccgtgacatatggttgatgatccctgcaatgcaaacgagtgaacattgcaagaataagataagattcaatctaaatattgcggaaaagtgattaagcacagagaaatagttgtgattgaagtggtagatctaatcgaaccaacaaatcaacacaccaactattggggctctgaattaataatcgctgactaatcgagtgaggaaccggcaaatcaacacgccaactattgggggctctgaatcaatagtcgccaactaatgaggactagagacaacatgaagagagaatctcttatataccactgaaaattggtcggatctcttgtatgccactgaaaaatggctcttcccctatatgccactggtccaaatttatgcaccctctcatgccactctcgcctgtgaccgttaactctcaagtaaaaaagatatatttgcccttctaagtttaggacatgcctaacaactcagaagggcaaacatgtcttttttacttgagagttaactaccaacacgcagtcaacagacgggagtggcatgagagggtgcgtaaatttggaacaatggcatataagggaagagccaattttcaatggcatacaagggaccagaccaatttccggtggcaaataagggattctctccaaggtgaatgacacctggcaaaattcaactaaacaaaaccctattgttacagagggtgtacatagacatttaaagacgaaaataaatctagggttaattgctaatttgtggaggtggagggagacacttccgatatgggcttagtctattacaaggcccaaggcccaagttcggtttcaacaacaatactgtcttattttgatgattcctgttgactcgggataaatttgaatatgagaccggatgcgtttgaaaggtgacgagataagctttccatcaagtccatgaccactcaaatcagagttggcatgaatgcactaggtccgtttgaagtcactgctgtcttcggaggtgaacttgattccaaaactcattggactttaatatcctgtagatcatccattcatccgatgtattctttagcgatgttttatatttatcatgcttgattgtatgcatatacttgatggtcacatcagtttgtgttcccatctcctctcattcgttttccgcgtgtacgcttttgaaactactaaatgatgtattttgtaaaaaaaaaatctatagaaatgttgttttaaaaaatatattaatctatttttcaagttattttaattaatatttaattaattatatgttaatgagctgctctgtttttcatgttggaggggaaggttgtcaaccaacactaacgaacccatcctaagggtttatttggattatggggtaagaagagtgggactggaatagaaaaatgagtgaaggttatgatcaaaaggaagaaacataatgaataatgaatgattaagatttatagatgtcctttgacgagcgagaaattatttaactaacctattaactaaatataaggcctaaggtttatggtttctaagtcaaatataaatggctgtcaaaaaaataaaatcaacgtgaacgcgtggcgactgaaatcttgaaatgagacagtgtgccaaacctgaaaatcgtacttggtgggcatatgtcaattctcgattttgaataatcactcgaagtcgaaggagcagcatcgtgctctagacgtcgatgttaggcatcatggcaccaatagtccgtcccaagaccaccgattttttgcatgttcagattattttgtccataagaaaatatagttttcggaatatgttcacatcccccatttctccatgtttgttcctagaacttcctagctactcctggcttgggaaaaaattatggtatccaacgcacacaccagatcaaatggtttgaagctcaaaataacgttccgggattctaaacaccggccacggtgttgttcctcacttccttgcgcggggaccgcgcgcctgaccgcggtccgtctgatgcgccaggcaggatggcagcgcgcgacgcacatgcatatgcacgcgccccggccgatcatcgtcacgcgcccaggatcgcatcggagcaccgcatgaacttccgttgttccgctgttcgcgcgcaggattcgagccgcgatgggccacgtacgggcacctgcggggctgtggctgcgggcgaacgatcgagccgagaacgcgacaggccgatccggtcggctgaccgatggataaccaacggttgggtgggtctctcgtcgacgcaggctcgcagcgtcacgtcgtcgtcgccgacagcgaccacctttgctgtccgtgtccccgcccccagcacgtttctactcctactctactgctccaccaccggcaccagcagtctcgcaacacatctatggccttatttggatcctccgagctattaaatagtcctttaaaatcttactatttatgag

SEQ ID NO: 68539 - DNA, 1809 bp, Oryza sativa
aatctaagtttaatactcctaaatagtaagattccggagggctatttaatagacctccggatccaaacagggcctatattgatgtaccacatgttagaacaggatccctgccccttgctagctccggagtactactagccacgcgtgcttgcgagggtggatttcgtactagtaggcgttgaagataaagctaatcattagcacatgtgggttactatagtacttatggctaattatagactaattaggctcaaaagattcgtctcacgattttttccctaactgtgtaattggtttttcttttaatctatattaatgatacatgcatgcaggtatccaaagattcgatgtgatgtttttgaaaaaaaacttttagggaactaaacggggccaaaatgatgtgaaacagagattagcatgagcctatgaatgtgagcgtgactgggctctattttctttgatttgatcccctctgttgccggctggtggaggacggaataacaaaacatggcatctcccctccagccgctcgaccaacccacttgcagagtcgcggcaagaaatggggtgagagtgaagtcggcaaaggggagaattcgttggatcggaccaaaagcggaccgaattcccgatctaaacagcgatatgagcttatcccctccgatccaacctatccgccgcccaacttcgtcatgcgtcacgcgtcaaaccgttcctaacttccgcaagctaccggcgaaaacgcccacctcacgtacataccgttcgcgccgttacgtaccggaagctcgcgttcgcgtcgcctacctgccgtgccgtcacatgcgtttccagaccaaaagcacgcatagccgcttaccctatattatccggaattccggactccgtcgccgacgcaagcgggacagcgggtcgcttcgctctcggtcgctagctcgttgcccgtcgagtcgtcgaccacttgctggtggaaagtggaaacaaccacggaattaacttctggtgcggttcaaggcgtccgttcgtgcgtcgctcccgtctcgtccgttttttggtcggcgtccgttctgggttctcgaccaatccgacgacgcgcagttgttggacacgtagggcttggatggtttaattacaggtgacctcgtgctcggtagatagaacagcatgcagatgcagtgactgaacattggatgatgtgcaagcagtgattgacaggtacactagcaactgggtgagagagacttgatgagtactatgccggtatggaagttggtggtgaaatttcatttacgcacgcttgcactgcacagtgcagtgagtgtgtgagagtgtgagtgctttgtcgctttgaaaagggacacagtgcaaggctagctgcaagcaggctgaggggagagggctttgtggttgctgttattgtcacgcgtgcatggatccgcattagcggcgctcgacgcctccgcatttagctattctagctacttaacccgtagctactactgcttcgctggtgattgtacctagcattcgcttccagcgaagcattgagatgtctacctttatgagaaaacggacaatatgacactctgtaagattggtttggataaaatgccactcaatataatgcaccggataaaatgccacttaatacattgcctacaggatgaaatgccactttagagacttttgtgcccaaaatgccctggagagagagaggggggaggggagaggggagggctggccggcggcggaggcggccggcagtgacagcggggagggaaggacgacgacgggggaggaggatacgcc

SEQ ID NO: 68540 - DNA, 33705 bp, Oryza sativa
  unsure (1)..(33705): unsure at all n locations
ccgaaccaatcttagagagtggcatattttccgttttctcctacctttatgtataccacgggtattgccatggacacctcgtgtacctaatagaggacatcagcgtccttggatgactggacagaaagctcacgttcacaaatcacaataattctgtgtccttcagttgatcgcctgatcggtgattcggtgaaatcatcaaatgtatcatgtatgtagtatacatctaggatcgttagtgaccacgttgtgtgtggcatgtcgttgtcaatttgcccatatgcatggtccatcaagaggaaaagatgatgaataatggcggtccaaactccaaaggcgtgtgtgcggtggtggatagctgctctgagatttgggtcatgttttttctccaacaaaagttgaataaagattaaaattttcgtggcacgcttttcaaactgctacacagtgcgtttcgtacgaaaactttctatatgaaagttgttctaaaatatcatattaatctattttaaagtttataataatttaaacccaatcaattatacgttaataccaccttattttacgtaaaaaacttaatcttcatctttagaagaaaaaaacaccaccttgattgtaatccggtagtgcatcgtgctactattatcatacagttaattcatctagagaactattttactgtaattaaataatcagttgaataaatattatcatcaattttcaatacagcaagttaattgtattgtatattaaaaaaataaatatggcaataactaatgcttattgaaatacttagtattatgcatcagagtgtgactgtgaagcctatacaaatgacatgttgggctagttgttgtacagtgcagctactgttctaatttgttatagcacagctatggcgcaactgatgtgcaatactattactattatataactcaacaaagcacgctaaactttatgtcggttggtgctgcgaaatttcacatgtagatattggcttcctataggtttgcacttatggtttggaccaaattttcggtatcaccaatttattgcggtttttttggtatttttggtactcttttgcacacttttttttttaaaaaataataaatattgactgaatttgttttttttttaccaaattccaaaaagtttggaaaaatctgaaatttatgggcacgatagttgcttgccggggtttcaaaatttcaaaaaatttgaaccgagatttcaatcactgagtactaattgaccatgaacaattcgggacgatggataaaccaacatcagccaaaaagaagtctgaaaagctttaccattgctggaaaatgggcatcttactttcaccgtactgattgcacgtctagcttaaagttccaaagggtctaacgtgagtgtggcttgtccggttgccatcaaagacaatgcatcagtgacacgcaaggcacttcctccctggttcgctttctctgctaggttgccctcctggaaaaggaacggaaaatatacaggaatagataatctttggttttgtgggactgcgttaccactgatccgctgttgagtcattaatcctgcttttcaaaatgctccacacatggtaccgcaatatgtgtccttttttatcaatctcccgttctgtgtggagcattacagcaaaggatgatctcacactggacgtggcgtgacatcaaaccgtgtcagtttttttttaattattattgtggattgccagctctgagcgatcgagtacgtatactggaccagtccagatcattggctgccttgtcgtttttagccgcctaataaggtgcgtcttaaaatgcacattttgtttggaaaagaaataagtgtacaaaataaggtcttttagtggtctctagccgaggaatcttatttgcgaagcaatggtcatatgctagctatacaaacatagaaaaggatgagcaattcgtccgtgcttcaacacttcctcatatatttaaccttttcttatgattcaagggtatctttataatgctctatgccagtaatactgtactatcaaacgacagtagaaatgaccagatttataaattctactgccagtaaaaacattctactaccatgatccacaaacgaaccatacattgaatcaaccaatcattttttacagtggatcccagcaaaacagttcagtgcaaattatccttggagatgcccacgtgatttaaaacagacaaataaatcacattattgctagtataaatacttcaaccgatattgctagcacataaaagtgccatgccacacttggagaaaagtacagctacgcattacactagtttagggaaaagggctaggccacaatatgcacgaggtgaaacaatacactgtagagggaagtaggctacctggccttgcttcgtggagactccatggtcttgacaagttcaaatgaaaatgttaaatgattaatcaacgttagctcatttttgacgtgtgatgacattttctaacatgggattttctaatggtgatccattctgcgagacgtatgactactgactataatgactacaaacagtaagctagaagttttagggatgccaaatcgtcctgtccaaaccataagctaatatactttttaaattcatcagggtttgtacactggtaaaacgtcggtcaattacaagcgaccattgtttctgctgttgccactcgcaaagtcgcaagcatgagatggctggaggtaatcaaagtatagccatagctaactatagctccgggggccatagtaatctcactgattgccgctgtccccaaaaaaggacaggaaaaaagcccccacgcggccaccaccaccagcggcctggcctgcctggctggccagtctctcccacctaactacagtagtatggtcgctgaggtgagaccctaccgaacaacaacaaattcaacaattctcacgcgccgctactcccccgcacaacatcaaccagaaacgtctcctcgtcaccactcgccacaagtccaccgcagcacggcgccctctcctctcctctcctccgtctcccgcctgccgcgaaaccaaacctcgaaaataaaaccaacagtttccctcgcggccgcgcgcggagacgagtagacgacagcgaatcgctgccggtttggggcgcgcgcggatcgcggcggagggaggcaagcctttcggtttggtccgccaccaccaccacggccaccgcgcctccgcctcagcgtccgcgatttttttttttatcttttggttttggatttccccttgtcaaaactggcaggattcttctgcctgcccgagcctgactactgttgggttcgtgctcgctgctcccccacgttttgttttactagtcgccgccgcaccgaatatttttcccacctcgctcgccacgccgccgacacccgccgtccgcttccgcggctgccccgcgcgccggtgctgtgtcgccgggctgcggcggaggagtgccgaccttttcctccggggtgaatgagagagatgtgatcgtggcgaatcccgagctctgccgctgggctgggaggcggggaagggaggacaggagatggggcggcgtggaggaggaggacgagcgggaggcgcgtggattggtggctgtgtacttgcgctcgccgccaccttggtcgtctgcgtgctcgtgatccgtggagctggaggtatgtgcagtggtgtgctctgtgctgtgctggtctgctctgtgggagttttgggggcctccttgttggtctagtttggccaggatcatgcagttccgatcctgaatgctagagtggtttgcttgttagatttttgggttttgagctgccagaacccgagcctgcagcggaagtttcgtactattattaagttttttcacttgggtctctgattcttcgaattggatgggtgattgatgttgaggttgaggacgttgttgtgatttgatgggtgccctgattgtaacatctgctaggatcacagaatattgcagggtctgaagaacatcgccctcttaagcatacgagaaggaataagatggcacgtgtaaattagaaatacagatgcctcaattctatgcacctaaaatttgggggcaggggcgagtgttatgtccatttcgttagctaccttttttatttcctatgacaaatagagtgtttagctgcaaaataaactactgaagcttatttttcagaaggggcataagacagacaaattcaaatggacaaacttttagaacataaatctcggacaaatgctgtaactttgcatgcactatatatgtcaactgataatattttcagttttagttgccatcttattagtttttaacccaaaaatacaatgatcatggacatcactgatcatttttgaccagtcgtattttttgttagcaattcattgttaagttattgcccttgaacaaagctcttgccacttttatattacatttaagctccaaagacaacccattcgttctattatattttggtttctggattatggcttgctatgctgacaaattgttagctattctgttcatgttttgttttcaaaggtttgaagcaatatcatgctcctgccttcgctcgaaaaattcttctttccataacaagcggacatccacaagataacttgaatattgtacttcatccgtcacagttacaaaccccaagactccaaagcttaggtctgaaagttaatggacctataccctgagatgctttcatttttgtttatcatgtcatgtattctgaactatatgcaacttaccatatttattattttctaggactaaatgtaaaaccacctgcagcaactagcagacgtgttaacgtacagcaggaactatatgcaccaagcccaacgatcagccacagaggtacattcagaattatgatttggtttgttatcctatatatatctataaagttcatcgccactaagtgtagtcaatgctatttctctcctctcattaagtcacatcacctcaattatttctagcccttgatgattgatctatggtccaaattatcttcctccttttcttctcttatataaagtcatatcaccttagttttgcctttggatgactaatctatattaccttctttcttttccttctctcatcgagccacatcaccttagttttgtttttgaatgatcaatccatatatgattaaaatttttataaaccatatcatctcaattgtttgtagcttttttattagtcgatcaaagatgaaaattatacaaaatgtagctatattacatgttatttctactaatatcacacaaaactcccgcagcaatgcatagggtttcatctagtttcttgaaattatgttgagaaaaattgttacgttggttttccctgaaagtcgtgtattctaccctagtgggttgctttgcacagatggcttatctcactgtctagtgtctaagcaaactttttttttaaataaaggaagctttatagatctcaaacaattacattgatacaattaatctaggaccactcctggcctctgtataactaattaggatgcgcacgacctataattattgcaaaaaaaaaaagcttcattcaccaccatagcaacacttggaccgtgagaaaggccctccaaaagcgatgcctccaaaagggaatggcaaactaagcaaactgtgctgcctacaatacaacctagtgctccctgtcattcttattagtctccaatcagagaaatatccccatgtatcgagagtccaggccaattgttggttagcttgatgttgaattctatctgcatcaatgttactgtcaaatctaggttgaaaatgatgaaacctttttgcttattcataggccaatctaccctaccttcacatatgatttttccaagttacagtcaaatctaggttgaaatgttttatatctctatcctctccgtaaggcatgcaaccaataagtttgttgtagaaataataataaaaaaagagacataaggtgatgggggcaaaccagcaaacccccaactccctttattattgactagcgttaataatagaatcacatagattctagccaataatcctaaggttactatgccacccataatggaatgaaagacccttgcctactgattcctgctcccctgtggtagcctcatagaccaaaagtagagccagtaggaagtcatctgttatgaatatagcttatattgaataatagccctaaggaggcaatatataggagtacaagagagcgtatatagaaacctatatatgtacaagactatattccttaacaacatgaacaaaacctgtgtaggattagacacttttttgctctagctaatgaaatttcattgcaagattgttataagcaaacaatcatatctattaatgcattccaaaaatagttcttttatgatccactgaaggtaccttctagtgttaacttttgtacttcttgatactccccaaggacataaaaagaactcttacagacacatgatgtacattacctgttgcttgttcatctacttcacaaactttttttatagcgacacatcctatttataaccggcaggctcgtctacttaactttcatcgtgccttcgtccaccaatactcaaagcatctacccccattaatttatccatatatgagaagtatatcccacccattcagaattttatgaaacattaccttagttcatgctgaaattaattccatcaatgtatgacgcaggtcttgctattcctccacttccaacaacttcacccccagttttcccacctcccatcagatcttatcctccacttcctgcaaataagccataccccaatagtatgtctctgaagcaatttttatacaagaactatatattttttatctgcttaccattttcctgtactgaaatatgcaggaccagcagtgtctccagcatcaataatccatcccaccaaccatgggaaggcccatggagttccaattgcagcacattcaaaagaaaggcatcatcattccatgcttgtaaataatacacatggaaatacccatgcaggtccagttgtggcacctccaaagggaaggcatcaccattctttgcctgtaaataatacccgtgtaaaaggtattccaccgactgcacaactaccataatgaacctattgctggtaataaaatgattcatgaagttgtatcgagcaggacctgcctattctccttcaaattctcccagtatccatagaaaacatggcattccagttgctgcacctccaaagcaacattccagcaatttaccaccttcacatcataggccccacaaaggtatgctgacagtaaaaaaaaaaaaagtactcatctcactaaggcaatgtttgctgcaggatcctttcctgtcataagccctactccacataaagctgataatgcttctgcgacgaaacatggacgttctggcttacaccatagtcctgcacctgcacctgtaggcttgcctccatctgaaggaaatgcacgaggaaatcctgcgtatgcaccacgtcatccccatgaatatcactcgccttcaaattctccaggtcagttagacattcttgaaatttctccttttcctttatgttgtctcatttgttctaacctctgcaaatgctccagtcataccccccctaagaacaggccataacatgcacggccttctatttatcatgatgttgaataggattataggacactgagattttgcacggtgatgcaagaattatctctggtatacttgataagagtacggagattgaacttacaccttttattttagtttgcaacccgtcctaccttgctatggtgattaaacacatttggatatgatactaatatttaggtccacaaatttccaccttccactaagtttatctaaatgcaaaagttttatcttctctcaacttatgtcaatcccagtagggccaatttagctcccctgttgcttttataccaatttcaccatataatttgtttttgttattttccatgtcattacgcctatgcagaacctggtctaccacctgtgaatccgcccgacagtcatgcatttaaaaagcccaagagtttggcaccagcaccccaatcatttccgccaccgcctccgagttcatgtatgctacctgaggatactatcttttgtatatgaattcatcaatatatgtgctctatccaatcatgtaagctactcagctgtgatccattcatcttttctatttgccagattgcatggcgttaaattgtcaagatcctctgaccaatagtctccctggaactacatgtctttgtgtgtggccaataaaagttgagcttcgtttaggtatagctttgtacacattctttgcattggtatcagaacttgcacaagatattgcatctggagtgctcatgaaacaaagtcaagttcgtgtaatgggagcaaatgctgcaactgaggacccagagaaaacagttgtccttattgatcttgtgccactgggagaaaaatttgacaaggcaacagcacttttagtatttgaaaggttttggcacaagcaggtcaacataaactctatgcattttggaaactatgatgtgttatatgttacctaccaaggtaagagctatttgtaatttttattgtgtcattatacatattctctttgttaattcctataaaccttattggattttccgatattcgagtaaatccttaattattttgtttattattcaggtcaatcagttcacttcctctgtgtgtgtgtgtgtgtgtgtgagtgagtgagtgagtgaaaccactggcatgatattctttttagccggatcggccaaaggaagaggctgatcaaatttcattaagattgatggagaaaaaaaatagaaattgtaaaagagtacaacaacagtagtctgtcgaaactggtggcaccccagctagctgggtaaccggaaaaagaaaaagggtagggatgggctagagactagtcgccatctcctttcaaaattcctgctgtcctccagacagagatttcatctctaatttcattgacatagtttgttttttagaaagggtcttgatatggttactttcacttattcatacaggtcttcctccgtcgccaccaacagctcccaggatgaacaatggtcttagcaatgttaatgatccaaggttgcatccacttgctgttgatgtgggaaaccacagagaaacaaaaagcaggggcataattgttataattgttctttcaagtgtctttgcttttattttatgttctggagctgcgttggtaatttgtttcaagattagaaaccgcaaccatttaactgaagagtcacctatgccaccgaagcctgcaggtaacaagacattcaatccatgcagtgttgctgtatttatctttattagtcacatattagaaaaggtgtagcaaatgcaatctggtgaaacaatcattgtcattctttccatgactatgggtgagttcgctactggaggtttccaaccgggaacagtgcgcgcggaaaacggagcggttcattagcgcgtgattaattaagtattagcttttttttcaaaaatggatcaatatgattttttaaagcaactttcgtatagaaactttttgcaaaaaacacaccgtttaacagtttaaaaagcgtgcgcgaagaaaacgagaggggaaagttgggaaccggcagtgccgaacacaccctatatccattctgaggccttgttaggattgtttgattattttgtagaaaaccaatccacataaaatgatcattcgttttctagctttcaagaactgagaagttatgtttcatatttgtatggttgaaaagtaatattaccttgaaataatcaaagaacaagagttatatttcatgcttaagtagtgaaagtacttggaacagctttgaccaaatctgaaaggattatatttttgcaaaagttaaaaactgatgctaaattattttcttccatcaatgattgcattggaaatgtaggtcctgggtctgcagttgttgggagcaggctaggaagcagacctatttcagcatctccatctttcagctcaagcatagtgacatataaagggacagcgaaaacatttagcttgattgagatggaaagagctacacaaagatttgacaactccagaattattggcgagggtggttttggacgtgtttatgaaggtattcttgaggatggagaacgggttgctgtcaaaattcttaagagggacgaccagcaagttacacgggaatttttagctgagcttgagatgcttagccgattgcatcacagaaacctggttaagttgataggtatatgcacagaagaacatatccggtgtcttgtgtatgagcttgttccaaatggtagtgtggaatctcacttgcacggtaatattttgttctctttttttttcctctgaacagtttctaaggcatcatttgttactttatcgtgtctattttgcttggagagatgcatcaaaccagtcaagcactttgttgacaagaaattcataattctgccctgtagataatacagctgttgtcgcttataacaaagtcacacatgtgaacactgtgcactaagacatgaaatgtattgtgcactaatctcctgttacattatgtttttttaagggaatcccattacataatgtttcttaagggaattcctttccatcatgttgacaaatacaaacttgcattttataaaattttgacatgtttcatggattcatagtacatccatattctattctccttaataggtgacttttttggccagacataagtattttggccggtccgtaatagctaactagaataatatggttcttttttttaaaattccaagcaggatcagataagggaactgctccacttgattgggatgctaggcttaaaattgcacttggtgctgcacgtgctcttgcttatttgcatgaagattctagtccccgtgtcatacaccgtgacttcaagtcaagtaacatcttattggaacatgacttcacccccaaggtgtcagactttggcctagcaagaacagccataggtgaggggaatgagcatatttcaactcgtgttatgggaactttcgggtaagttttgatctgaaattattatcttactacctgtagttggttaacatcctcaccttaaaaagattatgaactctttttaggtatgttgctcctgaatacgcaatgactgggcatcttctagtaaagagtgatgtctacagctatggtgtcgtcctccttgagcttcttaccggaaggaaaccggtggatattttgagacctccagggcaagaaaatttagttgcatgggcttgtccttttcttactagcagagatggcttggaaacaataattgatccatcacttggaaatagcatcctattcgatagcattgcaaaagtagcagctattgcttctatgtgcgtgcagcctgaggtggatcagcgcccatttatgggtgaagttgttcaagctttgaagttggtatgcgatgaaggcagcgagttcaatgaatcaggaagtttcagccaagatttacatattcaggattctgggattataagtagagcaagcctggatgtggacgtagaacctgttgtatctgctgagctgttcaatgcatcagcacattatgacactcttgatgcatctggttcttttcgacgatattcaagttcaggtcctcttagggtaggtagaaccgggcacaatagggagaggggtttatcaactggtagctcaagcgagcactgtggtacacaaagattcaggatagattcagagtagtcagcttgcaggcttcttttgacgatgtggggctgtgttcattggcttcttttcgcaagccacatttcatattcattgtgaatatctgtgaagagcactgagcaatatcaccagcttctgccgggacaaggaccagttttcgaagagcactgagcaagactgcaagagtaccaacatctcgtcccgtcccgtctctgtttatacagttctagagatctataaagccggttccttttttttagtggaaagtaaagccggttcatcaactgcggttcatcaactgtaaatgttcatgtaccttcccaagtgtagccattcctttcgcatggaaggtaagtgaaatatcagatgaaatgaagggtatttttgcctgtcatcctttcatccggttcaatgaaatggagtcttgcatgatttactgcattttattgatttgtggtaccaaacagatagaaacgtataccagttgtaaatctgcgaataaatagccaaacttgcataagtaggccttgtttgacacttagaaactttagcgaacaactatattcttgtaggggttaaataataaaagggaaaattgaaaccatgccattataattttacaaaatttaagatatgtcattctgaccaacatgtcattgactcatatgggtcctacatgtcattgagataccgatgatatatcttaaactttgcaaaattataatggcatggttccaaattaccataaataaaattgttgtgcgataaacagctaaggcaaccagtggataaacttaaataacattcctgaactattcacttggatgaactagcgagtcaacttggcataatcatttcctcattgacaacttatcctaccacaggaggccgggatatattagtagccttcctcaacaagtacgtgtgccccccacacctggctggagtaaggggatacactataaattgctaggattgcatcaggttacatcaggtcatgatactttgtcggccatctcccagatggggaaaaaaatcaatattcatccatccaatgctgaatacaacaccttactggaacaaaccacactaaaaaaaatagtggtggtggcaggaggcaagtatttcatcaagtagatgcattgccctacgtggttacatccaaactgtagggtttccagcactaaatcatttcacatgataaaaaaaaaactggcaatcatcagagaacatgaacaaaaaataaagattgcagtgggcaaatatgaactgcaaaagactaacaagcaaatcaaaccgattaaccgataaacaaaggtgagaaagaactacgacagctagggaatgtatacatgtcttgcgagttttaggttgctgaaggagcttccttttcctcagctacagctggagcatcttgttcttctgctgtaactacagaatcttcctttgctttgtctagacccacagctaccgagagccaatctgaagcaggtgctccagtttcaggagccacatttccgtgtatattcagaggagtgacagatatctgtaggttgtaaagagaggtatacggttagccactttacacttatacatgcatgtgcacacacagagcaagggaaggagggctcacaaatccattctccaaagctctcaaatcgatatcctcgtctaagcattcatgctgcttttcagtgaactgcattcaacataatcagagaagaaaacagcgctcagtaacatgttcatatctacaaaaacatcaacgctaaaaacatctgtaggctattcacaatctccatatgagcatattggcctaatttggtactgtcttaaagttcatatgttctatacatggtcggacaagtcaaataatctttggctataacactctggaagatatatttacctcagcacggaaaagcttcttcactacttctcgagcctctgctttccctgtagatgcaacagactcaacctcgacaatcttccgctgagcattaattctgcgtgcagccccctgtagatgaaaaccacaacaaatttgaggatgtgctaacaaggacacgtcaaatttctctgaaacaaaagcatggcttcatactgctgcagatgcatccttcccaagttgtgcgagctgaataccaaggctttggtgcatgcccatgaagtgagtagcaggtgtaggtctgcttgtggacacaccttcccaactttgggcaggacgatatatgctttgcttagtcagcttgaaaccctgatatcagatatcaggagagagatgcattaaagaaaggctattacattaaaaaaaactaaacgagcagtagatctttttatccatcagtcatcacaaagaatgcaaactaacacaagataaaacaaagtgggatggcttcgccagtttcatgatctaaatttcaaataattaactgttgctcatccaattaatagtgttgatctcctgtacagatatttgcatgggcatacaatctgcatatactatataactttcccaacaactagtacacacctgataaataaggctaatggatatttttgcatttgtgggcaagccagtaaggtaactagtaccaggacgactaagacagtaagcattctgtacagatcagaaatcatggactcacgatgcagaaaaatagcgaagaacccatgaccattttgaagccaaggaaatatgaatgacatgtttcagcatatttggaagatacgaaagcttcattgtactaattcttagcaattcaatcatcggtgaggtgcaggcagctgccatgagattcctgaacactttcaaaaccttaactccaataacaaaggaaacagcttatgttctgttttgaataatgtagaatcttgtttctttgccctcaaggctagcctctcaaggaaatatgtattgctctagtccatagtattatagcaacagcacggtcatgtgctactgtacgtttataagccaatgttggagaagacaaggagttggtttacttctatagctatggaaattttggcctatggtgctagttttggccctaaactggagttcaagattcagaattcagttattagcagaataaccttatttgtagttggtgagcttggaaccccaatgttcagtaagcagcctctgaggaaggttcctttctcaacgccttccaaggcagcgtgtatcaatggtaggcaaacctcagcagcatccttgaaatcactatctttgctttcatccttcttcctacttgcacatatccagcacaaattgttaccaaatgtgattgcataaaccaatttatctaattatgaaacatatttgaaatactaatatcacaccattaaggcacacccaccaattcaatgatattgcaattgaaggaacatcatacagtaaggcctcccttgcagcagcaatggcagaagaatgaaacctacacaattttgcagtaaattaaagaacaggatagaaatcagacaatgaattgggcatttctgaaagaatcatacatctcatatccacagttcgcccctgcattgatcccactgatcacctataaacgaaacgaaaacatcctcaatgatcacaaggttaggcgatcaagttcttacacgcagatagcaaacacaatactaaccaaagcaggcgccgaccaagagaacagcctcccagataatgccaaagagacgcaatccaccggtgtccctacaataacaataatcgcaatgagatagaaacaccaactctcactgtataccagcaacagtgcgacccaaatggatcgaggaaaggatgtagaacactcacctgatatctcgaaagctttcgcccctttgaaatccaccgatgttgctgtaatggtctcgcggatggtaatggaatagccgcaagcaggcttgtcccttcacatcatcatcaagaaaacaatacagattatttacagctgggaccaatggattagttggttggtagaattcgcaacaaatccagacaaaacaaggtattttcccgaggtcaaagagaatatcgtaaggaggaatcgaggattggggggcgcatacgattcgggcgcgcatacgtggacgtcgcatcggccgccggcgacgagggagtcgacgagggccgcgagacccggcgcccggatcccgccggcgcaggtcaggagtacggccggcttcgcgggaccttcatcggccacgggagcagcgccggaggactccgccgcctccggtgccggggcctcggcgccggcctcctccgcggccggcggcggcggccggcgcgccgcgaggacggactgcaggttggacacgagcgcggacgggagcggattgggcctcggcgcgtcgtcgccggagctcgcggccatcgggcttcccttcgcttcgcctcgccggagaggtgtttgggcgtggaggagagagagagagagagagagagatgtacggacgaatgaagggaagagagagaggaggggttggaacgcgaggggggaagagagagagagagagagagagagagagaggaaatggactgaaatgggctgggcgcgccatcgcatagttaatggatttctagaccggggcccgctttacgtgtagagggaggcaggtctctgttttgacctgcacagatacgtgggaaagcgttatctactcgacgactactcccaacttgcctcagcaaagcgtggcaagaatccgtgattctcccgttccgataccaaatccactatcatcaaccaaaataatagttttactggtattattgtgaccaacatgcgggcatgaacacggaactctgtggctagtatggggtggaatcttttcttaacatggattacaaaattttacatatttttttaccaacaatggtacagcctattttaaatgaaaaaaacaaatacaccaaaaatagtaaatctagagataaaatactccatctgttctaaaatataggaacttttagctggttgggacatatcctagtactacgaatctggacaggagtagatatgtcccatccacccaaagttgctatattttgagacggagggagtagttgtaaaatctaattttgatgcagtaactgagtgtagctataagttaggtataaaggaatgtaaatcttgatgtatgatccaatgaaaaaaaactgaaagatagaagtccaaaaaacttttgttcgtgaaatatcaaaactgcttaataatcagatgatatgaaagtgaaacgttgctgtgttgaagatgcaggccaatgtagtgggagaggtactcgttgtagtacaacgttagtacgtaactacgctcgtacggtgcaggatcagccggatcctcccttgaccacgtccatctaagcgagtgggccaacccgcgggcgtaaacgctttagggttcgcccgtccagattaattcccgttgtaccaccaagcacgaggacaaacgcaagacgagctcgctcggtcgctcccctcgcccctcgacacccaccacaccacgacgactcctcgtcgtgcgaggtgcgcacgttgcacgtacgtagccgggcgggagacgcgcgcgcgcgcggacgcacggttgctgcgacccacccaggcaacagtcgtcgtgggagcgcggcgctagctcactacccctgccacccccatgtgcctccgtctcagaactcatgtgagaagccgtagccagccagtgcggcggtcggttccaaacttccaatgcctcgccgagcgatagatcggcagatcgccccgcgggggtgggtgccgtggtggactggtggtgggggcgggccggcctatctcctcgtcggatccacccgcccgcgccgtgcggaaaggctaattttagcctgcggctggttggctggatcggtcggtgaccggggtggccgcgcccgcgcgcttgggttgggactttttgggagtcctcgtgccaaggcaaacaaacgttggtggaccatcaacgggacacgtgctgtggcgacccgatggaggcgagcgttgcgtcgttttctcttcgtaattgcgtgcgaatttatttgcggagcccccgagcctctgccacaggccacagtggaaccgtacgtatgcaccatatgttaatcattcaggatttcagatgcatgactgcatgagggctctctcattaacgagtaaggagagagatctggagatctggtgctgacaatcattcgtttctactatactgtgtagcccccgtgccgtagatggttgctggtagtttgcagatcacccaacgaataaaataactttttttttctggcaggctaggaacaaggaacactggcgatctgtttatgtgactaactttgccaaaccaaattttaggtaaactgggcacataaccacacgttaatcaagctcatgtgaaattgacagttgatatttgagattatatactaatccctctgtcccatttcaagtacaactataaatttccgtgtccaactttaatcattcatcttatttaaaaaacttttataattaatatttttattattatgagatgataaaatatgaatagtattttatatgcgacttatgtttttaattttttaaaaaaattaaataagatgaacggtcaaagttgtacacggaaaattatctctgtattttaaatgggatggaaggagtagataaaattggtatggcaactcacgattataataacgaatcaaacgacatcctagaaagttctggcatataagatttgacctggtaagttaagactatgaatcaaagtatttttgtatccggccaataacacgtattatgagcttggaagccaacctactattccctccatttcatttcaaattatgagttgttttaatcttagtgtcaaactgcttcaattttatcaaaatttatagaaaatgtagtaatattttcaacgcaagacaaatatattatgaaaatatactcaattataaattcaatgaaactaatttggtattataaatattactatatttatctataaacttagttaaatgatttataatctgaaacggagggattagctacaacttgtgaagttttaattctcctatatttttcttctaagattttttattttaaacgtacggttgctgagtcgatctccatttttcctccacttccttagttatgccacttgtttaatgaactaatttatttgactttgtaatatccttttgtctgttcaagttgacgtggctagcagcctagcacattgctgtacctactactcctatgttgttatgaaattcaatatgcattgattacatcgatgacattccaacacacaaggggcgcaatcgaattaccacatccgtacgtttgtgacgacttagtatttgtttgtcactcgatacgggcatggtgataaattatcactcgatacatatttgtttgtcatgacttaaatatacacaatcatataattctctcggccggtactcctacaagattaatcagtttgctggacgctattattaggcatttccatgattaaccaatcgttgccaccttttcaggcctacccacaaattatttaagctatatgtagcttacgcacaaaacacctgtcatccacatacgccaccttaatttagcacgcaccagagaaactaaaccgttcactaactaaacacgactagctagctagcgaacgaaacaaaacaccaggcatttatacgttacgttgcatcttgagcaagccgcacttgcatagccttgggccaaattaattaaccggcagcacgttgcccggccggttgatcgatcaccaccagcaagctagagatggcgagacgggctgcatcggtggcgctggcgtgcgcggtggtggcggccgcgatggtgctcccggaggcggaggcggggcagaactgcatctgcgagtgcgtgaagctgtgcatgcggacgcggatcccgagcatcgaggcgcagtgctcgggcaagtgcagggagacggcgtgcgtgcggagctgcgaggaggcgtgcgcgcgcaagggcttccccgccctgcccggcgagggcatcggcgcctgcgagctggagccgctcacccccgacgaggcgcacatgctgcactgatcatcgagtcaccaaccaatcgatggcaagcctcaccgccgtttccgtctctgtctctgtcgctgtgtatgtttctgtctccgcctcttctgcgctgttgtatacttgtatatgtgtactacatctaccacaccggtcaaagtgacattccatcctggctcatgtgtcgcgctacatacgatacggtgcgtaagcgtaacatacgtttgattattgtcagttttgcttgctatggtcgcggttgcgcactgacgggatcgaccacatctctgactctgaggcccagctaacatgtttcctgggcccgtcttaggaagtcgatgcaacgaggcttttagcccaaataatagtggacatcccttctgctgcctttcaggtttcagcccaaatagaaccgtgggctgccagcggcgctcgtgggtctacgcatgtcggtccgttgcgccgcagcagaggttgctgccttgcctgccactgtcatgtaagcaaattttttttgccgtttccttatcttatttcgttcatgtgtccgtttatctttttttttttgcgcaattaacgagtccgtgatcgactttgttggcttgctgctatctgaagctctgaacctgttgagctcgtggcacgccattcgcttagtccacatcaaagacatttgtacactgtagtgcacccttgtcctttacctacggaaaatactaatacatgcatcttcgctcgttagcgaaaaggatatgcttgtctttctaggaaatgatctcttcaagacaacaaatccatgttattctagaaatgagggcaatgatgaggagcaaattgcattggttgtttctgttccagtccatatatatacacgctcaattagtaagagctagccaaaactggcatatatactgacattgaataggtttttgcttaaatttttctagcagattttgttcagatgatgttcgcagttagatatcgctcgttgggtactttttaatgagatagtacgagtccccgacgggggaaaaatctaaggcctctttgattcaaaggaaatttataggaattttaaaggattttatttctatagaattttttcctatatagacctttgaatcaaaggaatgaatcctatataatcccatgaaatttctatggaatacctctttccatgtaagttttagaggaaatttagcatgaggttctacctcatgttaagaatcttttgagtctttatccctctttaaatttctgtgttttttctatggctcaatcaaacggtcattcctatatttttcctgtattttacaatcctctgttttatacttgtattcttgtcagaatcctatgtttttcctatttctctgtttttttattcctatgattcaaaggggcccttaaagctcatttggcacgcatgattctcaaaatagatgaaaaaaaacgctggattgaagcgtcttaatacatcaaaacctatggtttgaaaaaaacgtaggagaaatgagcctaggaaaataagagagtcagaactgatcagaagagatagattgacacaaggattttagaggctaaacctcacgtcaaaatcactagtttcgaactaatctaaagaaatttcatataatcttttaatagttattgatttgatccaaaagactagtgtagggtttgttcattttggagaaaaagaaaaggatttatttttttaagcattcggttttaaaaaagaagtataggaaattttcctttcctataagttgtagagagaaaacataaaagaatatcatgcatccacttaaatctcttaaaaaaattcatgtgaattgacgtgtgcatgtctttctattccttgaatttttggttgaaatttctccaaactgaacaaacatgtgattggaaagtttttattagaattaaattcctaagagcaggtacaataacagactataagacagctataaatatattttaaagagataaagaaagagagaatagcagcgggctatagatcggtagccagctgcagcacggactccaagacgtaatgtgtgtttgacaggtgggaccaggtattaatagtacagtaaacaactattgtatgaattattccctccatattttaatgtatgacgccgnngacacttttaacaaacgtttgaccattcgttttattcaaaatttttgtgcaaatataaaaatatttatatcatgcttaaagaacattgatgatgaatcaaggcacaataaaataaataataattatatatatttttgaataagatgaatggtcaaacattaaataaaaagtcaacggcgtcatacattaaaatacggagatagtagctagtacattagctatagataatttagagatagtagcgggctatactattaaacttgctgaaaggaaaaaaaacgtttgttctaaagaagcttcgaaggctcaaacttcccgagccaagctgaaacgactacgagcatccaccctcgttgtagttacgggcccgggacttccgttcttacgaggaaatacttaaaaaataacatatacttccctctgactgtaataaacttttggagcatagttttgtgttcttctttttttttttttacttcaaagagggaattttattgattacggaaaagaggattacattcttggtctatcaagtctatgacactactagaaaaaacatttttcccaacgtaggggtcttattttcgcaggcggacatgacacttagagccaaatgaccgcctacaaaaatataaatcggggtgaaatttgatgtccgcccgcgaaaatatcgcaggcggaccacttaagtggcgcctgtgaaaatgattttcgcaggcggaccacatgaggtgcgcctgcgaaaattagcatggtatatatatgtgacagatgggctgaaatttttctaagtcctttcctctcccctcactctcctctcctctcccctctcctccccttcacatctcctctcccctcactctcccaccggcagaaggggcggacagcacggggcggctagcgtagggcgggcggcgactcccctccctcccttcctcccctccagatctggccgaaggggggggagggggaaggccggtggccgggcgcgaggcgttggcggcgtgtgctcccggcggcggcggcggcgggcgcgtccctccctcccgcggcagagggcggcagcagcgaggagggtcgaggcggcgcgtctcccagcccctccctcctagatctggccggagggggcagggggagagcggtggccggtggctcctggcccctccctcccagatctggctggaggggggtggggggagcacggcggcgggctgtggcggcgaggagggtcgaggcggcgcagccacggcggcgcggggggttgaggcggcagcggcggcgcggacgacggtgcggcgcggacatgcagtggcggcgacggacaacggctgggcggcggccgtgatttttttgaatgtttttatttgctttctttgctacaattgattcggtgattttggatgaattgaatggattggatggggatgaagtggatgaattggatggggaatggattgggaacgggaagcgaccaccgtccggcagtggctgcccattttttttagcgctcaaagctattttcgcaggcggacctgttgcccgcctgcgaaaatcaactatttccgctggcgttgaggtgcaggcggacggcttgtccgcctgcgaaaatatgatttggccgcctaggaaaagcctttttctagtagtgagattcttgcgggagcacacaacttccactcctcacacgatctacctcatagccatttgagctagagcatgagcaatcctatttgcttccctcttgatcttgtaaacctgcacactttgtgttctgctaatgcttctaaggtaatattggaacagcatttcggtcgctgcacctaattaattatccctatgtgtacattcatatgttggaaatacatacttttactctatttatcaataagaatagcgctatctatgcacattaggaagcacatatacatatatagtatagtaaatcagaagttcaactgcaactgatacctcacccattatatacgtacttaattaccacttaccagtcctacacatttatatgaaaaatataaaaatgtatctacatgtaacttatgtgaaacatatataccctaagatacatgttattttataaattaagatctatatatatatttgaaacttaattaagacgagaacgagtttataaacccgtgtgttacgcaagcaccgaccagaatacccccgaacatgcatgcataattgcatattcagggaatccagtgaggttgcatggcggtgttcgccgagaagctgtcgacggatgaagcactggccgccgacgtcgtcgacgaccccaggatggcgtccatgaagtccatcaccggacccatggccggatcggccaagaaagcgccgccgccgccgcccttctgttcgacaaacgccgggaggcaactccgggccacgacgccctctggagccaagagatgatcacttggcttgcactgacccccgacgatgccagcggcgccgttctccagctggtacgcctccgctgctcggcacagcctgatgaactccccgtcgacggcggcggcgtactgaaggtcgccgccgccgcagccgtggacgccgtggccggggagaaagattggctggtgggagctgaagctggcccatgccgcggagttgtacacggaagacggcggcgattgagtgacaccgtgagctgcattctccaccgcgttcagtgacgcagctgcgatgctctgtcctgctccgtccagaatgttgtagtacaaatctagatcaatgcaacaaacatcgagtcgatcagtaattattcagtattcagtacactattacatgtttgtcgtgagtaaattatattcgtactgatccatgtgtaaactaacaagaacgaaaggtatgaaaattcatatgagaagcagcattttttcagaaagaagtgaaaaatgtagcacaggttttacctgcagaggaagggtgcagactacccacggcctgggagatgagcttcttcttgatggtggagttccagaagttcttgacctcattgtctgttctaccaggtaggtgcttggcaatctgagcccacctgcatgcaatgcagtgaatcacagtgacacagcatatgttagccagctcaaatctcgatcgattgccacatttgcgccccgtcctttgtctcagatcaagttaatgcgattgtgcattactcaaatataggccaaagcgtgcaaagataagtaactgtcacactgtcatacatgggacgttacagcctcatcacatgatgcagttagcagcaacgcagagatgatttgcaggtagagactgaccgaccaaggattacctgttgcccagcaccctgtggagctcaatgatgagggactcctcctgctgcgagaagcttcccctcttcaggtcaggcctcaggtagttgatccacctcagcctgcagctcttgccacatctctgcaaccctgcatgccatcaacaatacatggataacacgttcaccgatcgatgccataaacccaagtaaactgactgaactgaactactaagctagtctgaagaaactctgaactgaaactctgaactttgatctgcgactgaaaaaactatgtaaacgtaataaagcacttaccggctagcctggggacggagctccagcagccatggccgtgcgtggagatgtacttgacgagcttctcgtcttcctctggtgaccacaggcccctcctgaccttctgcttgttgcagcaggagtggtgccccatctcccttgacctctcactctctcgctgtactccgtgtaggctaggctcttgatatcctcttcttcacactgccggcagtagtaataccggccagaactactcgagcttttcagtagttacatggttattataaagaagagaggagaggaagagagagagcaaatgagcaaatacgccaactgcatgcatgccattccgctacatctaagggcaggcagatcaaaagcaaggagaagaaaagctgggcctgaaactgtgcatgcagttgagtcgatcgtcctagctagccaggaccctagctaacctagacgtgtgagctccatgttacgtaggttacttcaaaagtgagtggctcaagccaagtgaggggtactggagtgatgagggtgaatggaggagggcattttggtaacttaaggccccactgtgagaggaagacttgtgccatggaattgagctcctatgcctggttagttttgggaactcctgtactgtggtgtaagtgtgtgatgcctgagttgggtgtgtgtgtttgcaagcgtaaattttcaccgctctatcagtacggccataactgctatagtctgctagtagctttcttcaaactactaacatggcagcagctaccatttagactagtatcaattcgtctgtgtacatctaatggtccaaatatgttcactctgatctatcatctatatttgtacgagagcccaaattgcatgtgtatacgttttgtattagcatgcacgcaggtaaaaacaggcattacctagtgactatatagcactaaataaagcaatgcacgtagtgccattcattcacctttgacaattaaacgatcaagagctgcgattctcttgtctatacgccctgccagagagaaagacaagggatcaggatcaactgcaacagaaacagaagatctctggctctctgtacgtatgtgcatgtcttcttaggtagcttgcccgaaaagattgcagttgtaattaagccgagtaggtggcgatccgtatttgccagcgctctcgatcggcaaagtattcgttctaggtaaattaaggaccgatcctaagcatgtatagctaggtttatcgatctgaagaaacctgtaatgtgtgtgcactctgaatgattcatgtttgcagacacaattttttagctgatgcactaactacactatgggtttatttgatagagtttcaactcataaatttagctctagtagttgaatctagagtaaagttgtaaaacagcctaattaaacccagctccgctctcattttaggtagagctaaaactgtttggccggatggagttgaagctagagctgtgtcaaataaaccctatatattttgcaacgtttatttaactctcaaattagcttcacttcagtttttgccgttgcaaccagtggtcgacacaagccgatgtcaagaggctaaaggcaatattataggttgtagtactagtaccgtagtacgtacttgctggcgaaagattgacgcgaaagaggtgagcggtttcggacaagaaaaatcgagtgggccgggcggggacggcagccgtgcatatgcatatgcatgggcctcttgcagaatagaggaaacgcgacaacgcgtagtagcattcaaccccgtaccaacgtacatacgcgcgcgatcgctcacagagtcgtcgatcaccccgtcgtcgcacgaccacttccccactcctctcgatagactccggccatgatcgaagcgtgcaccatacgggtgtggtcgctcatgcgcacgtcgctcgtgccatcaatgcgccggggacccgcgctacatgtcatggcatgtacacgtgctcgtactcgtactactaatatactccatatgcatggtacataatacatgccacactcaaaggtcacagctttgctatacaatgctatatatgctacaaacaatcatgttgtatatatattgtgcgtatgtaatacgtgcgaaacgaaatgatgagaggatttgcttgtatttacagttaattatccttttaatagtaaacaaagtaactataaataacgagatatgttcgtcatgatttcgttaacatcaaaatgtgtcggttcagttcttttaaggtgcgtgtttgtgtactatgctttttttgttaaaaaaaaaatgtcgtcctagctagcagcggcatgtacacatcctaaagacgaggaagagatggaggtacgcctgtaccggccggcactttcacgtacacctgcatgataggagagcaaaacggcatgcaggttaattaataaacaagttgcatggccgcccggtacatgacacaggtgagcatgcatcaccgagctgaggttaattatatcaggttaatttcctcctcggttattggattgtttgcaaatcgttcgtacctgccgcggcgccggccatgcatttgcagcagctagtggccgatcgatcacataagtcagtcacatgtgtgcctacttggttgaatatcagtccagttcgtccgtgcgtacccaaagatgggacgatgtgattccccaaccaccgcctacttctactactacagcatgcagcatgcatgccacgcccgagatgacttggttcagtggcaagctattagcccctgcagcctccttttcgatctgtgtttctctttctgtgtttaccccctttgtgtacgtgctacgtgctctgtttcatttgacgataaattaagtattagtcgcgagctacagtagctgttttcttctctccctctttgcgttaaccataagcaaacaaatggcacagcgcttgtacgtgaggcataatttaagccgatcgatgagctttgctatgcgtacgtaactaggtatatccggtacgtattcatagtgcccatccatcggatgacaaatgtccggtcttcgggaacggcagtacgtagaaactgctccatggtgcagaaagtacaagcaaatataatgcagctcttgctgcacttgtaagcgaagctacggaatacacatcctgctggagagacaaaaaatgcaggtatatatcttcatgaaagaggcgcagtttcttttttttttctctccctctcttcgtcttttcagttatcactgtccataattagaaaattgtcagccacgtacgttacgtgcatgtacacagctgcacgtgcgattgcgcctccatggactttcggagtagaaagtcacctgacgtgaacgggttgtcaaaaaaaaaaaaaaacctgacgtgaacggtgcagaatcaatctccccgccgtacatggagcaggagaaaaggagcataaatagttcgttcagagagctgttcggtgctatactagtactgctacttggaattagtcgtccaagaacgccgagatggattggagtcggtggagtcgataccgaaagagttgcagcagagattacaaaagtcgtgttgacagcgtgcactggcatctcgtcaatgcttccatttcataacctttccagttcatggatacaattcgagcatgacacctctctagcttcaccttttcaaacgcacaatacagatgcgcttaaccggattcgcatcctcaccaaatcagcctatataattaacctgcggaaccttttttttttcaaataactactatctccattacgttttaactttgatcgaagtcaaactcatttaagtttgactaagtttttagaaaaaataataatattttcaatctaagataaatttattatgaaaatatatttaattattgatttaataaaactaatttaatattttaaatactactatatttgtctataaatttaattaaacttgaagcggtgtgacttcaatcaaagtcaaaacgttttataacttaaaacggagacgagacgtcttgcatgatccgacagtaatcaggaggcaagatgaatttactacctgccccaacgaaggccgcgaacgagtcgttttccaaacccgtcccgtccaagagaagcggcacggcgacgtcgtcggtcgcagtccgccactcgcgtcgctttcaacggagaggggacgagggatatcgccgcgcgctgtagcatccgcatgccgttagccggcaacccccggcaccggggaaggagacaagccgaatccccctcgcggatatcgccgcccacgtcgccacgcccgcacgcccgcgcccgcgcccgcgcgcgatggcgtcgtcgcgttggcttcggatcggagtccggatgggccgaaacgacttgggaatagtggaaaaggatcggcttgctctgggattgccggaaaaggatcggcttgcggcccggtgcacggcggtggcgatcacttgggcttagagacgtgaggtgccgcgttgcttgaataatcgcccgtgtgatggatggggcttgctttgtcagctcatctgtttggctgaccttcaatttctagatttagcttcagaagttaagtctgggggtatagttatagagctgtctgagagtctatttggcacagctttagctccacctctcctggagatagagctcagccaaacagctccacctgaaatgggagcggagttgggtggagcgctatcaccaaatgaactagagaagtggagctgggtttaagcagctccacagctccactccaaactcaacttctggagctaaatttaggagttgaaactctatcaaacatgccccaaacccagctctacctctttagttcattttgtgagagtgcaccacccagctccgatcctagtgtaggtggagctgaaactgtttggttgggctccagctccgggagaggtggagctgcagctgtgccaaatagacctaaaattactgcactgttgaggataaatttgtctcgattaaatcaaaacagacataacacttggtaaagtatcgaccaaacaatagacactaatattttgtgtaatatatatccgtgcattgcaacggccaataccattagaaacgggttgggttggatttagcatattattttttttttcaccagatggatttccaccaatttgagctcgacatcaaattatattcaggaggatcaatcaattaatgtaactaactgttaacaaccaaatttggtaatatcggcattggaaaagaagattagattgaagcaaagtcggaggcggagatcgagttcggaaacagagcagggatcggctggagtccagatcggctacgataagatcggctgagtctgagtcggactaggtaagccgatgtagccgatcctagcaatacaacttgatgtgtgatgtcgggttagattgaggtgcttcaaggtgattgccgcacatggatagagtcctgaggaggcaattgtatctattaattaggatgttttatgtaatttccttagagatatgattaggcaaaagtctgccgcaaagacttatagtatcttagagtttgttagaaatggtagtcgtgtccgttatggacatatcttgtaattctcgggtataaatagaccggagccctatgtaacttttaacacacgttcaatacaatctcggcgcatcgccccccttttactttagttttgttttgacgagttcttgctttcgagttgagctgcatcggtttcgatcttcaacaagaggtaaaacttgttatgacgacttgtgttttcgggattagtatttccatctttatgatactctgatctcgtttatataattcgccgagctatcatatatcttacataatcttcggcaataccgctatctaatctacaatcggctaacatctgtcggtagaaggcagccgaccaggttaaatagcgacgttgacctaaattatataagatatttaccactttatgaaactttcagtggtttgattgtctagatattgttcttcttttcatacttaatactgcatcagttaagtttgatctattaaatcgtgcttagaatatcaacctctagcctgccttctggttaccgattagggtagcatcggagtttcagccgatcttatctgatttaactatatttgctctatatgctttattgacatgttaaatctgccctttatgccaagatattgatgtatttgaatatattaggcttttgcttgatattctatacctgttttaatatcctgatataaagtagtatcggagtattagccgatacatgctagatctatctgatcggctatgctgtaaacatatatagtcctgttattaatatatatttcggtctaagtgatttatactgtctcggcatggcgaccgatctatcccaatcacttgatttaattatatatcgatataaggagtatatatcgttaacatctacagccgatcaagtagatttagttctttcttacttattcaagattgccgatcaaatacacatatgacatcggctcaaagataaatgatatatcatcggcacttagccgatcaactatcatttatagatttaaccgcgatttctttgcttctacttcttgttgattacaggatcaaatcaactggcacactagcacacccgaaggcgagctttggacctgcactggagttaaacagatctcccaggcctcatgttttctgtcaacactaacacagctaggacctacgaggctacgagtaccaattaaaaatcctccaaacagcttatagtttggatggtaaacaatattaatagttttacacatgctaatatacattcgtattaatccaaatccttggcgaggaagaactaaaaccctatgcataaaataacaatagcaataaacagctctggaggagtaggtcaagatttatgggaaaacccgtatggaattttgaaaccttttgtagcatcctaaaagttgtggtagcaccctacaaatttacaacgttccacatctggtggatgtaatgaatgaaaataatgaatcggaagaatatgtaagcttgttagttaacacaattactacttgacaagattgaacctcagaggctttatacaattgtgacttcacaaaaggcacttgataaaatcttgaaagagaaccttgccctgctccatgtttcttacggatggatagaaacttcaattagaaccatgacctgacattttcttctctctgggaggtatcttcagtaaactcttcatcgtgtcatatgcggtaaaaccaatagccacagagggtaccacctataaaaagaaacaatatttttataagggtcaatctggctaactcaacacatttatgtaagttgcaactaaataatctcttgtgaatacacatcattcaacaagtaaggttttcggctgaaactgagctggacaaatagctaaaacaagaatattgaagacaatcatgcaattcaatgttgtataaatgaaaggaaccaaggaaaattaagttcaagagggaaaaaaaatgatctgcagaattttatacatgccactggaaagattcatacagttctgacatgtacaactggaatccatatcctcttgtcagttgagtggcaaatgcaaaaagtgatgcttttcagtggaatataaacgcaaatgactaacaagaatcgcctcgctccaggttagggtgcagaacattgctcagaattaccatgtaaccacaaaagtttcaaagccaaagcaagcacaggaatgctattttttcttggggcgtaaaggttcagaatttgaggttctaggaactattacgagagcgagtattattacttgggtctaaccagtaaatagttggttatcacttggttctagcgattctagctagcaaaatagttaatgtacttaaatgttccagatgattgacctgccatcagtcctagcattcttgattatctgactagtaccatttccaggatattttgaaatgc

SEQ ID NO: 68541 - DNA, 905 bp, Oryza sativa
tgcatcaagcaaattggacattgcttgctctttgaacaaggacaaagaaatatggacaacaagaagagttcaagacatgttgcatttccaaagttacatgagttgcatcttaaggggatgatggaatggaatgagtggacatgggagaagcatgtggaggccatgcctgttctaagcgtgcttcatgtcaaagactgcaacttgagccatcttcctcctggacttccttaccaggcaagggctttgaagagattatgcgtaataaatgctcggaacctaaactccgtggagggtttcagctcggttatcaagcttgaagtctatggcaaccctaatctcgagaggattgttgatcttccaagcctgcaaaacctaaccattgtgaactgtccaaagctgatgttgttggatggtgttgcatcagttcagatcatggaacttggggaccacgggatggaaacgctccccgagtacctgcgacatctgacgttacgacatttgaagattgtttgcagcttgaatctgctcaggttgatgtcgaccaagcatgatgcaagcaggtcagagtgggagaagatcagccatatcatgcatgtggagggattcgctagcgataacggcgacggcatcttgagatggtacatgtcctacacaagagatccatacaacctggagacaaacattacaagcagatagctccacaccaccaggtacatgcatggttttgttcattacgagtaaattaactcccctttgccatgcaatacatatggcattctcattatatcaatccagaaactaagcgaactgtaaatttattctctatctgttctatccgtatgtgttcagaaggtgcatcagaataaaatgcgaagttgagggaagaacgcgatcgtgatgggaag

SEQ ID NO: 68542 - DNA, 3009 bp, Oryza sativa
aaaatgatgaggatggtagctcctttagaacacctttacaaaaatatcatgactaattttatcatttaatagaaaactcaactataattttacaaaaacaaagaaaccctaaatagtgtggatagaataaaagaagaaatttaaggattttcataataatgtgatttggtacattaaattttaaattaaaaatcgattgaaaattttattcgaatgtacttttttttctcaaggttcaataaaactgcactaattcttataaaactatgcaaaatttatattacctctgtatttaaaataatatcattttaaaaatcaacacatactccattgcatatgttttatcattgttttcccgaactatatgtctataaaaattaaaatacagctatataggagagttttcataaaaatctattaaaaagatatttacaatttaataatttaagatgtcaaaatttgaggaagtcatttttttaacaaacataatactttttttaataacacgaaaacaaatgcatgggctataaaataagcacgccaataagcgtgctcaattttctaccaagacttgaattccaagctctaataacaccggtttgaactgcttttgcatgaagcgagggtaaaaacgtaaaaatttacaataaaggtatgacccaataaattgatatgggcttaggtttataccctaggtgtttcaaatggtatcatagcatggttatatgcgtgtgactaatttatatcctaggcgttggtggcattaattgtatctagtatggtatggttacacgtgtgtgactattttaagccttagactttggtatgtcacaatggtaggtgttacaaatagtatcagacccacgattataagtgcatataagttagtatgtcacagtttgtatcgcttatagcctgctgggatgtcacaatcatgggtaactttggttacccaaaaatacgtatgaaaggaaaatcctctggctgagctgttcgggagaggaaacaaaaacttttccagcactgtgcagaagtgaaagctttctttctcataaaaaagttagcatgaacactgaataatacatggaaatttcagatccaaatctcaatctgaagctacaaaactggataaaccaatagtcaattcagattcagacatcatttttcaaaacaaattagagcagaatatcgaataggaacaggaaaattcagattgaggagaagatttatgagaataatctatatggcacctacaaaaataggaacctgtagttgcattagaagaagatttgcacccaaaaaaatggaaccaagtgatggagacacaatgcaactgcaagaggatgctagcaactcagaaggagatcggagaagagagaagtgtctctgatgagctccaagacgatgcggttcctcatcactgacgggttataaacaaaggccgtcacaggtgacctcatctgtgctacttcaacccgtcataggtgagttatctgtgacgggcatcaaggtagatacgtcatagaatgggtacacgggatgtcacctttagacccgtcacaggcgtctcacctctaatgggttgtaaccacccctaggcttgcggagaccctcacctctgatggccggaaaatactggcccgtcagatgtgactatcacctctgataggctgtccccgtcaaagatgagtggaatcataaagatgagtggaatcatcagtgaccagaaatctctgactagggctaaactcatcaaaggtgagggtttggacccatcagaaataacctgatccgacgtagtaccacgggctgatgtctgcacatgtgattttgaggtcgattttctccgctacccgcaagattgagcataccatggtcagtttggaaacgacagtgggatcagtgtttgtatactagctaaacataaattagcttaaattagatgacactttacaacgagtggtagctatgaacctcagagacaaaccatatcatgtcaaagatataatttgtagttttcttttgtttatttctaacgatacaaagtagtataatctcttctctccaactagctagactgcagagttgattgatcatcttataattaattcttcggtaagctagcggcagattatgtacggccgacctgtcttccctttattcgttacttcctccgtttcacaatgtaagtcattctagtatttcccacattcatattgatattagatatatatggttagattcattaatattaatatgaatatgagaaatactagaatgacttacattatgaaacggagggagtaacacttaacactgagccactaccttagtatcactgctcgctcttctttttatcgatcgtcttcatcagctcccgcatctgttcctcatcaagaggtagcctcgtctctgtgcacaatgtgtgtgccatcatgaatccattcggaccattcatgaaagatggagcattagagagagggtgatgaatgctatggacatgcgaaggaggcggaggaggaggaggatgtttggggatgaagaacaagttgcccattaatagagatcgacaatagatattctctatgcacgacagttgtcttttctttctttctcagtgtttgtattttgtgtacctgtctgtctgtgggtgtagttgtggtgctagccctttaaatactagccaaaggatcttttttttcctcttcttccttttcaaggaaatagccaaaatattattcgctggtgcagaataaaaatgtttgcacggtttgcattgatgtatggatttcgactaggcagtcgaccttataaggtatttgctgacaagctttctcttgagacacgttgtctgtcggaaaaaaaaaaccctttaacgacatactataggataacactatagtgcttttgacggcagatgagctatcgcaacttttaggtcacggtgtagtgttattagcttctcgtaggtaccaaattaatttgtaatttcctgagggctgcaggaat

SEQ ID NO: 68543 - DNA, 5942 bp, Oryza sativa
gaaccatgaaatttgtcatgccaaataatagatttttagttggatggcaataatctgcttcttacagcaaatatcatatctttcttatagtatttagagctgattatcttttagaggcttcgatattattgccattaaaacaccaattagtttgctttgatattattgccattaaattccaaaagtaaaatttggacgataaaaatatcccctagaagtcaaacttacatttccacactccaccttacaaactgaacttcataaaaatcccctccaagttaaactttattgtctactccctctgtcccaaaaaaactcaacctaatatgggatgagacataatctagtataatgaatctagataaaagtctaaccagattcgttgtactagattatgtcccatcctatactgaattaagtttttttttgacggaggaagtaggcctctgctgcgctatgccttcctcgccaaggcagtgtttggttgcctccttggagccttccatagttgtagtgtaagggcacctttgaggcacagcaattttgtaggattttcacatgaacagttcaattttcgtgaaattcctgcaaaaatcctctgtttccatggaggaagtgtttgatctctgtttctaccatcgtttgagtagtgttccagttctcaattgaaccaagtgcacttctctctagtctccacttgtttggtccattttggggcaacattagaggttgcctgtgtggagatggcatcagtgtcacactagttagttttgttatagggaacatcctgtttagcttttggtgatcttccttaattttcttaatttgcttgtgttagaaaggctatatttgactgaaatatatattatacacacatatgcttgatgtatgggtgcatcagacatcactcagcaactaaccactaatcacaagtgagtatatatcactgaaacaaggatagtgaaagctcttgaagaaacaagagagaaatgggaaatttattcattattaaccctggtggcccttcttgatcatatcttgaattcaatgtccataatcctgggccttcttttgatctccattttggggcaataattaataatcctaggcagctttcttgcttcttcaccagctcttgacacccttcgttaggaaattgaatgctcggagaagcggcttcggctcattcataaaacttggaggatcatcaactggaggttgatgaatgctatggagatcggaaggatgacgaggaacagggatagtaggttttcctggcttgaaccacaggttgcccattaattactaatagatcaacgatactagtatacagatgatatatgcctatggctgtgtttagatggtggaaaagttaggaagttgggagaaagttgatagtttggagaaaaagttaatagtttatgtgtgtaggaaagttttcgatgtgatgtgatgtgatgaaaagttgggaatttgggtgactaaacacggcctacatatgaccggtatattagtgtttgtgttttgtgttcctgtctgtgggaggagtggttctaacccactttaaatactaatcaaaggatcaaaattattcggcgcagaataaatctgttcacattgacttgactagcgtactaagttaagttaaggtaattttaccatccttaaaaatatatcgaaagataccatattttataatacaagtatcttgaggtattaattttttatgtaaaatttagttacctcaaacttttttgtaatgccgtaatttctccaactaatatgaccggctggtcgatcactttcttgtaggtaggggtgaaaatggtatggaaactttctggattccggacctattttcgaaaaagaaatctatcagtcggaattttttggaacgggaaacgaattcagaaatattttctcggaaatggaatcgaaaatgataagggtattttctgtccggaactcggaatcggtcggaaacttttcgaaaattttctcggaatttccagaaattttgtgactgaaatagtttggattctttttttaatcactgaatagtgaataatatagtatttggctgttattttttaaaaaatatttgttatgcaaatctaaaattacataagaatatttttttttctgtattggaatttatcaacatcattactctcttaaatatagataatttatccatagattgtgttttgttatataatgttgatacttaacaattggacttatatgattgtattttatgattgattagtaaccattgagacttgagaattggatttatcagtttgaggggttttttattccgataaattttcgttaccgtattctcgccgattcgttttcgctccgttctcggtttcgataatattcaattctgttttcatatccggggtttccgattccgaaaaagatatgaaaacgaaaacgataaacatgttttccatccgtttccgtaccgttttcacccctacttgtaggtataattttaattctttcttgatgattatatatatgaggtgaacttttgactgcatgaccgttagttttaatgcaatcaattgcatctccttcgtctaatttgatgtttaggtttgctcgctgtaatttttttttaataacacgcaataagtattttttcttctaatagataagtccatttgatgtatatgagcaataagtatttgatgtatttgccccctccgatctcaagctgcataggcctcggccagcatacatgtatacgatcatggataagtccatttgatccctaaactctttgctttgtcgaaaacacatgaagacacatctcgactctaaaattgggtatttgacaccatctaactttcaatactggtaacacccaaacttatgggctttcctcgaagagggaaatgctacagtttctgtcttttatctctcgagttctaactactctatgattgagaacttcctcttctgcttccgtttctgccatagtagtgtcggtggcgactgatactgagtaagagaaagtaggaatagaaagaagaggtggatgccggagatacgggcccgggggtatgtgaggtaaagaggagtcaccttcctgtccagccacgtggcactgcaagctggccccactcacgcacctcgtgggtcgcgaaagcggcgggggaggggggggcgtcggggggccgcatccccccctcgggctgtcccgctgcttcgccccgaggccctcgcgcagctgccgcgtgggggggggagagagcgagagggggacccaggctggacaaccataaatgcgcggcgcgccaactgtccctcagtatgtgtagcgcggggagggcagacgtgcgggacgcctaactgacccctatgaatcggatgtgaccagtctgtgactggcctgttgccggtcacgtccgattgaacgggcggccgtgctcccacgtcacctttgtatccggcggagtgggggtaagtgtgacccgtcacatcggagcatcactcgaagaaaggctgccacaagtcttcacttatttatgagcgaatgacagggctgtcccccgtgtcaggcgggggacgacgccgggtcccactcaaggaccggttgctgcatagctttcgggagaaggcatggatcgagactcggtcaaagtggagtggggtccccctcccattggggggagtaggtagaggcggcgcatgtggtatccccttgagctataaaaggaggaccttgcccaccgagataaggggacgactcttagaaaacctgaactctaggagaaggaaggcgatagcgctctccggagtagaggaacccttgtaaaactcatacataatcccaaacgcaggagtagggtgttacgctccatagcagcccgaacctgtataatccgattgtgcgcaagctagccggcagtttcagggcgaacgcgtgattcccaagaggcgagcttctgcccccggccgaactcacgaaaggggggtctcacgactccccgctatcgagggtcttccctcgacagctggcgcgccaggtagggggcagttgcgcgtttcgagaagaagtcgttttcttccgccccaagtttctctgggccctagacgatcatggtcgaggtcctggaggtggaggaggcggtggcgtttacccccaccccgtccgggagtggggattccggcgaaagccgtggccctcgtcaccaccgccgtgattctccaactcctccgcgccgcgaaccctcgcggagggaggatcccacccgttcgggtggttcggccctttccccgccccctagcggagggaggccacgacgcgtcggggcacggcgccgtctcgtttacagcgacggcagttcgccccaaggcgcgcttcaggcggcgggcgcccttctgcggcatccccccgtaaacccggagccagagactcccgtttagcgctggttggatgacgtggccaacttggtcaccgctgcccagcggcatttggccacgggtggccgatccgccgccactggtacgtcgcgtaccccggttaccctctcctcgtcagcaaggaggagggctcgtcggtcggccacgacctcaaggcggtccacagctccaacatcgttgggggcctcgggaagccggaggcgtcatgacgatctctacgaggagcaggacgctcggatcaacattgagcgatgccgggatgagcgccgagctgcccgcatgggggaaggcgcctcctcatctggagtgccacgctcctcctcacgaggcggccctccccccacgctcacccctggggggacaggttgtagggccttcgtggcgagtcttcggaatgtccggtggcccccgaagtttcgccccaacctcatggagaagtatgatggtagcatcaatccctcggagttcctccagatctacaccacgattatcgtggcggcagggggagacgaccgggttatggtgaattactttcccatggctctcaagggtcaggcgcgtggctggttgatgacccagccccccgactccattcactcctaggaggatctgtgccagcagttcgttacgaacttccagggcacatatccccgcctgggagaagaggtagacctacacgctgtacggcggaaggacgacgagtccctccgctcgtacatgcaacgcttctgtcaagtgcgcaatactatttcgtgcattccggcccacgcggttgtgtatgcatttcggaacggcgtgtggcacaatcacatgctggagaagatcgcctccaaggagcccaagaccaccgctgagctctttgagctggcggacaaggtggcccggaaggaggaggcgtgggcctagaactctcccgacaccggtgcagcggccgcggctacccccgagtctgccccccgctctaagcggtgagataggagaggcaaaagtaaaccggcccgctccaatgacgagggccatgtccttgcggcagatgggcccgcactggccccgcgcaaaggaaaggccaccggcgataagccgagctccaccgctccctccggcgagggccggtcggcagacaagtggtgctcggtgcacaatagttaccgccacagtctcgccgactgccgctcagtcaaaaatttggccgagcggttccgaaaggccgatgagaataagcggcagggtcgacgggagagcaaagctcccgcgacctcaaccggtgaccggcgagaggaggccaagaacaaggcccccgccgatgatggcggtgacagtgaggatctggatttccagatacctcaggggaccgtcgccacgctcgatggggggggggggggggcttgcgctcacacctctcgtcggggcttcaaggtcatgaggcgagagcttctggccgctgttcccacgcacgaggcggcccggaaggcgcgctggttagaggtgagggctgcaggaat

SEQ ID NO: 68544 - DNA, 3347 bp, Oryza sativa
cgtcggacatgcccggggtccccagggaggtgatcgagcaccgtcttgccgtacgaccagatgcgtgacccgtccggcaaaaagtgtggcgtcaagccccggagcgacatgccttcatcagggaggaagtggcacggctcctggaggctgatttcatccgcaaggtgatccatccggagtggctggcgaacccggtggtcgtcctgaaggccaacggcaagctgcggatgtgcatcgactacacagacctcaacaaggcatgccctaaagatcccttccctctaccacacatagatcagatagtcgactccactgcggggtgcgaccttttgtgttttctagatgcatactctgggtaccaccagattcgcatggctagggaagatgaggaaaaaactgccttcattactcctgtgggcaccttttgttatacaactatgccttttgggttgaaaaatgcatgccctacttttcagcgcatgactcgtattactttgagtaatcagatagggcgcaatgtagaggcgtatgttgatgacctggtggtaaagatgcgccaccaggacacgttgctgcaggacctggccgaaactttcaatagtctcaggtccacacgcgtaaggctgaaccccgataagtgtgtgttcggtgtgccggcgggcaaacttctcggttttctagtctcttcccgaggcgtagaagcaaatcccgagaaaatgcgcgcgatagagaggatgcgccccccagcaagcttagtgatgtgtagtgcgtcactggatgcatggccgccctgagtcgattcatatcaaggctgggtgagtgggcgctgcacctattcaagctcctcaagcgctctgggccgtttgtatggacggaggaagctgagcaagctctcaatgagctgaaagcttacctcacttccccctatcttggtggccccggggccagaggaaccattactactctacttggccgcgaccccctatgtggtgagtgccgccctagtagttgagcgcgaggaaagcgaacgagaggcccctttggctcgcgatggcccctcgtcccccgaaggcctagtgcccaaagcacccagcccccgggaggaccccgaggcccccgagggaagaggggaggctttggtaagtggccctgaggcctacgatcccgaagtgacccgggatccccccggggctcccgagcaggggcgccccgggtcatctgcccctgacaacacgaaccggccctgccgaaaggtgcagcggcccgtccacttcgagatgcgaaaacccggtacccataggcccagaaaatgctttatgctgttttaatggcctcaaggaagttgcgccactatttccaggcgcatcgggtttccgtagtgatatcgtatcctctcggccaaattttgcacaaccgagagggcactggacgggttgtaaaatgggccatcgagctagctgagttcgatctgtacttcgaaccacggcacgcgatcaaaagtcaagtcctggctgacttcatcgtggagtggacccagtggatgaacctgtttcgtccaatgtccctctcccccgggagaggaagaggacccaaacgctgacattcgtggcgggcactggattatgcattttgacggctccctcaaccttcaaggtgcaggtgccggactcacgctgacgtcgccaagcggagacgtcctcaaatacgtcgtctgattcaatttccgagccacgaacaatatggcagaatatgaaggactcctcgcgggattgagggcggcagccggaatgggcatccaccgtctcctggtcctaggtgactcccagctggtcgtaaatcaagtatccaaagagtaccagtgcaccgacccacaaatggatgcatatgtccgcgaagtgcggcgcatggaacgccacttcgacggactcaagctccggcacgtgccccaacgcgacaacacagtcgctgacgagttgtcgcgtgttgcgtcggcacgagccccactccccctggggactttcgaggaaagactcgcgcaaccatcggcgcgaccgaaccccttgagggaccccaacgacacgccttccgtcccgacccccggcgacccgcacccctcagggcccgagggggtcgaccccgacccccctcgttaggtcgtgtggatgaccgacatccgggcatatctcgacggcaatactctccctgagcatcgcgcagaagttgagaagttcgcgcgcatctctaagtggtacgtcctcgtagaagggaccctctaccggcgtgccgccaacgggatactcttgaagtgtatttctcgggagcaggcatcgagctcatagccgacacccattagggtgagtgcggggcccattcggcctcacgatctttggtcggaaaagccttccagcaaggcttttattggccaactgcattacaagatgcccaggaatgggtccggcggtgcaagacatgccagttccatgccaaacagacccaccagccgacccaagccttgcaggtcatcccactctcttggccttttgcggtctgggggctagacatccttggatcattcaaggcggctcgaggcgggtatcagcacttgtacgtcgccatcgacaagttcaccaagtggcccgaagcttacccggtcgtcaaaatcgacaagcattctgccctcaagttcatcaggggcatcacgtctcgattcggagtgcccaaccgcatcattacagacaacggcacctagttcaccagtgagctgtttgccgattactgcgacgacatgggcatcaaattgtgctttgcctcgcccgcccaccctaagagtaacggccaagtcgagcgagccaacgccaaaatcctcaaaggcctcaagaccaagacgtacaacgtcctaaagaagcacggggattcatggctcgaggagttgcccgccgtgttgtgggcaaatcagactactccaagccacgccacaggggaaacgtgtcgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttagaaaggttttataaaaagaaaaaaaaaccctaaaaagtcctttttcccccttcccctcttgggccggctcggcccacctccctccctctctctcctctcccccgtggcccaatcggcctcctccccgcgcgcgtgccgctgac

SEQ ID NO: 68545 - DNA, 12350 bp, Oryza sativa
gaatgtgatccttgggaatgaaattggttggctcaattccaaggagtagtggattgtgcgagacgcactgtcactctgtaccgagggccggaacaaccagttgttttctttgcacccccaacctctgtcagtagttccgaacttcatcagataggactgtcagaaatccccatcgtcagagagttcggagacgtgtttccggaagaactacccggtatgccgcccaaacgagagattgagttccggatagatcttgctccaggaaccactcctctgtacaagcgaccctaccgtatggcagcaaatgaactggccgaagtcaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatatggactgtatgaattcacagtgatgtcgttcggtttaaccaatgcacctgcctttttcatgaacttaatgaacaaagtgttcatggaatacttggataagtttgttgtggttttcattgatgacattctgatatactcacaatccgaggaagaccatcagcaccatctccgtctggtattgggaaagttgcgggaacatcaattgtatgccaaacttagcaagtgtgagttctggttgtccgaagtcaaattcttagggcatgtgatatctgctaaaggagttgctgtggaccccgaaaacagtgaccgccgtcactgattggaagcaacccaagacagtcactcaagtccgcagtttcttaggtttggcaggatactaccggaggttcatcgaggacttctccaaaatcgctcgacccatgacacagttgttgaagaaagaagagaaatttgtgtggagcccgcaatgcgagaaggtgttcaaaactctcaaagaaaagctggttgcctcgccagtgttaatcttgccggatactcgcaaggatttcatggtgtattgtgacgcttcgcgccaaggattggggtgcgtgctcaagcaggatggtcatgtggtggcctatgcctcacgccagctacggcctcatgaaggcaactaccctacccatgatttggagttagctgcggtggttcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctggtaaggccaacatggtcgccgacgctctaagtcgaaaaagccattgcaacactcttaacgtccgtggcattccacccgaacttagtcaacagatggaagccctgaacctaagcatagttggtcgcggattcttggctgcgttggaagccaagcctaccttgctcgatcaaatctgcgaggctcagaagaacgatccggacatgcatggactcctcaagaatatgaaacagggtaaagccgctggtttcacagaggatgaacacggaaccctatggaacggaaatcgagtatgcgttccagataacagagaacttaaacagctgatacttcaggaagcccacgaaagtccttattccatccaccctggcagtacgaagatgtacttagacttgatggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaagactcaaggtggatatgattctatatgggtagtggtggatcgattaaccaaggtagctcgattcattcctgtgaagaccagctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagactgatgggcagaccgagcgtctaaatcagatcctagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccgtaacctggaattcgcagtggacgattttgtgtatcttcgggtcacgccattgcggggtgtacacaggtttcagacaaaagggaagctcgcacctcggtatgtgggtcctttccgtatcgttgcccgacacggagaagtcgcttaccaattggagctgcccgcctccttgggcaacgtgcatgatgtgttccatgtgtcgcaactcaagaaatgctttcgagtgccatccgagcaggccgactcagagcaaattgaagttcgcgaagacttgacctacgtggagaggccagtgaaaatcctggacaccatggagcgcaggaccaggaaccggataatccgtttttgcaaggtccagtggagcaaccacgccgaagaagaagctacctgggagcgtgaagacgagctgaaggcagcccatcctgatctcttcgccagttcttccgaatctcggggttgagattccgtttaagggggggtaggtttgtcgcgtcccaaaacgactctaaaatacatcatcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttagaaaggttttataaaaagaaaaaaaaaccctaaaaagtcctttttcccccttcccctcttgggccggctcggcccacctccctccctctctctcctctcccccgtggcccaatcggcctcctccccgcgcgcgtgccgctgacggacgggcccgcccgccaccctcgctgacgggtggggcccacccgtcatcccctacctcccgccgctcccgccgcctcgcccgtgccctagcgccgccgccgccgcgaatcccgccgcctcccgccgtccccgcgcgcaataaagagggggaaatcattccccgtgattccctctccctttccccccatttttccctctctctctctcgcgttcaaacgggcggatttgcccccgcaaatctcgccggcgccattgatggagcccgagagcgccgcgccggtttccttctcccccggccgccctctctcactcccaacactatataaacgctccccgtgcctccctccaccgtttccgccactcgccgctctctctctccgccggaatcgagctcgcgccatcgctctctctctccgccgtcaccgccgagctccggtccgccgccgtcgtcgcctcggaccttctcccgcctcggcgtcgcctccttcggctccgccgcgtcctcgccgacctcgtccacccctccgtttcgcccgccgaccgccggaacgccgccgtccccgtcgacccgtgccgcgccgccgccttcttctgctccggtcgccgttcccgtcgtcgtcgtcgacccggggtgagccgtggaccgcccatttcgtttcccccttccctcccctctctcggccgccgctccgccgtgcctatggccgccgccggcgaccataggggcgcgggcgcgtcgcctcccgtcggctgtgccggcgaggccgccttcgggcgcgccccgcggctgccatgtggggcccggccgtcagccgcctgcgccctcgggtgcggctgacgcgtgggacccacggcgccggccggcgtaagccgcgtgctcccggtccaccgtggaccgagaggctgccgcgtgggccccactcccatggacccggtccgtgcgctcctctctcccggctgacgcaataaatatgtttttaaattaaaatttaaatgaagaaattcgtaaatatccatttaaagagcatataaacttcaaatggccataacttggccatttaaactcggaattggaccgttaaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaacttattgcattatcgctttatttaaattcccgcgttatcaccgttttatttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggtgggtttttttcaactctagactttgggaatattcatatcacctggacaccatggaatggtttggttattgtggaattggcttcacaccgctccttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagttcacggatggagatggaagaagtcgggggtcgatggacatctctaggacaaatgaaggctacatgagctgctgcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtaggttcacggccttgataaataatattgtatagtactagaatcgtgtttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgttgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaaaacgccatttttcctgttgtacggcgccgaagcggtcctaccctccgagctttccctagggtcgcctcgcgtcgcgctgtacaatgaggccaaccaggatgaccttcaccgcgacgatctcgattatctcaaagaacggagtaggcgtgcggccctgcgtgccgcgcgttaccagcaaagcctacgacgctaccatcagcgccacgtccgggcccgatcactacaagttggcgaccttgtcctacgccgcgtccaatcgcgcctggggctgagcaagctctcgccaatgtgggaatggccatacaaagtgatcggcgtgccccggccaggctccgttcggttaaccacggaggacggcacagagttgcctaacccttggaatatcgaacacctccgtcgtttctatccatagcatcgagattttttgctttccaggagctcgggccaacccccgcacaaccccttggtttgtgcgggcttggccgggggctaccactgtgtatccttttttccttttgcaagaagtgaatttttctactttttgtgaagaccgtctattctcttcctctggcttgacctggtttaagggataatccgcgtttactctgaaccctaagtgccgtagggcggcctgaaaacctccgaaagggagcacgaacgcgggccgcgccccgggttgcgccgaacctcgggggatcggaagggcctacacacggccgtccctgacccccggtcgtcgcagcctcggtctggctagtcccaatgggcggctccctcggggcgacggtcttgcctatcaccacttaggtaccatggaccgagcgcggatttaccttctcgctagaacaagcccgagggggggaggatggggtcaaaacggcattttgatcacaggcagattaattatacccgttttgctctggttctttcttctctctatgtcacagacatccaatggaaaaagcaaatgagtaaaaggggctaaggaagtttcagttgcagaacaagataggacggcacgatggcctaaatacaagaagtgcccgccacgggcacacaacaaaagggaattgaaagcgcgaatggtcacggggtgcccaggcccccgaggccggcgccgctgacgacgtcgtcccagtcttcgtcgcccacgttgtcgtcgtcacccccacttccgctctcctcatccgaggcgagcccaaaggtgaactggggggccaaccgggcagcctcgacttcgacctcgggctcaggaccgcccccaacctcgaccttgacctcggactcgggaccgcccccagccttgacttcgacctcgggctcaggatcacctccggcctcggctcccgagctgcgacctccctcaccccccgatcctgggtggcgttccgcatggaccctagtctcacagccgcccccgggaggaacgtcgccgctaccgttgcccgcagcaagtcgagtcccggctgagggtcgctcgggaccaggcccggtatgtggcctgtgggtcccactgcgaggctgcgaagaccccgcggccttggattggccgggcccggaccgttccgatcgttcggatttcgtcccccacgaaggctccgaccctgagaccccctgagaaggaatctcgctacaagagaacccagatcgcgttaacaatgaaaaagaaaaggagggaacaagaggccgagctgggtaagagcaccgaagtaggtgccagcaatcgtacctacggggagggcggttgaaagtccacttcggggtctcgatgaagctccctcggctcggctccgtttgccctatctttcggacccgtttcttcttccgtccgacctcgggcccggcagggcgcttgtggcccgctggcggatgatctgccgcgtgctcggtgccccctccacgcgggggagagggcggccgggattcgggcaccttccgcttcccctttgggtcgccgaccaagtcgtctccaggtccgcggctcgagtcgggcgcccttgagccaccaccgcctggaccgcttgtccggctcccacccgcagtcgcgccgccgccacccgcgccaacggcgctaccgctggcgccgcctcggctggaccggctcctaccggcgccaacaactgacatcacggccaggatgctctcccggtcgcggtcgcagtagagggggaggatcccatctgggattagcgtttgcttggcggagtccaggcccagcaccagcaccatctttgcgtcctcctccccccagtcccagcgctcgcccacatgcgtgcgcatggggtcgttgggaccagtgtattcccacgcgccacgggatcgttcctggagaggtgcgatgcggcggcggatgtaatcgccaaagaccattgcccccgtgaggcccaggcttcgcagacccctgaggcgatcccacaccgcgtcgtattcctcgcccagctccgaaaccgctagccatgcggcggatctttcaggaggaccagcgggaacccgaagtcacggatggtccggcaacgcggtgtagaaccagtccttcttccagtcctcccatttcttgcggagatgactctcgatgtactgccccgccgtgcctggccggggctggaagtagcatccccccaccaccgcaccttgcagcagctgcgggatgaagaaggcttggaacagccgcatcgtcggccgcaccccgatgaacatctcgcacagatgcacaaagatggccagcgtcatcacggcattgggtgcgagatgcaaggcatggatttcgtagaaatccagaacctcatggaaaaatctggagaacgacggaattaagcccgccatggcgaaggacaagaggtgcacggaccgctccggatatcgcggccgcggccgcgactccaccgccctcacgacggcgccatccggcatgatcttgcgggggaggctaaggtgcctgtctgccgtaatgcgggaaaaagggagcactgtgtcgccagcgtcttgagccatggtggccggcggagcagtggcgaagagcgtggcgcgcggaacagtgtgaagtggcgagaatgttagggttcgaggagcgaaaggacgagcgggcggttggcgaaaggaaggaggcaaagtccctgcctccgtcccccttttatccttgcctcatccgcgctcacctcctcgtttcacgccctcataattgcccccacgatcctcgcgcccgcagttgtctcttcgtttcccacgcccactcatcacgtgacccgttgtatccgcgtcccgcctttagtgcgcctgtcagtggcacactcgaggtggagtgcgcaacggctatgagcgcaagctgagcgaacagtcaccacaaccgccgcaggagtagcgggcgagggaatcgaggcgtggtctgaccgaccccccggttatcgcgcctcaagcatcctcatcattagcgtggtcggtggcggtcaaaccgctgctatggttggcacgccaacctggccgctcggcaatattcctttcgattccccgccgggcccacaaccccagcttgagaagtcgtgaggcaccatgtcagactgatctcaggaagccaatgtctgatatggtgccgggggcttctgtcagagatatgggcccgggggtatgtgaagtaaaggggagtcaccttcccgtccagccacgtggcactgcaagctggccccactcacgcacctcgcgggtcgcgaaagcgccaggggggggcctcggggtgcggcatccccccctcgggctctcccactgcttcgccccgaggccctcgcccagctgccgcgtggtggggggagagagcgagagggggacccaggctggacaaccataaatacgcggcgtcccaactgtccctcactgcgtgtaatgcggtgagggcagatgtgcaacgcgcctaactgacccctatcaatcggatgtgaccagtctgtgaccggcctgttgccggtcacgtccgattgaacgggcggccgtgctcccacgtcgcctctgtatccggcggagtgggggtaggtgtgacctgtcacatcggagcatcactcgaagaagggttgccacaagtgttcactcatttatgagcaaatgacagggatgtctcccgtgtcaggcggggaacgacgccaggtcccactcaaggaccgattgctgcttagcttctgggagaaggcatggatcgagacccagtcaaagtggagtggggtccccctcccatggggggggagtaggtagaggcggcgcatgtggtatccccttgagctataaaaggaggaccttgcccaccgagacaaggggacgactcttagaaaacctgaactctaggagaaggaaggcgatagcactctccggagtagaggaacccttgtaaaactcatacataatcccaaacacaggagtagggtgttacgctccatagcggtccgaacctgtataatccgattgtgcgcaagctagccggcagtttcaggggcgaacgcgtgattcccaagaggcgagcttctgcccccggccgaactcacgaaaggggggtctcacgactccccgctatcgagggtcttccctcaaaagtggcggtgatgggaggttttactgaatccaagggtcgtcagaagcacacgtcctccaggccttgaccttggagaggcctaatttggcaccctctacttgctagcgagccacagaggttactgggataagaaaggctaaggagcgcggggaggagagggccgtggacagtgctagggagaaggtgcagtggtggcaattgggaggaagaggcagcggtgatggtggtagtgggggaggaggtggtcatgggcgaaggcaggggggcgacatgtgggaagaggtgacgagaagcataggaggtcgcagtatagtgcatgagagaaatggtggagtcaaaatgaaagggagcttttcatggaaatggaaagttttcacggcttgtgtggatcggacgattgttgattttttttactttcattattgtaacttgaattttttactgtttacatctttatgtctcattatatgcaatttctaaaccaacatgtaatagatgcatccccgcaaaaaaaaaacatgtaatagatgcaaggtgaaaaaaaatcaccaactgcaaccatgaatgagagcttatattacacaacgtgtagtttgaactggcccaggaggaaagacagggagcaaagagatggtattagccttaaacactgcaaggaaactctgttcgttcctaatgaagctatttctaccactctagtctctagcctatttcttcaccaaccccattatctcaatcaatcaaaaccattctccatttaaattatttacctactttctcttctcaaccaatcacaacttcactctaatcttttttacccactttttaatacccatacccagtttcaaaagtacttatattatattatattatattttagatctagtatgaagagaataactagtcttagcccaagcatccaatgatatctaataaaatattcaccttggtgatccaactgttgaaagcatgaaagaaacaaagtgggaaaccgagaaaaagaaaagagaaaggaggacggcataaatagcattttatcactactacaaaatcgatttgcgcaggcggttgagctgcttgcacgcattcaggtgtctgcgaaaatcacatttttctatgcggccaacgcaaccacatgtgaaaatctcatttttcgcatgtggtcacctataccgaccacatggaaaaataatttcggcaaaacaaaaattccaaaacgaaaaattggtcgaaaccttaactccccaaggcgtcgtcgtcgttgttgacggttgttttagaccgatttcgaccgtcaatataactggaataaaggagaactagctatacttgcaatgcatatttgttttagaataatctatctctacttgtacttggattttatttgtttgcagggattgccaacataaatgaaggagaatcgacagaaaacaaccgaacgatcactcaaaatccgtcgagaggaaaacttatggttggaagggctcacaaatccaatgaaataacatcaattgggccca

SEQ ID NO: 68546 - DNA, 2012 bp, Oryza sativa
acgtagttaagaaatatcaccagtcgtcctcctcctcaccgtagcccactgccatcgtcgtcactgtagcagccgtcaataagggccaggggctagcggatccaccccttctgatggtggcgcctccggatctaccaccctcaagctccaccatcatcgcccgctatcgtcattacccctcccggggctgagagtggcagatccacccctcccgagggctgcgccaccggattcgctgccctcgagctcatcgctctggttggatctcgcattcaccacaccaagccccacaaggtgtccgaggacaccaccaccgccactcccgccgtccttcgtgatggatcctcagtcactgagcttctcgccgctcaagcctgacatcagccgctcctgcccaacgctccagccgtgcgcacgagatggagagggagagtgagagagagaaagaggaaggatagcataagagaggagagctgaaggagcggagatgatttagtttttatatttagtttgcagtgattttcgcaagcgggcctggagaagtctgcggaaatctaatttttgcatgcgaccgcttaagaggctcacctgaaaaaataagtctattttcgcaggcctcttaagaggctgtatgctaaaatgcattttctcatggaaccctttgaaccgatcctgggggagtgatttttgtaggtgggagcagttatggtctgcctgtagtatagaaaaatcaattgtatagtaacgtacgtctatgagtgtccaacattgggtgctactgctcataactctacaaaaattctagctcaccctgtattgcccatgcaagtccttaagtgtgtatctggttatgggatgaggtgacaggatgggacgagattcagggataggtggtggaacatgatcatttttaaggagaatattcccctagttaaaatctagcataagtttatatttaaaaaactggtgaaccaattcaacccattttttctctcgctggcaacatacgggtcacctactttcgatcatcccttaaaaacagaatcttcgaatccctcatgccaaacatatagctgtgagcctgtgactatctaaaaaaggatgggcctcacccattccacctgaccacctctccaaagtaaaaacacactaagatatttccaatggccagttggccaccactgggatatatcacatccatagacccgtatattctattagccaccaccgtgatcacatcttgagaatcttctctctctcacacacacacagttatttatctctagatcagggcacacatatatttgttaataaatatgtttgagctattcccattaaattccaacagaaaattttggaggagaaagtcttttcaatacccctaaaaagtcacttacattgccacagcaatagaccaaagaatggcagatatgaaataacgcgactaccttgttgatgatatcttctactgtagtcctgacatttgatatgtcttctcttatctacggcatgcgattgccattggacctcacgctcgtctcatcgcatcaaactttctgtcgtggcctaatgggccggcagatgtatgtatgaacctgggtctcggttagttccaccacaagaatctaacgagagtcattttattttcgttttcaataataatgtaagaaaattggatctgctaagctaagtgtgaaaaagcaccaatttgtaacggagggagtaccaagttgcagttagatgccccaatattataaccatcaattgcactgtatctggacaattattctgtacattcccagtggatggctttctccttttaattgagatctttggtattactatctggtgatgtcctccgtagatcgatatgcaatggtggattggcggggtgatatgagagctaccatggccatatatatatagcgaagtgtgcaagctgctggcctagctatcaagggaaaaatatgcggtggaaaccacatatgtgatggaaacttgaaaactaatgt

SEQ ID NO: 68547 - DNA, 1558 bp, Oryza sativa
ttatgttaacttcgccacactcgtttacaaaactagctagctaggtagactatatgtgtgacaattttagtaccagtcatgatgtattctggtgcggcatagccctgtgtgcccatcactctagtggagacatgtgtctcgtcttcttgaggcccatctttggccagtccgaaatccgaaagttttgcttcgtagtcctaccaataattaaacaatgtcagtcacaaaatgtcatatgacaacagctaccaggatgggagaagctctccaatatttcctttccatttgataaattgcagcgttttaatgtgtgctccactcatttataattcatatatacagataaagacaatttgttactagcttaatacacatcctctgctacggatatatattgcttagaacaaattagttataaggttttctttagaacaatgcatccttattggtatttttgcatgataaacttgtttttatggatgaaataagatagataaaaacaatatatataagtactattttgaaatattaaaaggatgttggataaaaaccaatgtataaataagctcatatagatagatatgtataccgagttgagtaggatgttggaggtcttgaagtcgcgatagatgacgggcttggcagcttcatggaggaaggccaaacctctggccgctccaatggcgatcttcaagcgtgttgaccacggcagcgacgcagagtactctgcagtttcaatttgcacaatcgatcagttcatgcattatttcatctacaactaattatgacccatcgacaaatcagatgatgaaagcaaaaggcggcaatgcaaattgttaggagcagccaattaagtagtaagtatgtgcatctccactgaaattaattcaatgcaagctttgaatattttttgttgtcttgataccaacattaaagaagattaattgctagctaccagaaataactgagagcatgaattgtcttccattctatcttgtgaagttgacaacattgattaccacattagaatgatatatataggcttccatggtaatgcagatgatgcactatttcttttattatgtagaaaatacacaagcacacaaaagcccctatatgaatgcagctcttaacacatggtcaagagataaagaccaagagtaaattcgtttatactattattgttatcgaaatttaaactctggtagatggagttatacacccataaagccatcactccacaccagcattttgctttccctatctgcactttttttatcttttatgatgagattaacattttgtttgttgtcacatgcatgattggctacttttgacttgtgtggcctatataagtgccttatccaaattacatgacttgtaatcattgtggcctacttggattctccaatttgataaactatcaaagcaattagaaatttatgcttatttttccacgcttcaattcgatccctttatcaactaacaatgggaatgtgtgttgtcactttaatttgagctgatgaccaaaacgaattttaggccacacaccaaatta

SEQ ID NO: 68548 - DNA, 6238 bp, Oryza sativa
ggaatacttctaagcacaatgtaaacgggaatggtcaaattaacaatacttcaaacagaaatgattacttcaacagaaattcgccagtacatataaatttctaattggaaatggaaatggccaaattaacacaatctaaaacttggatgacttgtaatcatttgcttacttcaactatatgtactggcaaatgaagagctaattacctacggtttgattatgatctggtataccttgggagttcatccaatatgtatatacacaaatatttttatgctaaagtagaaaaagtttgattcatcattcctgtaaaacaaatctacaatttcttttgtactgtgttgtatgctctctcatactaatttttcgtagttccattaaccagttcatatttatcagaacaataaaaaatatttaaaagaataatatcatgccctctcattagagatgtggttgggtagttaatagagagggatgttgaatgtggctatttataagtgtgccatcattttgttataagtcgtaacgtttattagtgataacaaatgatttggagggataacttttatatatgttcttagcgacttaaaatcaatactgaaaaataaaataggataaaaaatagtaaatcaattctaaaattaagttttaaaatttaaacttgtgacgtggttgataataagctgaagatgaaataatagaatgcttaattttggtttaaacaattaaatgcctaaaagatgtcttgaattaaaatttctttgtttatttctgggattttggttgaaagaaaaaaaggaagcataagatggaatttgccgtacttttgaagaggtgcttctccaagctgcccctagccatgaactcgtagacgagaagtctgtgctcatcctcgtagcagtatccgatcagcttgacgaggtgatgatgtctcaattgcccaagaaatatgacttcagcctgcccaaattttacataatataatccattaattagttcaacacatgcccatattccatcagtataattaagttatgtcagaatttgaccaaaacctgtaaccactcttaaaaatactaattgtttgaccaaacaaatagcatattgcagtatatatagttagttaggtggctgatcgacattatccttgcctccgggtactaaaggattttaataggagattaagtatgaactaatgatcatgagaggaagacgtggcgactttctgaagggatcacagctaactaagtagctggcatgcactaataattattcaatttgctttggagtaggatttaccacagcattgacaggattcttatgtgtgatccgatcttgtttgttgtcaaatgaagtactaaaatggacgttgcaactgtttgtgtgtgtgctcaatttgtactgaactgatcgaaatcatcgtctataaaagttcaagacgaattaattctattatgtgttttcttaaaagggaaccttgttaaaaatatacaaacgacttctttaaagacaaaataaaatcattgcactaaatcatatatattccctcccatgagtgtgaagtttcataacgtacgtacgtacgtagttaacacatttaaactttcgaccaacaacttatatttgaatattttggttcaacttaattttaagaaatggtatatagctagatttatcttcaaattaaattagtttcatgatattataactttgctaaacaaatttactagttatcaataatcaaactagtgtattcgacagtgtcgctatccaaaatatcattattttctcgtatttcttttttctgttttgactggagccagtaaatgcatgctagataaactggccttcaataatatgaaaagagattgactactgcttaatttggacttttgcagtttggccttttcttttcaattaatgcagtttcccgaagttaaattaaaatatgcttaaatatgaagtcagggttaatagcacagtcaacatcatggcccttgaaatccggtttacgaaagaaacggaagtgtcatactgtacggtatgcacgggcttaacacagcttgataattagtcccaactaattatcacaaacgttacccctattaatttcggtgaaacattaacgactaactatagtaatggggctatatatgctaactcaaatactgcgtgttgattagtaaactatcgttaccaagtcatgcgttcaaaggcaaattaaacgacatgtgtagagtggacaatttccaaattaagaaattttgtagaaaaaggtgcaattcccacaaaattgtccttccaaccatagaattccgtattgactttgcacacaatatggaaatgatatgaaaatatttacctaacaatcagtcacagataaaatatacatactaatcgattgaatttcattttgttgtgcgtcagccattatctcactctttagtcattctttgctctcaccgtcaactaaaatttgctttaaaattagtgcaaatagaagcacgtcctcaagaacaacacccactgatcagtaattagggagttctaatcttagttctagggacaattaactacaatactatgactactaattaattaattacttgacttgaaatcgtactgataatctcagtgatcttaattagtactatacatatgatgagatagtctcagtgagacttgcttaatttacttcatttatagtaacaaaagacttgatcattactttgatgagataatctctctcagtgaaactttatacttcatttctcacaagaagacttaattaattgcattgataagataatctcagtgaggctttgattagtaggtcagtccccacctaagacagtagatatagttttcataagctccacatcattaagaaactagtactagacactactcttttaatgtaaacatcacttttccatacttaaatttaatgctacttatctcacatgatgtcttggtttttttctcttttctcatttattcacttgttacattattttttattttaggtggcagcttatttaatattatggataccatccatcattggattgagaatggccgtatagtaatcaatcaatctaactaattcgccgttaattaatcaattaatcaccgggtaattaataactggatgagaaatgagattaattagtgagagaggaggagttaaactaattaccagccattccttgtggccctgggagccctcgaggtcgagcagcttgacggcgacggcctgcgcgcgcacgccgggcttgagccgctcgtcgacgtaccccttgtacaccggcccgaaccccccctcgcccacgaagttgctcaccgagaagtcccgcgtcgccctcctcagctcctccaccgtgaacgcctccaccccgctccccgccagcgactgcgacaggtcctccggcgacggcatcaccgccgccgccaccccgtcgttgctgttgcacgacgacggccgcgccggcagcggcgtccccgggttcttggccgccgccgagccgccgtcgctgtgggaggaggtgaagcagccgagcccgaacagcgagctccacgacggcgacgacgacgtcgtcgtcttcttccccatgattgccaaggtgtggaatggttgggaggaggatcggggggagttaatttataggaagcacgtcgcggtgttgggaattgggggatgatgatgatgatatatattgagggtggtgtgtttaatttgtgggtggggtgggttttgtttgtaggagtggttgttgtcatggtctatcgagggaggtttggttaagtttggtttggttgagaagggtagactagtatagtacctagctagggaggtaaggtggccttttgactcatggaagatcgatacctgggcttagttttccgatgccgagatagtgttttatttattttattagatacttaaaaaaaatacccgtgcgttgcaacaggtaaaaatatttttggatcgtatacattatactatttgctttagaccaaaagctcatttattcgttccatttcagtcctaacccagcccgctacctctctttgatctagcccacaggtgaagctgtagacccagctagcatagcccacaactgtcttcaacaatggataaaaatatttttggataactatacattatactccttggtttttggtcaaaacctcatttattccttccttttctaacccagcccagtgccttatctctttgcttggcctacctttctttgacatagcccacaatgagagctataggctcaactcgcatagctagctgactgccgtcttcaatcttcaatccccgtaagagtgtcttttctattttttttgtcgttcttccttttttttctcgtcggtcttttcactctctctttttttttcgccgtcacgttcgatctgcctctaatgtgttccgtccttattgcaaaaatcaattccccactactactccatcatttttccccatgatttttcttttcaattccgctttaatttatgggaactaatctctatttagaagtcaccgtttatatcccgagttttatggagttgcttaaattttgataaaaaggaaacagtagatcaagtgtatcaaaaaccctcaaccaattttggaggatcgaacagaaaaactcatttattccttccttttcaatcccagcctagtacgtcatctctgtgcttagcctacctctctttgacatagcgcacaatgggagctataggctcaactcgtatagctagctgactgccgtcttcaaaccccggaagagtgtattttcttttttttcgccattttttcttttttttcttcggtcttttttctctccgttttttggctgtcacgttcgatctgcctcctaatgtgttccctccttcaattgattgcaaaaatagattcctcactactactccatgatttttcccatgttttttttcctttcaattctgctttaatttataggatctaatctctacttaaaagtcaccgtttatatcgagctttatggattcgcttagattttgataaaaaaaaacagatacaatagatcaagacagaatggagaaaaaggaaaaaacacccctaaaaaaataaaaaacagacgaaaaaaaagaaaagaaaacggaaaaggagaaaagaaaggtgggtggaaaaaggaaaaaaaaagtggaggaacggtaaaaaggaaaaaaaaaagggcgaaaataaccttaaaaaagtgatggacaaaaaataccggaatccttatgtattttttagttaggtatatagatattttaaaaaactgctacaagttttttagtgaaaaacttctagatataattatagtataattgaagccactgtatctatactgtaattgcattgtaactatactacaatataagttatataaaacttgtatttaactataaaacttgtatttaactatggtttggctgattagcactaggatcttacgcgtgacatgtgtaaaaatttctttctatagcaatttttttctcttcatgctcaaatcccaaggcaatccgatgattgcaaatctgaaagttttggggggcaaaacacttgcagaagctttccagcaatttcatttatttactctcggcctctatctcaaaatataactattttactttatccgtctcaatatctatacatacaatcttaaaagactataccctctgtaattttacaacatacttctccatgattcccaaattgtacacccaatatacttctccatgacttcctaattttacgaggttctccggtatatcaagtatcatccatctataacgaatgacgtctctaaagagtgaatgagttttctcttttagataaaatgaagtttcctaaattgttcgccattattgtaacacatgggcactctgctagtataaatatatgtctagtttttcatggagttaaggagagatgtaaaaaaaaactagattgccttaatttcgtttattgtctcggttgggagctagggtgaggtggtattttgactcatggaggatcgatacctggacttagtttgcgggttgtggagatgtgttttgtttactctcacatatgtctcaaaatataactactttactctcctcatctcataatataactaatttactccttccatatcagaatgtaaagtgttttgcttttgtcttaagtcaaacttttttttcgaaagtttgacaaagt

SEQ ID NO: 68549 - DNA, 1929 bp, Oryza sativa
ttttgtcagcatgtggaacaagttagacttgtatgtgaagtgcctacgcagcctttgtctctgtcactgaacaaactgctatcaaaacttcaatttgtagcataaagagaatcccaaggatcaggttagataagtaaccaccaccttagagcaggtacaatagcagattattagctagctataaatatattttaataagataaaaaataaaagaaaataacaatgtgcgtatgataggtgagaccatatattaatagtatagtaagtatctattggatgaattggatgaattggctattagatcggctatagataaattagagctagtagtgggctatactattagacttgctcttataacatgtctaaagcacaattgaatctctattagacttgctcttataacatgtctaaagcacaattgaatctcgtccactcattgcggggagctcataaactggttagtgaatgcaacttgatatcgagatattgataaacgtttcatccacatcttctgctcatcgatctcaagctgtgaaaactcatgaaatcactaggtcaattgttcagacaaacatataaataagtcgagatgattatttgtgggctctccatctacaatagtcaatcgaaaacccgttggtttttatccgactcttgcacgtgtgacccacatcaacgcgtttacgctgccgatatttgtgaccttccctagtttgtctaagacaaccatctcataaaaaagaagtttctctgacacaatttgggcttaatgtgactatcgtcatctgtaattttgtcatctttctctagtctaaactttgaatccttgtcagacctaccaaacgaatgccatgtccatgtcaaggataaagtgcacgataatatatagacagcaggtaaccaagtcaattgcactgttttggtatcatgctttctgagagacagacaagaaaacactacaaaaacgatccattccaactggaattgggatgaagacgtacaggtcaacgagtcaaacatgtaaagtcttcagtttacaaattagtccttgattgcagcaactaaacaataattgaacacttacaataatgatttgttagtaactagagaagttaagaacttgcgcacatgagtatggattggtacgaaaaatgtcaccatgttaaagacttcacatttttatccttagattctgcaattttaggtttgtgctaggcatggcaacaaagcaatgcgccattttaagtggatcaccgagtcatactgagaaaaatctaggcaaaccacatgatgattactgacttaaaattcctctctaactaagcaattggatcatccttatcgcctatcagataacacgcctaggcaaattcatcttagcgggtacgttgtctgaaggtgctgcatcaggaactgagcagagtgtacatgacgaagtgatgagggcatctcgatgtttgacatgtctatgtccggtacttcctctgctatctcctctgtcgtgaaaggaatgctgcaatttgcagaggttagataggaaggatgatgaatgtacaggtcagataaacgtatgcaatcaaagctcatggacattttgggggcactaacctcaagtcgtcatccaagagaaatgaatttgacactggattttgtgcatcgctgctcaccatgtccctcattttggcaacaacctgcaattaaagaaatccacaagttagccgaaagaaagaacatggccatagatcacagttcacagctcaagaggagatgagaacatgcctcggctgatacactgtgggtaccatatttgtcatcccagtacatcgtacatagacgatatatctgcctcacacttaacgcctgacagatatccgtaaaacaaaataagtgcgcgtgtgaggaaaataaattctatgtgaagtataa

SEQ ID NO: 68550 - DNA, 3500 bp, Oryza sativa
ggaagttctagcttctttgtaatcagctgcaatccaggcagactgagcttgttcgctaccgtgtgaaccgggttagatgccttctgagtggcaacggacaccataacatttgctccgaaaaacctctccgagaagaatacccagaaaacgtcgtacacaaacaggcagacgagcagcaacgcgcagatctttatgttgggaagcctcacatggctgacgaacgctatgcatatggatatccccagcaggttattcaacaaccagtgccccgataccaaccaggcaaccaccgtgccgacgcagatcgcaaccagcaacccctgcaaccgggtaaacggcttcgagcagcacctcgacacgaacgggtccccaacgccgaggcgcgacctgacgcagtttacgtacggcgacaggcagaagaagagcgccatcgccgacgccacggcggtgaaggcggtgaccaggtgcgacaccgacgagaacaggtagaacatcagcagcaggctgcaggagctcgcgagcgggatcatgagcgcctgcgaccgggcgagcgtgatggaggcctcggagaagtcgaggttcctctccatctccctgccatggtccagcgcgcgcgacgccgacgcgtaggcgacggagacggcggtcaagatgagggcaagcgacgctggctcgagcaagtagctcagcttccacagcgattccatgtgatgtttttagcagtctctataacatggcacaatttttttttctgggtgaacgaacgaactgctattagtatcaaggtttaaggtaaattgagagaacatagcttctagatctagaactgaagctagggtttacgcccgtgaaattcgaaggatagagagaggatgggtggatgctctcaccagtatgcgatgcggcggaagaagcgggagaacggcgccgggggcggcggctgcggccctcccctggtcgctcgcggccgcggagggatggggatcggcgcaggcggccgaggggaaagggaagtatcctccagccgcacgacgctttcctctgccttgtttggcacaatttacgtagggatgcccgggagtatgagatatttggtatctttcctaactttttggtattgatttttatttcttttttcaagtaattttttgtattatactcagaaaaaaaaatgtccgtgtgttattgggagttgggaaataacttgaaacattagtattgctgtacagtataattaaaaaaagttaatcaaaatcttttcttagctttgagcaaaagctcattatttttttttccttttcagctctaacactgtcagttctctcctacctttctccactcgacctacctctcttttcttcggcctagcccacaagtggagccgtgggcccagctagcacagtcggctgcccacgcgcttctgtagcgtcttcaacctctggaagataatcccatgtgcctgcacgatgctggagccagttctccctcatcaaatccggcaagtctttctcaatcacctaaaattgattgaggacttttgatccactcgatctcctctttctggtttccccaaaatcggagcgaatccacaaaactcagataaaaagggccaggagaagctcgtcgaccggccatcattggtgaccgttcaacagacattaaatttggcgaattaaagccgaatttaaaggagaaatcatggggaaaatgacgagggaggataaggaaatcaatttttgcaatcaattggaggaggaaacgcatgcgtaggtagatcgatgtggcggcggcgctagggttcggcctgggcggcggctagagattaaatccggtgaattaaagtcaaattaaaaggggaaaatgatgacggaggagtgggaaatcaatttttgcaatcaattagaagagaaaacacatgcggagacagatcgatatggtggcggcggcggagactgaaggcatgtgcctatcgagcgacgtacggacgatgtacaaagaaaagaaatacaaaatccttatgtattttttattaggtatagaattacttccttcatccctgcagctatttttggacagagggagtaccatttcctatgcgttgctgtcggagcccaagctctaataacgaaaactagtggaactccattttagattcagttagggaacatgtgtgcagttgctaagtccgagacatgtgagacagtgggaagcagagtggtgaaaatgtaataccctactctagtttcattcttctttggatctcttattccaactcttaattacaaggggtgaaactttgctagctattgctagctaaaactacgtggagcgtaatatccttttttttatgtgtgtttgtcctctctaagcagccctagctctctccttatagtccacgcaagaacagcatagtggttggtccatcactagtggaccctagtataggggttagctattgaaggtcatgttacttattgacaaatgggcctggctgttgtgcccaactagggtataggccttgccacctggctgcgcgttctgagtgtgcatgcaaggtttggagtagaagcctagagcattgttgacgccagcaggaaccttctgttaattagtctcaggtagaagaaagtgtgaaaaggttgtgcccgatagagtggcatcggcaaataaccatgctgcctaatagcccacactctttccccgcaggggtgatgatggtgcacgtgactgttgtacaggcaccatcccatcacatgtcgcctcggttgcaccctaagttggtaagcatcgcctagcattttatgcaaggcttactttgttgatgatagctatagcaccccgcgtcctatcacggttaatgcgctggcgctaccccaagctcagccttgcaagggccaatctcgagggcaagcagcaaccatgccccgagaggcgaggtcccaagctcgggttccagctagcggccatagggatgaacacgaggtcacccctaccaggggcggtcctaggttcttgttgtgtttctcctcaagtgcatatcgaccattgcatgggctagttgatagttgtgtgggctgcctgatccgatgttgttcattgggttccccaagcagccagtgatgggaagcctggttccaagtttaccaatatagcaattgaaaaaacaaaaggtggtgatataaattagagtgctatatgatttgatcacggtttaatttttataatgaaatccaaaattagctctatgggtccgaaggggccttaatcacaacctagtgcaggacaacaacatcaagtaagaaaataaataaatggtaaaataacaggaatgaaagaaagcagatgacccatcaatttttatgaacaaaagaaaatggtaaaccaatgtaaactctaatggaattggtcctaacggacctgctgaaccactcaaacaagttgattctgcttaggctcgcgcatgggttacgttcttatacaaggttaggttcaataatccg

SEQ ID NO: 68551 - DNA, 8066 bp, Oryza sativa
aaccccttgagtagtgtaacacatttccgagagtcatgaatatatatattttttagggaaccgagagttacgaatatgatggtattgttagtatccaaaaaggacatttgctttggttggaacgtggatcccggatgtagaaccacaatgtcatcaaacatgagattgatgactacggtatggaaacggatgagaacaaagcacattctcaggcatggggattcccttttttagccattgaaaggaaatgtgttggatgtgctgatgatggcgtcggccatggagacagtgaggcacacaagagctcggtgtcggtggtgcgttgctatattcatggagaagaagcagagggaaactctttggtatcaatctattaggaatatgtttacatggttattatggttcatttacattacccatctaaataattacataacataaaacctcactggtaatagaagattttagtagtgcaagcagtggggaagtatcaacggttatcatcatggaggctagggctcggcggtgtgctcaattttgcgagaaatcgatcaagagaggaatgatctgagtggcgtgacgatagaagatatgatagtcatgggcctaggatgcaacacaagtttaggctgcaaacggtcaaagaggctcacgtacgtgaagcgaggcacatcttgtgatcggattaacggatgatggagtcaagtttcacatatcaagtagtacagaagagacatgttaggtctttttggcacaactctagatccaaatttttttaagctgggtattcctaaatctacaaatccatgatctttatatatatagatatatatatatatatatatatatatatatatatatatatatatatatatatatatatgattatgttaataacattcggataaattatcttatttcattttagattaaatttttaatttttaattcatcaaaacagtggtaactatatgtcggaagccacaactttgatggaggccatgcaaacaacatcctaaaagttcttttaaaaaatgtcaaaaaaggtgatattagagaactaccggtatgaccaaacttgacttcgtccgtgagataaaaaaaattacaattactagtaaagaaaaagatgcaaatcagcaatattgtttttccatagccatttgttaattttgtatctcacgaactaggttgaattaggttgtgcaatttcgtatggttctctcgaatcatcttacctgtatgtgtgaatttcttttagatcttttgacaacttttatgcaatcgtttttaagttgtcaccaaatatatggtctccactgcatagttttctctaaaatagggtatatgttgaaagtaggtaaatttttccctagtaatggtactcgatttattcttcctgggtgcagtaaccgcgtcgtgtggtgcaaccggaccgatggcagatgacatggcatttccatgggtccgctttagtatatacaaggaaaaaatatgaattaccccctaaactattgcgacagtacgaattacccctgaaactacaaaaccaaacatattaaacctcaaactattgaaaccggacgaattacccccccccgactcaatccggagcggttttagtcctacgtggcatacacgtggcgccgacgtcgaaatcccatcaacaaaaaataaaataaaataatgtagggcccacatgtcatattaatactttttctgtgtgtgctcttatcgttggaggcgagcggctacgagcccggctgggcgagcaacggcgggcacggttccggccggcagtaggcgcggcggggaaggggaaccggtcggcggatgggagggcgcaccaggcaacggctggagcggcagggagggggcgcggctaggagtgctctccaggtcgcgacgggagcggcggggaggaggaaccggtcggcggtggtcgcaggagaaggtgccaaccggagccgggaagtccggcggcagagacatgttccactggagcgacgctgacgcgccagaggccagggccagccgatgggggatcccacgatgggacgacggccagtgttggcctcctgacaactgggtcggcggagtagatcgaggcgatgaagtggcatctgtcctccgacgacagcgaagcagggcggggtggcggtggtggagacggggccatgccggcggaactcgggcagctgtccttgaccggagtggaggagttggtcggctaccccgggcccgggcatggctagagggcggccgacggccgggcatggcgagagagcaatcgacggccggcgggtgcgacggggagggcgccgtcaccagagccatcggtgtagccaagtcgccgcatccttctcctcactgccatcatcgttgacttgctggtccccttcctgcgaggtcggccggtggcgaggagaactcatagagggcgccgatgggcatggataggcagcgaggttgcccctccctcctgctcctagccccacccccaccctctactacctctctctctctttctctctctggttatggcgggtgtgttgtagagaagaagagaggaaggagaagatagggccatagagggtgtcaggtgggccctactgccaggtaggattaaaacaaaatttcattgccacgttggacgccaagtaggatcaaaaacagatgatattaagataggggggttgtttgtccagtttgaagaattaagggtgttaaatgtccggttttatagtttaggggggtaaatcggacgaccgcaatacttcaggcgggtaattcgtactttttcctatatacaatgatgtggagtggttgtaagactcgccattttgccacactgagaagtgagaacattgtatgacatgtggactcgatgcatcattaaggtgagagttataacagggctataattttacaataatttcggccccatcaattgggcatatgtgcgcataatacattatacggcatattagccagccaggggcggagctacagtaaagggccggtgtcaggcgacactgatgactttcggcaaaacctatagcaaaactgtttatccatatgttattacactatgatctaagtataattaatatactatgacaccgatagacacgttatgacaccaacgaatcgattttctatattcgccactgatattagcagaataataggtaccggcttataggtgttggtttatttaaaaccggcacttatactttagaaaaactaggatctatacttatattacaggtgctggatctatataaaattaaatcgggacctatagtatttgtacttatttttttttaaaaaagggcacctataataaactatgggaacgggcacccgagccgagctgaaccgagcgcctatactccactcttagtccttatccatctggccatactccactccttcattcttccctccctcctcctcacctctgttgcgaggtggtggccggagtcggtggaggtggttgcggtgttgcctccatgtctgctgccctcccctccggcccccactcccttggcggaggcgaaggaggactgcggcggccgcctgcggaaggctacatccagcggcagcgatagagaagaccagcgcgggcggccattctctgctgcatccgcctcccccctcccccgccttctcctcctccagatccaccgccggtgaagaagaccgacggtagagggcgaggcggcggccggatccggcgatgacctctcctctccatcaggcgacgatgccggtggtggttttaaatttaatttttttttgctttggttggttccatatagagcaaacaattaatagaggcctccatcggtagtcgttgagttaatatcactttgggctatgttttatcgtaaaagttttagtttggaccaccctttgtccatttttttactttaggctaggtaactttatcttaatttgttgtacaatagactacctcaaaccacatctttagcacttcaatgactttgagcaaaacattaatgacatgccggcgaattttcatacttatatgcatgtcatacctttatcaaggagacgttagacatggtttgcgaagagagctagaatggtccattaattatgcaacaaatataaagttacataattcaaagtgaaaagattggatatagaatgatcatgagttaaacttcgacgataaaacatggtacgaagtgcaattcactcttaaacttgtcatcctctaaaatttacttaaaataaaataaatgccacacctatgagaactgatttggttttatttgataacataatatagatatgcgcatagaaatacggattcgaatcggaaagtcatgtacgcaagcaaatcaagaactgtttatgtgatccccagattcctattatatgataggacagtaggtccatctctatcccaagctagtgcaccacacatatcacaatatcagccaaaactcatgcaccccactcctctctgactccgtagtccagttgaaaagacaattaatcaagtgaaaattggaaccatgtcattataattttataaaatttaagatatgatatcctgacccacatgtcattgactcatatgggtcctcatatcattgaaataccgatggcatatctcaaacattgcaaaattataatggcatggttccaatttacccattaatcaacgggaaggacgccgagatgtgttcggcactgcctgctagtaactttcagaacggaaaagagttaactcattttcatataattaattatgtattagctaaaagagtaattttattggttcttgagaaggtatcagaggcaccatattttctacagtgaaatctggtacctccagggttaggaggtatggaaatttatggtaaaatttttcttacctctcagtataatttatctggctaaaaacttaaaaattagattaatatgaatttttaaaataacttttttctgattttctctaattctccacagcatcttcatgttagtacagtagtatatttgtgtagatcaaataaattatggaaagtcagcgcgcgtgcagcggcggctcaagaaatttcgctgtcacggctctctcacggcattgatcttcccaaacccataatgccaccactcgatcgatcaccacactgctgcaaataatcgactttctctctctctagtctctatatacaatatcgatcagtggagcttaatttgcaaattaaccacattcgaatttctctctctctctctctagtctctataaacaagattgatcagtggagcttaatttgcaaattaaccaacattgcattgcctacgcaagagcgagcatacatgatttccatggcgccggcggcgccatttccacgtcgtcttctactctcgctcctcctcggcgtgctcgtcgtcgccgtcgtcgcggcggccgacgtcgagtcgtcggccggcggcggcggtggccgccggcattcgccgcggcggacgcgctactcccgcgtgttcagcttcggcgactcgctcaccgacaccggcaacgcggccatcctcccggccaccgccggcgggcccttcacgcggcctccgtacgggatgaccttctaccaccaccccaccggccgcgcctccgacggccgcctcgtcatcgacttcctcggtaaacatcaacgatatgatcccgattatttttttcttaaaaagaaaaaaaaaagaaaggtcccaatcatctatgatggagaataagtgaattgtctgcttttcctcgtcgattttgctatatacttatccataaattttttccttaaaatttaacatatgtaaatatagtacaatctcagtgtaactaaggtgatgtttggatacatgaactaaattttaatccctatcacatctgatatttggacactaattataagtattaaacgtagactaatgataaaactcattccataacccttaactaattcgcgagacaaatctattgaccctaattaatccatgattagcctatgtgatgctacagtaaacatgtgctaattatgtattaattagacttaaaaaatttgttagcgaatcagctctcatttatgcaattagttttattattagtctacgtttaatacgtctaattagtgtccaaacatccgatttgacatagactaaaatttagtccccgatccaaacaccacctaaatacagtaatttgcatgtaactaccatttaactacgatataattttaaaccgttatatttgctttaaaattcgtgcaaggacggtaggaaaaaatcacaacccacacacatgtgggaggattcggtaccgttacctctgttttcacagaaatagcatgtcacctagagatttttaaaaattatatacaagttatactatagttacttgcaaactataatatattcacatcacgattatactacatttacatctgtcaaattttttagttaacaaatatatagctagccccgcaatcttagttttctgattgaacgtgcatgcagttttacttaaacaaaaccatggattaattagttaattgttatcatgtatgtaattcatgtgacgtcgtcttcatcgatcgcttgtttgtgtggactgtggagcgcatgcatacagtgaaggcgctggggctgccggagccgacgccgtacctcgccggaaagacggcggcggacttccggcgaggggtgaacttcgcggtgggcggcgcgacggcgcttgacccggcgttcttgaagagcaggggaatgacctcctccgtgccagtgtctctcagcaacgagacgaggtggttccaggatgtcctgcagctgctcggcgcatcagcgcacggtaattaagctagcattgcacaacattaatttcatgcttctgatgttaatagttacctagttgattgatagagtgaaagtaattaggccgtgtttagttccacgctaaaattaaaagtttgaaaaaattggaatgatgtgacgaaaaagttgaaaatttgaagaaaaaagatggaaactaaacaggccttaacaaaattactcaatcaggctttggtaggttattccctgatagagagagactttttttggaaagtctttcttttttgagagatcggataggagctctgccatttaaagacttttggaaactctcactgttaatcacgaaagtttaatactttctctatttcacacactgtaagattttttgggtgttgaatagattcatacattaattgatctatgtatatgcgctttatatatgtgcccaaatttaaatgaatattaataaatttagataaggcgatggagagaacaaaacattttacattttacagtacggaaagaaaaggagggagtgtatctaaacacaaaatgaacaattgggttgtctatttgaaccaatggaaaacacagttttgaattttgactgaacaattgggtcggtgaattaattcacatgtggcttctgatcgatttgggttgtcaaattgtacagttttgagtgaagtttaacacgaagaaatacaaatgtcttgcttgaataattttttaagcggcgtaacttaatttgatcgcaccgtacgtccccaccataacatgtttttaccaccaatattttctactacttcagagaagcacacaatcgcggcaagctcaatcttctatttcggcgagatcggattcaacgactactctttcgccctctccgccggcaacggcaccgtcgacgttgcggcgagcttggtgcccgacatcatcgccgtcatccgttcggccgtcactgtaagagcagcgcatactaccataaaaatattttttctgtacaaggaccctgtaggttatagacggtataacggactgtaactgtctcgtctaaaaaatggacttccattttcacagatgactttataataggagcgcatacaaaaaaaaatctattttcataggcggacctcttaaggggccgtttgtgaaaatgatcatattttcgcatgtggttctcttaagaggcagcatacaaaaatctattttcgcat

SEQ ID NO: 68552 - DNA, 1584 bp, Oryza sativa
aggacagcgattgcgaggtctggtggcgagggtggtgatccggtgactgcaacgacggcagcggcccccttggccctcccccgtgcagatccggcgacagactcgagcaggaggccggtggcggctctcccccgccctcccccgcgcggatccagagttgggcggcacggtggtggcatgtgcgggctccggcggcaggcgcggatccactgtcggcgacaacgggagctacggatccgccggcggtggagatgggagaggcggatccgccagcgatggcagcggtggcgattagctagggttagggttaggtttttgtgttttggatttttttttttgcgatttttcatttttcgcttgcacacggcttaagcgcttgcattccgcatgcggtgcaccacccgcatggaaatattatcatttttatatgccctattgggcaggcagttggtacaaccgcacgcaaaaaactatttcgacagtttgaaaaaaatatgtttttgtagtagtggcccgctcgatttgattcgtggccggttgctttgcttacatgtcttgcaattgagttgtgtgtgtgtgtgtatatatgcaggccgtgatcgccgccggagcaaggacggtggtggtcgccggcatgataccaattggatgcgagccggagatgcttgccctcttccccggtggcgcaggcaactactacgacccggcgtccggctgcatcacgcggttcaacgacctcgccgagctgcacaaccgtgagctgcagcgggcgctccacgagctccgccgagcccaccccggcgccaccgccgtccgctatgccgacctttacggtccagtcgccgcagctgtcgcttcgcccaaagaatacggtactctccccgttttatattacaagtgacaacgatatctttttatcctttttccagacgtgtatatttctataaaaccggtagaaaaagatatatattttcaatttctttttcaatcggcgacagaacaatctccgcacgcgagacgaatccatcatcatcgtcgtctcgctgctgatatgggtggatgttgttttcggcagggtttgggagctcgccgttggcggcatgctgcggcagcggcggtgagccgtacaacttcaacgccaacttcacgggattctgcgccacaccagggtcgacggtgtgcgcggacggcccatcatcgtcggtgtcatgggacggaatccactacacggaggccaccaacaagctcgtcgcccgtgccatcctgacacgaccgtgaaatcatcaactatatactccctccgtcctaaaaagaccatcgttttagttagtccaggcagggacggatccagaaacagaaaattggggggcctcggttacatggtttcttcgacctctagccatctaaaaacctttaatttagcatttacggtgaaaaaaatcaaaggggtgctccgaggggtatccataggtcttgtgggtgtaggggggactcgagtccccctgcacccatgttggatccgcccctgagtccagacatattaaacatgcattttgttaatatgctctgcattaatatgaagag

SEQ ID NO: 68553 - DNA, 8548 bp, Oryza sativa
  unsure (1)..(8548): unsure at all n locations
cgccgactggatccacatagccgactgccgcccggttgaccggttccccctcccatcccgcccgagcctaccgccggcgtcacgggcgccgcgtcacccccatgaggtaaggaaggcagtcgtgtcggaggcgctcccactcgagtgtccgccactctcgcttccgcgtccctcaccgccgtccgtcgttcgccccagcgcgccacagtccgccgcccgcccctccacgccgccgtgcgtacctgcacccgtgccgactgcccccacccacctgcgcccgcgccgaccgtccccgcccaccacccatccccgcgccgttgtgccgccatacgagagagagaggagaagagtcgtgcgagagagtagaaagagaggaagtagggaagatgagtatgatatgtgggtcccacctttttttaataaataaaatgctaactggattgtcacgcgtacgccacgtagaacaaaaccgctctgaattgggttaagaggggtaattcgtctggtattaaaagtttaggatgagcaatgtctggttttttttagttcaggggtaattaggtcgaccgcgatagttagggggtaattcgtacttttgctaaaataaaaataaggtcacatggtcgtaccgttaaaaaaaaaaaagtcatggccgtgtcccttctggaccgcgtcggctttattggttgtgggccaaacccaggctagcccaaccctcctagcttcattaattctaacacggcatcaaagggagcaaaatgtcagggaaattaaatttggtttgcagtgttcgcgaaataaacacgattattacatgactcttcctccttgtcgtcgacgacgtcgttgatcctgcgtcttgcattcttgtgttggacgtgtgccattttaattttggaagtgtgaaatcgtcaattcattgagatctcggtcagttagtcggtatccgtcacgtctctcgtcgcaatcccatcggtgtccacaccacgccggaggtgtttcgttttgttttgaattttttttccctttgaatgaacgttacctcattttgtacccctcgcttaaacacgattgaacattttagagtatgtttttataacactacatgaattttgatgaaactattgtaaaattacagatttaaataattgtatcctaaactataatttagcggtaaattatttccaaaactacatattctagaaatcgtattataaaattagacctagaaattgtattataaaattagacttagcgatattcaagtaactattaagattacaaaagttttagttttctttacaaaactgatgttaaatttgtagttttataatacgatacctttaaatatgtagtttactgaaaatataatgttaaatctataattttgtgatacacatttttaaattgataggctaatcaaagtcttgtagttttgtaaaatttattcaaaactttaaaaaaccatggtgagatagatcaatatgtgtgatgtgttgctttacaatcatgtaattttaaattcaacttaaacaacaagaataacaaaatatggttgggcatgaactatagagtatagacaatctcatttgtttttcgattctgaatttgtcaaaaaaattatgacttagaatggacagctaaaatatatacataaaagagagagaaaaaaaagactttcctactggacgccaattacaaatagatagaaccctcgccgagccggtaaccacgggaagcatatcgatgacgccattttccccgcatctcgtcgccgccgccgccgcgctcctcggcgtcctcgccaccgccgtcgccggaggcgggacgggcgcctacacccgcgtgttcagcttcggcgactcgctcaccgacaccggcaatgcgctgcacctcccgtccaccggcggcggcggcggcccggccagccgccctccctacggcgagaccttcttccgccgccccaccggccgcgcctccgacggccgcctcgccgtcgacttcatcggtagccaaccaccaccaccacacattcattctcaaaaccaaaatggcaaacttctgatcacgacgtgacgacgtgcagtggaggcgctgcggctgcggcacccggcgccgtacctcgccgccggcggcgagacggcggcggagttccggcacggcgtgaacttcgccgtcggcgggtcgacggcgctgccgccggagttctacgagggccgtggtctcaagccgttcgtgccggtctctctcgcgaaccagaccgcctggttctacaaagtcttgcagattcttggatcttcagatcacggtaaaaaaatcaaaaaaaaaacattagaaataattaacgtggatcgcgacgtgccatctaccggccgaaatgttcgatcagtgtatcatcgagtgcttttttatttttctctgacatcattaataaacgcacgtgccggaaaaatgcgtgttggttcacttttgatagggaggaggaagatcatggcgagctcgctgttcatcgtcggggagatcggcgtgaacgactacctcgtctccctcgtcggcaacctcaccgtcggcgaggtcgagacctccgtcgtgccgcacatcgtcgctgccatccgctccaccgtgaacgtacgtaagtttaattggtacgatcgttgcgttgtgaacatcaactctctgacgtgtaatctttttgcgcgttcacaaaaaagagcagatcatcttgatcagtaatgacacatcgaccagtgtcacgacacgtaggttttcgatcgatctcatgtgtgtgtgtgtgtgtgttgcaggaggtgatcgccgccggagcgacgacggtggtggtgccggggatgatacctctcggctgcgagccgcagctgctcgcgctctaccagggcggcggcggcgtcgccggcgacgactacgacccggagtccggctgcatgacgcggctgaacggcctcgccgagcaccacaaccgcgagctgcgccgcgccgtcgccgagctccgcggcgcgcacccaggcgcgtccgtcgtcgtggcctacgccgacctctaccgcgccgtcgccgacatcgtcgcctcgccggggaggcacgggttcgggggcgcgccgctcgccgcgtgctgcggcgccggcgccggcgcgtacaacttcgacatggcggcattctgcggcgcggcggggtcgacggcgtgcgcggacccgtcggcgtacgtgtcgtgggacggcgtgcacttcaccgaggcggccaacaggcacatcgcctgcgccgtgctggaggccggcggcggcgcaccgccggccgtggcaacgccgctggcgacgtggtcggcggcggcggaggctggacgtagtaggatagggtgctcttagactgagtatacgtggatggctgggatagcttccacgtggaggcccacggtgagcccgtggccctacgccctcttgctgaacatgtggatgaattgatccatcacctttctgttttgttgaccagtgaagcagactactgttggctgttgccgtcagacatttgggcaaaagatgtattcagtgatgtcatactgatatattggaaattactttgtcacaatgttacaaaatcaactgataaagactccctcgaaattaattaaaaaaacattagttgtgccctatggtagatagccagctgggtaaaacattttaattgtctaagaaagaactactctgaattaaagtgatttgaccgacgtatagcaaaccttacataaacgtttagggctcattcatttcaataaaggaaacatataagaatatccattcgtttcaaaggaatccagcaaagaaaaaattttctatttctccactttttgggggaaaacacacgaaaaaaaataatccacttcaagacaatgttttcaatatcctttggttggcttgctaaataatcaaagataagttttctatgtttttaatgggtgaatagctaatacggtccctgaagtttcgcttcgggcttaatttagtcctcgatgtttcaaatcgtccaaacaagtcctccaaatttattatttgggttaatatagtactcagacccacaaaaaatgtaacgtaagcatgccaagtcatccttacatgcagtgggtatgaataaaantgatcattctaccccttatatatcatatacaaaagaaagaaaagacacaaacaaaaagaattgtggagggtggccaacaaaggaatttacactatcagtgctggctacagcaatcgtaaatgacgattctaaaacaatcatacacgtgtgaaacatttatcttcttttttttctttcttttctatatggtatataagggtacaatggtcatttcattcataccgctgcatgcgaggatgacttgtcatgctaacgtggcactttttgttggtccaaggactatattaaccaaaatgattaatttggaggacttgtttggacgatttgaaacctcaaggactaaattgagcccgaagcgaaacttccgtgactatgttacctattcatccatttttaattctcagacttgcacatgtattttcatactatttctatgtttcaaaatcctataaactaaacgagcctagacccctttggctcggtgaattcataaggaaaattaaggataattcaattctatatttctcattgaaatttctatagaatgataatcctatgactttagaggaagttttccatgaggtcataactaacggtttctttcctttttcttacttcaaacaccttttttgaagttttgtgtttttcttttttaagcaatgtagaaaatggagaattgacaaagaatgtttggaagattcaattttctatggacttttttcatatagaccactttaattcacgggaaaaagattgaaacttttccatagcatttctatagtcaaattccaaatgaaaaccagcgaacgtttagtcttcttggaaacattttttggttcaatgtgtcttatggcacaatcaaaggtcttctcttcttgttgggacatggccgggaccagtactttaaccatgggtgtacgtaccaagttaattaaaaaaattatcaacaatgtattgttatatgtagaaaaactaaaatgacagcagtttactacatgctttgaaatcggttttttggcagtgttacgacaactatctagcctgttaggtccaaatgtgtgtgtgtgtgtagttttgtgcaaatctggatttgaaaagtataattggatttgacatccaattcttgttttcacttttataaacagatcgaaccataccttgtacacaattatactgaccaatttatgtttttataaatgcaattgtagtttgtatacaaccatatcgagcaatgtacaccgttataatctaaatccaccacaatcgtatagggcatatgttctttttttattattatttcacgtggtaatcattagagaccttgagatctatttttttgtatttatgcaatttattaacattgttttttaacatttagtacacgtttaaaaatatatttcgtttatttggcctctgtataaaaagcacacgggcactacgctgcggtcaaaaagagaaaagtaacctcattttcttttcttgatttgtgacgttcagttaatcagtttgcatgagtatcgtgtctaaatcaacctaggctagctaccaacctcatgataaaacataaagctacacatgccaataaatattgatcgaccaaaagtgcacactacatatatctccatactaacttggagaagaattctatcaccaattaattaagcgatgagttcggcatgttgctttttatgcacatgtgcatgcatccagcttaattagtggaagaaaacgcatttaggcatcttagagtataggttaaagtgcaacctctatgtggatcatatcactgatcttgaggaacttttggatcacacgagctctttaaaatcgtgttttgcagaaagtttacatcacgacgaccatggcacaaacaactttcacaaccaaaaagaatgtttagggccaactccctaccttatcggtgcaatgtttctttacaacaaaaaaattcggcagatatatatgcatgaaacaacatttgccttatagggcaagcaacacgtgacagtgaggatataaaatgcaattggatgtacaaaagttattatttattgcgatggatgaagttgtttgcttgtgctgtgtaagcatggatgaagttgtttaatttgcgtcgtgtgctgtatgagcattattctcttgaccatctagtacatatgaatattatagaattggaaatgtgggatgaaaaataaatgtagtgagaaagtgaatggctttttcttagcagaaaaggaaaattctaaacccatgtaaaagccatgatcacgtcaaaagttaaaagcattcctcttatcctttttcatccatgaagtagtcaagtagcatacacaaaacatgtggggaaatgtaacagctatattgcaactcaacatatgaaaagattatgtacaccatatgagcttaaaaagttagagcagacaaaacgacagcacatgaaaagaacacaattaggatatgacaatctaaatcatgcgttggaataacaaaaaaaaagttgaaagacaaaacataagttgttgaaaacattcagctgttcttattgctggaattgtgcttcagtacgttttcttattgtaaggttgaattaatatttaaaagtaaacatacaaaacatattagaacaagtggcctaagtaatgcacaataagatctttatttttgagaaatcatatttttagaagcatggagcaaataatctacggtagtgatataatgaagaagctgaaaaaaaggggctatgttaccatggacattctgaagatagtatggacccataatgtggcaatcagtacatgaattcaggaattaaagtaaaaagattttgttccacaacacgattcatttttatatagctttctaatgaattcatatgaattagaggtccaagctaagtaaatcccttgcttttgtataaaaaaaaattggcggccggcagaagccaacctgagcatattcaacaatagcccctatagtttaaatggaggctgccccatttattcaagatctaaaagatgcctccaatctagtagtagtctccatttctcaatccttatttttttagttttctctttcatttcaatatacactctatctttatgactagtttaacactacaataattcaaacataaatatttctaacacatagaattcaaccatatttaaattcacaattgtaaacaccatgttcacaatttatattcaaccatattcaaaatcaaaatttcaaatggaaatgaaaatgacatatcataccatgaaagtctcgacatattaatcataatcaggtttattctaattaataacagatcaaaacactgaacaaagttttagacacaacatgaagttcgatcaaaaattaaaagcaaagccatgtaacactgccaaggacatgcaaaagatggcatgggcagggatggttcaaagggcggcggccatggagcacacagctggtgttcatgtgcccggcggcatgcagcctgtcaggtgaggacgataccagcgcctacgcaggagatcaccaggagcggtgaggttggaaacaatggcattgtcgcaacgtcccctggatggaggtgacacaacacgaaaaggaaattgtcatctcgtgtagaaaaaatagatggggattgtggctagagtctccaaaactagaggcttggaggtgagattttggtgccttactattctagaggttgtaataaggactctgctggaatttgttttctacgctcaaccctcgaaagttgtttaggggctctacatttagaatccttgctggagatgctagctctctttgcccatctattttgcagaaaattttagggaataaatttaatttatttagttagattaattagggatgtgctacgttctaggcactaaggagtactacgtgctcgcgaattagccgatatccatcatatccttagggaaccaagcactatctaaacacgcaattgtaaagcaaagcgttctcgattggaactcaaatgatagggaaatgacataacatgagctattgcagggaaaactgaccaaagctaaatacacataaacttttcttcaacgctacacttcttttcagtctgaatgcttgagatttttttcagtactgaacgcttgagatttccatgattgctgcctcttgtacacctgtgtttgtagagtgtgtaacatcatatctctatttaataagcccagtggtttttgtacggagggggggaaatgattcgattcttggggtcacctaacgagttggaatgcagtagatatatgtcatgttcccaatcagaggaaaacaaacaggtcttgccaacaaaactgacgcacaacacgctgcgaattaatgtccggcggaaaatcggcactgtacttctcttgtactccctccgtctaaaaaaaaa

SEQ ID NO: 68554 - DNA, 9620 bp, Oryza sativa
aactaggttttaagttttaaattttagcatgcatatatatcggctgattttgtacagagggaacgatgcatggagacgttaatgcacggcagacggcagatgcatcggcgcatcagcgatggacggtgctggttgattgtgatatatgccgatcgatgccgccgtccccttttctctcgtgtagtcgtctggtagcaccgcacaagactatacacgccgagaattaaaggcaacgcatgcgtggccggggcggctggaaagtttgtgctgctttgctagggcggaaaagcaaattaaacagccggccggtgcacacatacaacgcacgcggcaacggcggcgaggcgagacgcgcggacgcttgccgactggcgactgatgacgactcgattggttaatttggccgccggctcgatcgcccgctgctgcgcctgcgtggtgcgcgcgggtgagcaacccacaaccataccacgcttgctcgatcgggcgcgggcgggccggatggatcgctcgattttccccggctcggttgggcaggcggccgaggtcgtgtgcccaccgcggcggtcttgctctgggccgaattggacggtttgaatgttgaaaggtttgcaaagttgttgttggaaacacgttcattttaggtccctcatcaagttcgaatttcgatattacgtttttctcaacttttaaaaccagtgtacccaagatcccaaatagtatagtacctggttttagctaacgtggcgggtgagacccacgtggatcccacaagtgaggcctattttcttcttcctccaacttaccatctcttttcatctcctattcccccaccttcgcccctcccccactgtctgtcgatggagaatggaggagagagaaatatgtctaacatgcaaagcccagtcatcacgtcagccaaagctggacgctatactgcttgggatctcaagtatatcggtgcaagttgagagactctttatatatgatattacggtttgacaatgaaatttgaactcgatatcaagacgagaaacctaaagtaaacttattcctcgctggatatatcaacacgttgtaggctgagccctgtgcgttgtattgtactgggccggtcgctggtctgtgctgttggcaaagctgcatgggctgccccgtatttgccaaatcacatcgggcatcattccagttttttcagcggtttggtttgtcactaatactactttacccaatgagaacatttacagtgcagtggttcgccgagtggtctcactgaccatgcaggctctgagccggaatggcctcgcagaaggtatggtggcttactgaaagaagtgtggtcctcccagtgaaaggggaggaataaggtgtgcaccttagtcatctgcacgggaagagcgattggcaagccaataaatggaggaagaagggaagccgagggcgaagatccaccacctgcgccacctacaaagacgactccaacgacctgcgttaacaactccgatgacctgcgagagaacgaatggatctggcatgatctgtttagctcgtggccagtaccagtgattttctagtttgtgtcgcagtgcagggagtcgagacgcaaggtagtgtgtgcgagaaagatgggttcggagtgtagagagaggaagggaagggtggaaagagaaaaaaaaggtgttatgccaatgacaaatggggcacaggtctaaaaggggtatatgtgtgattcaattttgttcaagagggttcctcatgtaaaagttgtaatcaactttggtaatagaggataatacaagggctaaagcgaaaatttgtaaaggctagaaatgcaaagatgcctgtggcctttggtaattatagcacactttggccatacgagtctactgtactaaataccctaaggccattcacaggcacctaggtgtcattctcccttatacagccagctcaaagattctcctccacctaggcatagctcggagcctcgccaagaacagggagccaatttttgctccctattattcgccagaatcgcagcttttgggccacaagagaatagatgaagaagggaggggaggggagaagcgccgatgccatcgtcctccccgatctgcgtcagccccccctcccccccaaatctgcgccggccgcgatgccccccgatccatgcctgccgccgagggaggaggccggacggggagaggaagcggcggtgcgccagacggggagctccgcccggtgtggtcgaagcttgggccgtgccgccgcctctggccccgacgaggagagatggaggcgtggagttcggtgccgctggcgctcggacgatgacgtcgctgccttcggccccgatgaggagagatggaggcatggagctcggcgtcgctgccgctttgcttcgtctgcccgagagagtgagtggtggggaaagtgtgagaggagagagagggagagataaaagtgagtggagagagataggtgggatccactccaagcaacatgcattgtgaagtatgtagctaatatggttctttagcccagttagaagcccaagcgcggcattttccaggacacactgtgagtagtttgcaagatatgaacatgacaaaggtaattgttaggaaccttttcatgtcagcacgtaaaacaaaacgatttattagctcatatttaattaaatgttagcttaaaagtttttaaataaattaatatatatatatatatatatatatatatatatatatatatatatatatatatatatttaaaaatatactgttaattgttctagtagcatgtgcgtgaaaaaagagaaagcagaagttgtgcagtgtgttgtcatacgggaaaaagaaaacttcaagattcctttgaatcatagaaatgaaaaaccaaaggaatagaaaaaacataagattccgatagaaatacgagtataaaacataggattataaaacactggaaaaccataggaatggatatttaattgaaccgcaggaaaaatatatgaatttaaaaagagataaagactcaaaggattctttccatgaagttctatctcatgttaaatttccttcaaaacttgcatggaaaaatacatttcatagaaattttgtagcattcattcctttgattcaaagagctaatctctccatcccaaaatgtttgacgctgttgacttttttaaaaatgtttgaccatttgtcttatttaaaaatttaagtaatcattaattctgtttctatcatttgatttattgttaaatatacttttatgtatacatatagttttacacatttcacaaaagtttttgaataagaggaacggtcaaatatgtttaaaaaagtcaacggcgtcaaacatttaggaaaagagagagtatattagaaaaattcatataggaatgaaaccatctaaaattccataagtttcctttgagtcaaagagcgcctcaaagtagctatcccaggacatcacaggagtggttgacaagtgacaaattaactaaacgcgttggtcgatgactcgatggccgccgatagtgtactaccatgacaagtcacccaaaggcccgcaaacacactagcatggcgcctggggccattctccgagtgacggcgcttctccgcttcatcctcctcgtcgccggcgccgcgacggcgacggcgaccgcggcaaggttctcccgcctgttcagcttcggggactcgctcaccgacaccggcaacctggtgctcctccccgccggccgcgatgtcccggagcgccgcctcccgtacggccagaccttcttccaccgcgccaccggccgcgcctccgacggcaggatcgccatcgacttcatcggtgccgcccgccaatctctctctctctctctactgtttcttcttgcaactcggtcaatcatttgataaactaacgtaactgtgcagcggaggcgctggagctgccgcgcctgaagccgtacctcgccggcgagggcgccgacggcttccgccacggcgcgaacttcgccgtgggcggcgcgacggcgcgggacgccgggttcttccagcgccgggggctcaggtccgtgccggtctccctcgccaccgagatgggctggttcaaggaactcctgccgcttcttgcctcctcctgtcctcaaggtgttcgacgacgaacactgaatattactgaattttactaatgcatcagcaatgcaatattacctgatctttctcccacgtagagcaaaggaagatcacggcgagctcgctgttcttcgtcggcgagatgggcggcaacgactacctcaacgccatcttccagaaccggactctcgacgaggccaagaccttcgttcccggcatcatcgatgccatccgttcatctctcgccgtacgccgtggcacgccatgatcgatcaccaatgcaattcaccttgattaccatttaaatcgtgatgattatatatgcaggagttgatcggggttggagcaaagacggtgttggtccaggggatgctgccgatcggctgtgagccgcgggtgctcgagctcttcaagctcaagcacggccgctccaccgccggcgacgacagcgactacgacgccgcgaccggctgcctgaagagcttcaacgagctcgccgagcagcacaaccgcgcgctcaccgccgccctggacgagctccgccgcgcccaccctggcaccgccatcgtctacgccgacctctaccgcgccgtcaccgacatcgccgtctcgccgcgcagatacggtaacgtgcattgattcctcgatctcctcccacagctacatacaacttcgcagtggcgaacttggagcaaaaattaccagggattctatacatatcaattatctaattattagttaatatatactaattataaattagctagcattgagtaatttacccggggtcaaggacccggtaaacactatgtaggttcgccactgcatcttctactctgtctcgtaaaaaagcaaatcctaactacgaatctggacacgcatatgtccaagttcatagctaggattaaattctttttgggatggagggggtacatatcttcgtaagtaatgtcttaagctgtttgtctactaaaaagggacaccccatcccccaccacgacaatgcatacaacctacgacaatgcatacggtaatttggaggccaaaattcgatccgcctataaagtgaaatgagtctcgtatgctaaaatcatttttctagtagagtctccttcttgcttcgtgttcatggcggcgtatgctgcagggttcggcggcgagccgctgttcgcgtgctgcggcggcggcgggggccgtacaacgtgaggctggcggcgaggtgcggcgacgaggggacggcggcgtgcggcgagccgtcggagtacgtttcgtgggacgggatacactacacggaggcggccaacagggtgatcgcgcgtggcatcgtggaagggcggtacaccgtgccaccgatatccttgtccgtatcttcgagcgattgaaaaaaacatgcccgaaatttggagggattttacgggttttttaaaaaagtgccacgaaggtacgagcgtacggctctaagggaataattaatgattgtgcatccattagtcaattatgtgtgtgatgatgatgtcaatgcaaaggggaaaagaacattgttgtgtgatgggctgatggcaatgtttttgtttcctttgtataaaatgtactccctccttccgtattataagtaactaggaaggcaacccgcgcggatgcgcgggaatcttgttgattgtttttataaaaagaatgtgaaaaaaaatcatattgatattaaatgataggaatatttctcaaattgaaataaaaacacttttaccgagtaacatataaatcactactatctccgtcccaaattaattgtaattctaagttatttagcatatattaaggtttgagaataaaaactatagtaccccttattaaacggttcatatgtaagaatgaaatagtagttgagagtaaaataagaataaatttggatgagatgtgttaatgggtatcattagtactctactgtgacaattattttgggacaaattcaaatcctaaaaatacaattatcatgggacaaaggtagtactacttattttgtttttaaagctgagaaagatgaagttgcatatgcgccaataaaataatcacaatacatcattaataaattacaaatatccactacttggttttcatgtctcacttatttgtaaatcaatacataaatatggtaaaaataccgttacttctacccattaatgggatagcaccattaaagttaaacatgaatgctactctaatagataaaaccgatcgtagccgccaagactttctttctttattgccttgaaatatggtcctgcatcaatatagttgtgttcctcaagatcagcttggatcacaattttaatatctaattcatgattgcatgctcataaattattacatcgataagtacgaagctgagcactattagctatcgcggccaccttaacttagtcgtatgttccatgctatatacctatatagcgaactctgttgttcatgcttggtgccctttaggaaaggacaaagagaagatggaggtgatcaagatagttctttttattgttttcagtgtatttgtggtttagtgtagacacagtttgtttttggtattcatcattattacacaaatttttatcatatagataaaatactcactattgaaaacgagtgaggttaatcattcgatgatattttaaaaaattaaaattaaatatgcataacaccacgataatatccagagcaccatattattgattatattttaacaaatatctatagtttagtgtctatgttttaacctcatagtcacgtcagtgaagtttatggcatatatccattaattatgcctgaaatattgaaatttcttaagtataagaaaatatattatgagtagtttattatacatgttgtttcactcttcatttgtgttaaaaatatttggcaaaaaaaatatgtgcccataggtctcataatggattatagcaagatctttggcaggaaatattgttgatagttttttttatatctatgcagcatgtatgctacccacttctcaaataccaattaaatagttctgaaaatatccaaaaaaaaatactttgagaatcttaatctcaaacaaattacaattaaatctcagacatactttaaaaaacataactaaattgtgatgttttcattttttttaatatgtagatttaaattagattgtatatttgtgtagtgatatttcacaccctaaaatatgatgtgaatttgttttgaaaaattatcatacaactaactattatatgtcggtccaatgtgtcgtgatgtatttaagatcacaatataaattttataatttagtttaaataatacatcaggatcacaaattagatatctgatctaaaataatttaaaatacagtttaaagaacgttgattggatattttttatattttattatagatcttagtttaactacatattttatatttctgaagtaatatattttatctttatattgtagaaaaaatcctattttaaagaaggttaatttttttcccaacagtatcacatacgtatgttttttttggctttgtcttttttatctacgtgcttttcttcccttccgtcaacagtaggtaaggtcattatattatattgtaggaaaacaatattttaaagaccgtcaattttttccccgatggtttcatggtcgcatgttttttaaatctaaaagtaatttaaaagatggtttaaagaatgttgattggatattatacatttttattatagatcataggttaactacatatttatatttgtgaagtactccctctatcccattataagtgcagctaaagtttccgtgcctaatgtttgaccgtccgtcttatttaaaaatttatgaaaaaattttaaaagttaagtcacacgtaaagtactattcatattttattatctaataacaacaaaaatactaatcataaaaatatttcaaataagacggattgtcaaagttaaacactaaaacccacaactactcttatgggacggagcaagtaatacagatctttatattttgtagaaaaagctattctaaaaaccgtcatttttttccctacggtaccatagacgcatagtgctttccttccggtaaatcaatcgtaagtacgaacggtaacggtagtactgtttatattgtatatgcaggaggaagctattattttaataataaatctaatctaatgatgtaaaataacgggtccaccaatttaagtgaaaatcgacggtgagatttaactgtgcctgtaggatcgaatcacaataactaagccaacagagggggtgaatggttggtatacccaaaaacctaaaacctaaaacttttagcggaaataaaagttaccctcgaaatcgacggatcgcggtctgactgaaggtgttgcgccggtctaaccgcctgatgaacgtcggtctgaccgatgtagatcgatcggtcgaaccgccgaagtcgcctgtcgtgcctgtcgccgccgccggtctgaccggccgtatgtcgtcggtctaaccgccgcttgccaccagtctgaccgccggtatatcaccggttagaccgccgaaatccagtaaacacaaatcgaagaactcttaaagtagatgacgactttattgattctctctgtgtttacaaagtgcaccaacagcactccttgcaaaaatttcgactaaactcgaaaccctaactcaaaactcaactcaattgctctcaaaagcgatactgggaagcctcacgctccccctctatttatacccgaggtaggcagcctaaagccacgaaccaaactcatactaggagtcctaaacaccttaggaaaccctctagtacaagaaacaaactttacataaccaatcataccaaatttggactccttccaaattcgactcagcatcccatacgcacacaatacctccatcgtatgccatatggaatctccatcaaccacatgcatcaactctagcctaagtatcccgcatgatctctgaccaccacggacgtcgtcttatccccaagccgactcttggtccatcaccgcaaatactctcctgaggcatcgagtcacctacacatgaaataaacaaagaaaccatattccgagactaagttatctccaacttgactcattagtagcaaacaacagtattacatacggatatccaaacaaacaacccgaaactgaaaccgacacagagtcggccggtcagaccgcaggctggccggtctgaccgcacgcatactgccggtctgaccggcaacacctgcccggtctgaccggtcacatgaaataaaagtacctgcgattcacctgtaaattcaatcatctccaaaaccacttcgtgaataaattccaaataacaaaaccaataatctccaatgccaattgttcatcacataataataatcaaaaacacctttgattttacagtgccatgtggcggcttgagagcgtttgtaggagtgccacatggtgg

SEQ ID NO: 68555 - DNA, 2114 bp, Oryza sativa
caaagtgtattcatttgtcaaatgtatctctgttgaatttttgtgctgtatgctagagatgaaataatgctaccgatgcttcacaaggtctgtttgtttgaatgctacaagtctgggtgtgctatggccaccataaaggaaatagcacatgttttctacagatgtatgagaatgctatgaatatacaattaatcagttatacatgccttccccagttaattacactgctttaataattcctgccatgtctggactcttgagttagacttgacgagggccatgagaaattcctcatggggaaatttgtatgctggtatagacaagcaccaccaatttgttgagataagcttctgaccttcagcttccttgcgtgcaagtactcaatggcagttttctacagtctacagaagctagcatgggtatttctttctggatgttctgtcagaaaataactgtagcacaattacttatcaaaatgttatacggttcaggaggtttagtggtctaaaacttttaacataatctaaaatctgtgatttgattcaatcaagtacaagcatactcttatgtgcagcagacatactcttgagtacttgaggttttagcatgtcttcactgcgctttaagatatgccattcacaattatatcctaacataataatcccttatttcttttacttaaataataatcccttaattggtagaacaaacaatcaaatttaatgaagcttcagttaaaaatttatacatacaaattagtgaatatggtaaaacatgtacgcttagattatttttatttggaaggttatgaatgcttatattattgagtgaagtgatttatctatatctttcaaactgttcatgatctccaaatacaagattgatggctatgcaattttgttcaaacaacagttagtgaatacagtttccttaataaaataaaacgaatgtacataccatggaggaaggcagatcaattcccatttgtgtatacaagtcatctgtccctctagtacttccactcctgtatgtccatccaaaattgtccagtacagtagctttccagaaaaagaatttttcctatacatgcctgcacatctatgattttccaatgaacagcaagtcatcaatatgtatgaagaaattacattggtggtttactgataacaaaatggctatcagccatcagggtaaaaataatgcaacttcgccaggtaaaaagttaacataatttaactgtcttcacttttcagagatgaacaagagattgagatgaatttagagtgcttacgcaggtttcttaaggttttatatgaagtctaaaacttccatctcgtcgtatgagtccctccgattcttcaaaacccttggtctgtcattgattatttctaggacctaattcaatagagttgcacatcaaactccggggaaaaaaattatgggcatcaacatattgcctgctatgctgctacttgataaatatgccaaggaggatagaatttcaaacaagagattcagcatatacccaattaatatgtctgcattaatattcctagaaaaatttcatggctttaatatgtaggttactgcaaataagttagtatacatgttgcgcagaggatcagaaaaactgaacaacacactaccaaccaaatcagtaactgtttcatgacaacacagctattaacagagatagaaaatgaactgctaaatgtctatgaagaaccaaggcataccaaatttccaggcaaaacgaaagtttacctctggccttgaatagagaacaccataagacatgcccacatcaacacaccaaaccttgccatcgcatttgctgggaaaaagaaataatcacctattacttctcttgatgttttttcagttgtaaattacccaagtgagaacaacagataccaattcactccacgagtctggggtgtgtgccctacaaccatcccttttgctcccacagatttcagtgttcgttcagcaaccacagaagatagctgaaaccaacaaaaataatttgacaagtctgtgataatcttatcaatagtgctattgatatattttccatagaccatagtgcaaaataagcatatgttttatcgata

SEQ ID NO: 68556 - DNA, 1000 bp, Oryza sativa
tttcctcccaaatagtttggaaatgaacttacaaacaattagtttctacttccttcgtttcaggttataagacattttgactttggtcaaagtcaaaatgctttaagtttgactaaatttgaagaaaaacaaataataacatttttaacccaagacaaatttattataaaaatatatttaattattgatttaatgaaactaatttgatattataaatattactatatttgtctataagcttaattaaagttgaagtagttcgacttttgacaaagtcaaaacgtcttgtaacctgaaatggagagagtattttttttctaaagatgattcccaatgcaaatagaaaaatgaactgatgtagcacgtataaacatggacaataaactagtttttatctataccggaacaagtgttcggcgagcacgtatatatagcataccggcgacgatgcggcggccgggcgcggtgacgaacgtgggcgggtcaccggcgacggtgatggccggtcggccgccgccgccatcaccagccgcaccgcgcgagaaagaagcccgcccgctcgcgctgatggccacgtgcacggcagcgcggcctctaggaccacaacgacggcaaccagctggcgtcgccgccgccggcgacgtcgagagcccgaacgtggtggcggcagccgcagccgcaaccctcaccggcggcgggagcaccgccatcgctggccgtccgtacgcccgctgttttactcgtctaatcctctacgagacgtggtggtgaaaccacgctgtaactggagtggaggcagtgaaagggtcgagcctcgagtctcgagcgcgcgggggcggcgtctcagccaaccgttttgtggatggagtttcgcggcgccgtgccgcccagccacgtacgataggagaagggccggcccagaaacgacggtgttaccggcccaaatcaggcccggaaaaagtacaccgaaagacctcgagtgaccaaaagcggggtcttg

SEQ ID NO: 68557 - DNA, 1731 bp, Oryza sativa
aaccgttttgtggatggagtttcgcggcgccgtgtgccacccagccacgtacgataggagaagggccggcctagaaaacggcggtgttaccggcccaaatcaggcccggcccggcccataatgatgtacgccacttgcgtgtcgcgtcggtcaccatgacgcaatcacccgtctcggagaagaccagaaataggggacttccatgtgactaataatatatatccatgcttagtagtagtaacatgttaggctcgtataattaaaaattgatatgtatggaatgaaaataaattaataaatattacaggcacatacgaagaagcggatgtcgacctccaatttactgtgagaaggccggcacgaaagaagaacgattgtgcttttaaaaacaaatacttctatacataccagtgaagcactgaagcatacaatccgcatccaactctgccacattcaccgacccaccgtgtttttttttttaattatgctggctcgacaaacaacagctgtgaccgtgcatacttagtcttatgcaggttgtatatttgggtcggatgcatagcaattatttcttttaaatagtagagaaagaaatgaacttctctaacaaagttgtgtaatcattggtaggtgtgcttgttcagttaggtccatgcacgcatgcgaaatgggctatccatcgatcgatcgaatcggctgtgcaaatgggatcctacgtacgctttggcttaacaggccagctagctactgtggagtggagcatcgcttcactaatcactagtgcctgcaatgcatggcgccgttgactatcacggatacgtgggtgattagcaggagcctagctgggttgcagttaggtaagatcggattaccttaattgggaatgtgagcacgtaatttttggatttttgtttctaagcaacatgcatgcttacgcggaccacgtcgatccggttgacctgatgttgctacagctaatttaaatttatatctatgctcacaaatcaaaatttagggccctttgatttaaagaaaattcgtagaaattttagaggatttcattcctatagaaattttttctatatagccctttgaatcaaatgaatgaatcctattgaatccaatgaaattcctatagaatgactcttcccatgtaagttttggagaaaatttaacatgaggtagaacctcatggaaagaatcatttgagtctttatctctctttaaattcctgtgtttttcctgtggcccaatcaaacagtcattcatatgttttttctgtttttttaatcctctattttacacttgcatttctgtcagaatcctatatttttcctattcctccgtttttttcattcctatgatttaaaggggctcttaaagggtgaatagctaatatggtccttgaagtttcgcttcaggctcagtttagtccttaagattttaaatcatccaaataagtccttcaaattaattatttgggttaatatagtccttggaccaacaaaaagtgccaggtgagcatgtcaagtcatcattgcatgcagcggtataaatgaaatgaccattctgcccttatataccatataaaaaagaaaacaaatatttcacatatgtatgatcgttttagaaattatcgcttacaattgctgcagccaagcactgatcgcataaattcctttgtcggccaccctccgcaacaatgttgggtctgggttggcctgttatttt

SEQ ID NO: 68558 - DNA, 2799 bp, Oryza sativa
ggatggtgctggccaacaccgccgccagcggggaggagctcgtggcggacagccacctcctccccgccgtcgcggtggggaagctcgccggcgacaagatacgcgagtacgcctcgcgccgcgccgccggcggcgccggcgcgccgatggcaattctgagcttcggcggcacggttcttggcgtccggccatctcccgtcgtggcggcgttcagctcgcgcggcccgaacaccgtcgtgccggagatcttgaagccggacatgattggccccggggtgaacatcctcgccggctggtccggcgtcgccgggccgacggggctcgtcaaagacggccgccggacacacttcaacatcatctccggtgagcattccattccattccattccacactccatgccaagctaggagtagctctctcacactgctcagattcaaatggttctgaccaccatgtcatgttgctatcaagtttttggagttattttactcatttactgccatcacagtatagacaatccagtgggacaaaagaaaaagagcaagcaaacagagcctctttggatttagattcagccatggatggaccctgtttgcagaaaggcaattttcatttcaactttcttgttggttggatgaaatggcatttgctttcattcactgcctccctttgtcaggggatgcacatgtgatgctcttgcagatgtgaaacaagggaacagcagctgagacaagttacccttttacttttgtttcttttgattgcccgttctgaaagtgataaactagcatgagatggggagacaatagtacatcactggtttctaactttatactaagctggatcttattaaagatgtatagttgcattttcattactagcttgaaacgagagtgttgcatagtaccatataccattgcaattcttgtgcatgtttgttagtcctaatgtttgcttatatatattattgctagcaaatcaggaatacactgttgagctctgtggggataaatttcagtagacagcaaatgggaacattttgatatatgaggcttatcttgtttgtgcctttcaatgcttaaatagtggttgtgtcctatggctatgagataagtaagcatgtaatattgttgatttgcatgttttcatcagccaagatgaaatgctacatttttctcaatgttttgcacgtaacaatgctgacttctatttgatccattcaggtacatcgatgtcgtgccctcacatcagtggagttgcggcactcctgaaggccgcacaccccgaatggagccctgccgcgatcaagtctgctctgatgaccactgcttacaccgtcgacaacacaaactcttctctccgagatgctgctggaggcttgcttgcaaccccattcgccttcggcgcaggccatgtcgacccgcagaaggcgctatctccaggccttctatacgacatctcgactaaggactatgtttccttcctctgctccctgaactacaccacaccacatatccaagtgatcactaagatgtccaacatcacctgcccaagaaaattccggcccggcgacctcaactatccctcgttttcggttgtgttcaagaagaaatcaaagcatgttatgaggttcagaagggaggtaaccaatgtcggcccagcaatgtctgtttacaatgtgaaggtcagtggccctgcatcagtcagtgtgaaggtgacaccagcaaagcttgtgttcaacaaggtagggcagaagcagagatactatgtcatattcgcgtctacggttgacgcaagcaatgcgaaaccagatttcggttggatatcctggatgagcagccagcatgttgttcggagtccgatcgcgtatacatggaagatctgaggggtgaggacagtaagtaaattatattggagatgttgaattattccctggagcagatgaaagatagatagcttgatgatgtagtttgctgattgcttcacaaagagaatcggcgtgaagctctctctactgcaaacctggagttctttcttcgcagtgtcggttactcgccgaacttctttttccccccttgtagttgtcagtgcggttgcccgtcaagaaacttatgtgctattaacatgtgagatttccttttctttttctttctctagtttcatgttctcagacatgaaataaccctgaaatgaatcggttgttttatggcaatgatcagctcacatcagctattgttttatcaatgttctgattctgatcctcctgagttaactgaagaattgaaatggctgtttcattggcaatgtgttctcttcttttacatgtatccagaaattttagctttgtgcataagtaggaaccaatttcagcaggaaaggaaaggggaacagagatcagttcagggatctggtgaagctgagtctcacagacaatgaactgtaaagtgatggccaaaaagaaatcaaatgatctgaattctttccgccgaccgtgcgtgtgcatccgtaacgcacgcgcgttcgctttcacgcgctggcgcctgtgtacatgattggtcgccctgcctgtttagtgtttactagtagtagggtagtactggaggactttacataacacccacgagagactggcccaagttttggcccagtgcagccgaagcatgaaaagaataagttcactttcactcccttcaaagtgacccaaatctaattcgtatccctcaaccgcaaaaccagatatcttgacccttaaactgttaaaactggtgcaattttactctcttggcggtaatgaaggg

SEQ ID NO: 68559 - DNA, 891 bp, Oryza sativa
tcccccctcccccccttttttagagtctaccctagcttccgcgagcgcacggtgccgccgtgcgctcacgggagccagtgtgacggcgccacatacactaaggaggttgtcaccgtcatcgttcaaatgctgtggcgaggagttgctcgagagatgaagggtaaggaattaccctcactgacatttgagcctcataatttcttaaaaaaaaaatcttctaataaaattgccaagcaaaagacatgtcaacaccagtagaccaagtcaatgtgacaaaattgccagcaaaattgctagggggatttacactaatttttataatttttatagttggggaaagttctatacccgaatttgcgaaggacacgaatgaaactcgacctgttaatgagggatctaaagttaactttttccctattcttaagcaaacccaaccagtgtgaactatgaagtgtcttgcatctaaacattactactatttttgtagtgtctggcatcaaagcaagtgacgtatgctcctgttgggctgacgcgtggttgaggtaattttagaaagctctatagtttaacgaatttcacgaatccacgtatatatcggagaacttaattaggctattttttatttttttaaaataatgagaatttataaaacccggcttctacaccaacgtggcaataacattctgaaccgtaatttgaatagtaaccatgattctaattctatccctactttttcaggtttatctgggaacatgccgtgaacacaattcaggatataacgaaaacacgtctttccgtgaacaactataataaacacgtgctagttgattattattatctgattttattggaagcacctataaatcgggcgcccgattgtttttaaaaatc

SEQ ID NO: 68560 - DNA, 12272 bp, Oryza sativa
ctaccaatgttgcggggcagttcagatatatctgtgtaccttagctccaagtatctcaaatgtttaaggtgacacaaggagtcctgcaatatagaaaaattggaactccttacatgtattgtccgtagagatggaagaattctcaaggaatcgccaggtttcaacttgatgtttccgaacaatatcaatgttcttagacaatgctgattctgtaaattgctccactctatttgctctgctgatatagataaccgacgaaattttgatgaagagagaattccattgttttgtgggtcccgaagcaccagtgcttcatccctggcaacatgctgagcaaaggagtgtacaacatcatgcatgatacaatgttcttcattgtagtagtcattctgaggttctaaaagattcctcttgattaactccttgtagtaatctagaccagctgactgtgcggaatatccatctttaccaatgaatccttcagctatccacatggaaacaattttgtcaataccaatgatttcatctttaggaaatagtgagtaatacacaaagcactgtttcaagttatggctcagatcttcatagctcaggtatattgccttgtttagttcttcaggaagtcccatttttgaccatatctgattgcgtaaaacctcttcccaagcattttttgttgcatttttgttgcatttttcttgcataagacaactcctattactttaattgccagtggtaaaccatcacatttttctgcaattttcatcccacattcttgtactatctcgatctctgatacactcaaggcagcctagacaaacaaaaacgtataatatgagcaaaatagaaccataacttgaaacattattgtgtaaaataattgtgcttatttccttgtctacattattgtgtaaaatttgagttacagagagccttaatgtgcttactcacttttctcatgatgagaaacagttatagaagttccttaattaatcaacaattccacattctagagtaaaataaaaggcacaatttgttaaaagaaatataagccagacttgtaacagtgccgtggtgacttttgatttttgataatttgccaaggggaaactactttatttcataggtgctgctgaaatcacatatctgagatgttcaacaagccaccaatcaaggatatatgcatcgaaggcaccattcagtcaactattttggccatccaaaagaacactatatacttatgtaccttgtgtaaccatgccaccacctatcctgccagccatgttggcgatatgcccatagaggcagtcaatctatcacgaatcatatttatgaatctcttccaattatttatactgatctgtgagtatgacttatttgtaaactatttatatatcaagatgctatttctaaatcatctctgatgatcgtgtttcatggaagatagatatggatatatcatatcaatcagacaataatataagcatgcttcgagaacataagttagatcgatccaccatgactccatgagatatttaccgagattaatttagttgtaagtgttattaatttgaatctagtttctatggttaacatttaggataaattccaaattacctccaaactattgtggtagtccgatttattcagtccagccacactacagcagctagatcacaagtaaccccttctcaggatgtgtatggttttggagacatcaggtgcaattttgggctacaacaataattgctattcattcgattctatacccttggcaaaactgactgacatatagaactcaatgttatatcagagctaaaaggtcaatagttcgaatctaacctgcaacagcattacagaaagtgttgaagtgctcataatatgttaagaatttcaatggttactctcattgagaagaggatggcactcgagatggggcaattttctggttttcttcattcacaaaacacaaagccatatcctcccaaagaggattgggtacatatttatagctgcttgtagcagccatgctagggcaatagggtgctgtcctagagcatcccaacaaactgtcctagagcatcccaacaaaatgtcctagagcatctcaacaaactgctgtcctagttgtcctagagcatccaaactgaaagtagagatgctgtcctagaaagctaaaaagcaagaaaaagcaccacaagaccaagaccaaccagccaagacttattcctacactctccccctaagtcttgtgcgtcgtcttgtgggaaagttgagccatcccgatccgggagcaaagctcaaggaacttgatccttccaaggggcttggtgagcaaatccgcaagctggtccttggtgttgatatagctcgccttgatgctcccttcctccaagtagcttcggatgaagtggtacctcacccggatgtgcttgctccgttcgtgaaaaacggggttctttgccagggccagagcggacttgccatccaccctaagctccaccgctccagtatctctgccgaggagatcactaagcagtcgagcaagccagagcgcctaggtcgaagcggcggaggccgccatgtactcggcctcgcaactagacagggccaccacctgctgcttgactgactgccagctaacaaggcactcgccaaggaagaagagaatcccgctcgtgctcttgctggtgtcgatgtcgccggcgtggtcgctgtacccgacgaagtgtgccttgccaggacaccttgggtagtagagaccgtggtcgagagtccccgcaacgtagcagatgatcctcttcacagcctgctggtgctccgttgtcggtcgctgcatgaaccgactgacgtagccgacggagaaggccaagtccggccgtgtgtgggtgaggtagcgaaggctccccacaagacgccggtactgtgtagcatccacttcctccgtcgtgctatcgcggctcagcttcagtctctccatcggagtgagagctgggttgcaatcggtgagcccagccagctcaacgacgcgcttggcgtatgcggtctgtcgaagcgtgatcccggagtcatcctggtacacctcaattcccaggtagaaagagagaggccccagatcactcatctggaaggtggccttcatctactccttgaacgccgcgacctccgcattcttggtgccggtgatcaagtcgtcgacgtagacacccaccagcaaggcatttcctccattaccccgctggtagatggccgcctcgtgcgggctttgctcgaagcccatccccttgagcgtggaatccaacttggcattccacgccctcggtgcctgccgcaagccgtagagggccttgtgcaagcgtagcacattgccctccttgccggggatcacaaatcccggtggctggtgtacgtagacctccttcaagtcgccgttcagaaacgccgatttgacgtccatgtgatggacgccccagccttcctgagcagccagcgcaaggagtcgcacggactccatccgtgcgacgggagcgaaggcatcgtcgtagtcgatcccctcctgttgcacgaaaccgcgtgccaccaagcgagccttgtgcttgacgatggctccggcttcatccctcttcagcttgaacacccatttaagggtgatcgcgcggtgaccacgagggaggttagcaagctcccaggtgcagttctcctgaaccgcgtccatctccgactgcatcacggcaagccacgcggcgtgtttctcggcctctgcaaaagaccgaggctcaccgtcgtcgcacgcaaggtgcaactgcgcctccaggtcgcggggcaccagtctcggcaccggctggtcgccgagaaggtcctccatcgtacggtaccggagctgctcgccgtcgtggtacgcgtcgatgcgctccccgtcgtggagagcggagtagctaactccaccgggctgcgctcaacacgagctggcgtcggagtagacatgcccaggggagtggctgttggtgctggagtgcgtggggtcgccggctgtggtggtgctggcgaagaagtcgtcgcagccgaagtcgaagctcgagaatgtgtcgctgccggagttggtggaggctcggggactggggtaggcacgctcggtgaggaagagctgcctactcccccagctccctcgaagtggacgtactcgacagtgaagtcgtacgtcagagtcgaaccatcgtccaccgccttgtcccatacccaccctcgcccttcgtcgaacactacgtcgcgcgccgtgcgcacacgctgtgtctccgggtcgagaatgcggtaggtcttcgagccctccgcgtagccgatgaacacccctggggtgctcctatcgtcgagcttgccgatgtggccaagctccttggcgaacgcgaggcagccgaagacccgcaggtgggagaccgccggcttgcgcccatgccaggcctcatacggtgtcctgccgtctagggccttcgtgggcgagcggttgaggatgtagacggccgttaccaccgcctctccccagaagatggccggcatccccctctacttgaggagagcccgagccatccccacaaccgtctggttgcgccgctcgacgacgccgttctgctgcgagctgtacggcgcggtgtagtggcgctgaatgccctcatcagcgcagtacgacacgaattcagccgccatgaattcgccgccgttgtcggtgcgcagcacgcacagcttgcggccgcactccacctctgcagcagcctacgcgcgcctgatggcgtccgcagcttctcccttgctgccgaggaccatcacccacatgtagcgggagaggtcgtcgacgagcagtaggaagtaacgtcgtcctcctggtgtggccggtgtcactaggccacacaagtccccgtgcacgagctcgagccgctccttggctcggaagctcgtctgctggggcaaggggagccgcctctgcttcgtcaccacgcaaacgtcgcagagctgctccacgtggtcaaggcatggcaggcctcgcaccatctccttggcgctgagctgcttcagggcctcaaagtggaggtgcccgaaacgctcgtgccactgccacgcctcgtcgtcccgacgagcggcgagcaaactggttgtgcgacctgcgcgctgaggatgtagagtcgattagtgcttctggttaccttggcaagaaggcgacggcggcgatcccaaatcctcatgactccgtgcttgaccaacacgtgtgagccgttctcatccagctgccccacgctgatgatagagttccttaacgcggggatgtagtagactccggtgagcagcctgtgcttaccggacttggcgatgaaggtgacggagccaacgcccttgatctccacgccggaggcgtccccaaacttgatggagcctcggacgctggggtcaagctcggtgaagaactcccgtcggccggtcatgtgatgggtggcaccggtgtcgaggtaccacccatcagccttgtcattgctggagctgttgcagagggagacgagcaccttcggctcatcaaggtggaggaaagccgctgtggccggtgtcgctgggggtagctcgatgcttgcgtatgccaggagcagagccggctcttcctcctctacctgtgcgacgtgggcctggccatgtcgtggctgtcgacagtctttggcccaatggccaagcttgccacagttgcggcaggtgtcgtctcgtgccggcttgtggttgccggcggcgccgccctgggcgcctctgcgagcgccaccctcggcgcgtcttcgcgcccaccgcagctggacacctccacacgccttgcgcggcttgcggccgcctgtcgagggagaagactcccccttcatcccgtcaccttgagaggcctcccactgctcccgagtgaaatggagcttcccgccaatggtgataggccccgagaggggctgtggctcatcaccgtcgacgaccttgaggcgacctaacgcctcctcgatcgacatcgtggagaggtccagcagagactcgatcgagcgagcgatctgcctgtacttctctgggacgcagcggaagagcatctcgacagctctctcctcgtcgtaggtgtcgtcaccgtactgcaccatcttctgcaaaagagtgttgagacggagggcaaagtcatcaacatcctcacctggcttgaaggccaggttctcccactccttgcggagtgcctgcagtgtggacttgcgggcgcggtcgctgccgatgcgtgccgcaacgatggcgtcccaggcctccttggcagtccgcttctgggaaagcgagaactgcatctcgggcaagactgcagcgatgagggcatccagtgcccgccgatcctcgtcgtagtcgacgtcgccgtaccggactgcctcccacatgtgctgcacctggagcctcaccctcatcatcgcggcccactcaatgtagttggttttggtgagggtaggccacccacagccgggaccaaagtccctgaccaccgtctggacgccgtggtggccatggcgtcggtcaggggagggagagccgcgctgcctgcgaagccgcgcgtgggctccgggctgctgccggcacgcccgcgcccgtctgggttcccatcggcgggcgcgcggtcccttgggccgccgccgtggaggtgggctgctgcccaccgctctgcccgctcccgtacccttcctcttgccagctcctcaagctccctgtcggcggtgctgtcgccggtgatggaaccgttgatgctactgcgcaaggtttcaacctctacctccgccacacgtgccgcatcttccgccgcctctgcttccgcctccgccctggctgctgccaactccattgccgccagtctggccgccctcgctgctgctgcagcggtctaagccgttgctcgcctgcgctcttctactgcggcgagctcggcgtcctgctgacgccgagtgctcgaggcgaccgaacgccgagaccgaacgtcggacatggcgcaccttcggggggctgctgcctggagagggggaagggaacggggaaggaggagcagccagtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcacaaaacacaaagccatatcctcccaaagaggattgggtacatatttatagctgcttgtagcagccatgctagggcaatagggtgctgtcctagagcatcccaacaaactgtcctagagcatctcaacaaactgctgtcctagctgtcctagagcatccaaactgaaagtagagatgctgtcctagaaagctaaaaagcaagaaaaagcaccacaagaccaagaccaaccagccaagacttattcctacataattggaaagcattcaagtgtgagtttttttcctcgaaaacagcattgaaatatgaggaaaattgagtttttggtgaactggcttgtgtatataattcaataaattttttcctcatggaaattgaatcccaaattaagagaaacctaaagagtgaaacctgtgcagtactattaatctgccccgtggtagtaaatatagtgtaagtattatctatatattaatatagcacagtaagaggctctcctgctgttttaagtaaaaaaatggattacacgattctttctgtgcgttgaagacaaaaattgggacgaatttttcagaagttctcatggaaccacctttaccacctatgtccggtaatatctgtaaaacgtgcagaggtaatcttactagttttattgattacgtacactgcttgactttgatgaagccggattgactacaaaaggaatgtgacacagaaacatttataaaacaggagtcatactgaccaagcttgattagaaaagaagtacctagctaaccatgatattcttttcttgtgtgtgcagagctaaccatgatattgaatgagctagctatcaagcagagtcatataattaatagatctgctgccctaacctgtttctggagcaatgtccaggaatcatcgagtcttagtttggtgacttggtgcgtgtgagcagctttcatcactttagcaacatcttcatttcttgtggttacaaggacacaagtccctggagcacaggctttggtgattgggactctgagcccattgtcccatgccttctcagtccacatgtcgtccattaccagcaacagcatcttacctctcagggcttccaccagggcatcctcaagcagggccatgtcttcaacggcagggatttgttgcttatctgactttgccatggcaatggcggttttgagaagatgagcctcattgaagtcctgagtgacactcaaccatatctttacatcaaaggtgtcttgaatcgcctgatcatggaagatcttcttggcaagggtggtcttgccgatcccaccgacgccttggatggcaaccaccagatacttcttgtcatggttgatgagccagtccaccagcatcctcttatcttcttcaatcttgtcaccgacgatgtcttcgtggatgatcccgggggctgtcctcctagggttgccactatgagggttgccaggggttgagctggatttgagtcggtcagtgtcagcctgctggtcagcttcagcctgcttgaagaggccatccatcctctcattgagctccttcactcggcttccgatcctgtgggcgaagaggggatcctgcaagcaccagagcaaggaggagttggagcagctgcctggatacggagacgcataccgctcgcgccgctgctccgacttgagatgaacgtcatcgacgatgtcggtggcgtcgtacatggcatccttgagcttcctcacccactcatgcacatattctccttccttggcatcggtgatgtgccgcctctccgcgttggccaggaacttcttgagcctgctcagcatgcctgtcagcttctcgacctcgccagaagcgccaagcagcatccctgcctcgtctttcaccatcttggcgaactgctcgccgaggtaggatgcaagggcatccaggatcatctccatgatgtatgtcagcttgctcttctctcagatttttcttgctttcagcttttcagggtggctctgctggtaactagcagtgtttaatgttggcttcttacatcggtcagctccgttgatgtatgttatgggattatcgcagcaaaagcagccaccgtgcacttggagcgatgtcttccttgaaactagagcatggaaccgatgcctgtcctgcccagctaccttgccacaacatcaatcctcaggaatataggcacacactctctccgacatgcactcaaccactcttcttttgctttggttattctgtacaaaaagaaaaggttatcttcgtgtgaaaagcatcaaaaacaagaataacataaagattcactaatcaaagggaaaaggtggaaaagggttattgtgcttatcttcgtgcgatcacacatcggtttctcgtctgtaaacgggttataccatagtagaaagttgtatctgtagtattattttcctttagtacactgatactagattatggggatttcatttagaaaaggaaagcatccggcttctacaccaaagcacacacgaccaaaaaaacaatcacacagtggaagaaggaaaatgtagtagtagggtaacttcttttaattgcactggattaaaactactaaataactggcctgcttgggataaactggaaaattttaacccttaataaacttaccactgcaattgttggttaccaaaggtaacagtgaaatgaaaatcaaacccccttgtatacatgctgtttgggagaagaacatcaacaaaggtcttaataactctgtggttgcatcaagccatgaacattgcattatccatcataaatatgcagtgcacattaagttgaaactatacagctataaataaatatactagcatcaagaatcagaggaacaatctaatagttcaagaccgaaaaaacaaatggaacaggactattgatttgggggaaggggatcatcagaaggtggatcgaatctgagcgacgccagcgacgagggcgaggtgaggtgatgcgagcgaagccaagccaccacaccgacggtgaatggaggctgagaagacgcggatcgggggcgggcaacccgggaggatcagttcgccggagttgcgcatcgcggccggcgatggcgagggggggagaaggccggagagcgaggtcgccgccgactcgccggtggctgcgcacgtggcagggctggtcttgggcaatgcggcgagacgaggaggcgaaaaggcttttacggcccatccaagcgcagatcttttttaccgaataaagtttattttacctccctcaactataactggagtttgattttgctctccctgaccatagacctgtttagggagctttaaattctaagaagcagttgtttgataaccagcttctgagaaactggaaaagctctaaaacccagcttctccagcttctagtttcttggtttatttttcagaatctgtaactacagattctcagaagctgtggactgtttggggcaacttctagcagaaacagcttttgggaaaagctgcagctgggaaaagctccccaaacagggcccatatatgcctcagctattaaaatcagcgtaaatcaacttctcaaatattttcagaatggtttttggctgaagtgatgcgttgaccaggtccacagtgttggcttatcgatctacgtggcatttagctagcaaaagaaaaaaaaacttgtggggctcacgtgtcatgcaccaccactttctcccccaactgcttgactgcttgcgcacggtgctaaatctagagtgaagtttgaggaattggtgtgctcaatcagagttagggcatcgccagcgccatagaaaaggagtagcctcactagaattggaggagaaggcctagaaaccatattagttctgacgatcaaaacctatcaagatacaaaagtaaaacccgttaggaaaattgttccttatatgtcaatgtcatggaaattccatcaggactatctgcaaggatgggctgcagctcaagatctggacatagatcatgtccataggggctgcagctacagatcgatgcatggacgacctctaatccaccattaagagtaatccctacttagtggagggctacagaatataggagattcgagggaaaagacgattcgaaggaattgtaatatgggaaaggggaagaggaagaagctaaaggggatgagaagagaagctagcttggtgacaggttttgtgtccatccattttctcatgatgttataagctcgtcatggaaaattgaattttgctgataggaaactgtgtacatgtaaaattaatggttgttggggttagtccctttttttttgttaattttgttgtttgcaacgttatcattgctaaatttcaagaaaataattttccttgaaatccatctgattgacagaattaattaggagatgtggcttcttctcagccgtagaaaaaaatatatagtagagatttagctaaatctaccgcttcaactccactggatccaaacccattacggtcttacggagctcttctctctctactttcccccatactaaaaactaacttttgacaaacttgaaacaatttcttctgctaaattacttatccaatccaccaaccaattataccattatattctttgcattaaatatctataacaagatcttactcgaatatattttgctgaaaaaatatgtccgttgtttcatcagttgaaaaaaaattatttcagatcactacataattaagagagaagtaacatataaagtatacttactgtaacatcagcaccattgtttctaacattgaatctcaattggtgaaacatatgaaaaaataatacaaataatacaatatatttgcaaaaatgtaatattgttgaaacattttttatcacataaaaactttaaattgtaactgttgaaacattatattcaacattataaaatacctgatgaaacattcaaaagaacaccacgtgaaatatttgcgaattaagtagtgaaacatcatatgaatacttgttgaaacattaaataactcctct

SEQ ID NO: 68561 - DNA, 2245 bp, Oryza sativa
gtcgcctcccatatacaaccctctaaagctggcgaactcccccctcttcccccttcccctcccaccctatcccaacctgagaccctaactcgtagggtcctctgcgggagtctacggtgttaccggcaccggagaagaaaagcagatcatcgaagttggagaagacctggagcacgaatcatgaaactcatccggtggtataagatctgcaagatttgaagatggttttatgtgggcagaagattagctattcccttttttattcctaagattacatatggattcgtgcctaaaaacaacaactttatcctttccctttcttcttctcatcctgcgatctagacgcgtgaatgagtttagctggaccctgagattattgtcttaagaataactgttcacatgttaactttatgtttactttatacttagactagaaaaaatacccatgcattgcaacggatgaaggctattgtaatcgtattattgttagatattttatatgggatttttattttgatagtattgatatctaattcggaatccttattgagatgacgatcatatcttgtacattgctttcttatggcctggcgagaattctgaagtaattaggagtccgactattaaaataagttagcatgtgagatttttaagatgatttcttatacgactccttatgtatttttcaaaagcgaacgaacttaaaaactgactcaaatacggatgatgtaccaaagtaagtatcagtggaaacatctttaatttttataatagtagaaatagagataccaataccaaaagtgaaaaggaggcaaaaagaaaggagattggaaggagagggtaaggattagaacgaccgagagaaaagaaaaggagaaaaagaaaatagagcaaaaaaatgtcgggagaggcacgtgcgctttgagtggagacgcgcacgatggtgtgagccgattaggttgggttgggttgggagggaggtgtataatagttattttaaactcatgtcgaattgggtacgggagacgtaaaaccaactaaaaaccactcaaacacataccaaaatttcagcgaaaatattttttatttttataatagtagagatacaaacatttaaatcctaatcgaaatcttaatacgaatcataatcaaatgcataaactttcggtgggttaaattaacagaaaactaaaagtgtgtggtgaaaataaaaggagcacgacgagcgtgttacaaataaaatccgaaaatccttctatccaggcgaccgatcgagtaagaaaaaatcgggtgcttctcctctctctctctctcatctctgacgcgcctcctctccccgtgctctctctcgcccctcctctctctctctggtggagcggcggcagccaacagaggcctctcctcaccggcggtggtggcggcagcggtggaggggttaggcggcagcttccgtctggcttcgtccccccgcacggcgtccatctgttgcagctggctccggaggcaatagccacctcatcgctggccactctagggtttcgaggaggctgtttccgcttcgatttcgccctgcgtgtgacgcccctctggtgcagtcgacggcgaaggcagtggcggcaccggcaaaccgaggagacttcgcgcagcgtcgacgacggcgaccgagctccgtgcggcgtcgacgacggcggatacgcaaatgtggccgagctccgtggtgtcgacaacagtggctatgtagatgtggtggagctcggcgcggcgtcgatgcggatgtggttgctaatcaccagagtggaggaagaggtagatctaggttttcctcttaatttttttaatgtttcagtccatgtaccgtgatgtttcatcggttagatttgaaacgttgtagtgggttttcgatggtgtttcatccttttcttggatatacttggattcttttcatattttagtacattcggaaccgttgttttatacgttgtagtaaaatgtttcattgtgtgatttgattgtgtttcaccattttcagcactaaacattttcaattcgatggagtttcattcttttcctcaatgtactcggatttgtttcatgttttaatatattcgaaactgttgtttcatacgttgtagcaaaatgtttcatgatgtgatttgattatgtttcagctttttaaaagattgaaacattttttatctacttggtaaaatattttcgatctacttagtgaaatagtacccgattt

SEQ ID NO: 68562 - DNA, 2900 bp, Oryza sativa
ggagttgtcagcacgtcctcggccgtcacgtggttcacccgaccccgaatgacatccttcccaccgttgttagagcggggaggcgcttggccttgctgacgcctcggctttgggcatttatccgcaaagtgcccgggctcgaagcagttgaagcacagacgctgtggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtctaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccgtcacggagcggttgccttgcttcaactcccggaattcccttttcttaagggccatgactccggcgggcacatgggttctccggaaagcggcggtgaaacgggcccaagtaataggttgcccctcgggctgcgtagcctggaaatggtcccaccatagagatgcgggcccctgcagctggtgggcggcgaagatgactttctcctcatcgctgcactgcacagtgtctagctttttccccacggcatgcaaccaatccaatgcatccacggggttgttggagctagagaaggtaggtgggcggatgcggaggaactcggcgagtttagagtgttggggaggtggtggtggagcattatgttgtggcggattttggaggtggtggaggaaagcagtcatcatgttggcctgctgggcgaggatttgggtgagaatggcgttggtgtctggtggtggtggtggaggcggaggaggaggtggaggtgggctgccctggttgtggtggttgctgccttcaggttggttgccatcaccggtggcagcacttctcctggtcgtcaccatctgaaaaccccacacagaaccagcaaacagagagagctgacaattaaagctaaccatccacgactaccataattcttgaatttattactgctattaaattggttcattaaagttcaagttgcttaggcaaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcaatagcgcatcctccgtgctaccaacgccggaggcttcctcctcctggggaaccatgggcgcgggctcggcacgaggggtctcgacgaagcaagtccacgccagggactgacgaaaaagctcgggcctagaggtgctcttgcgggcggtgatcttctggctgcggcagacgcggcgacgcttggggcggcagacctctccctgggcgatcttgagctgatgcagctgcgcctccaccgcgtctaggtccttcttgagctgcaggttctcttgacacagctccaggatcttcatgttgttctcgaccatcccagggtgcaccatctgatggaagtcgatacgagccgcgtcgtacgcctccaccatgcgcgccaggtgcatgatggtagcgtcatcctccgagctagcatcccggaaggtggcgtagtcgcgggctcctccacggcgagggtggtagcggtagggcgagtgctgcaactcgtccgggtagcgctggtgaagagtgccgatggcgaggagagcggcgctctggcaagcggcggggaaagaatctccacccgcggtgactgccagcgaagtccgctcgggagagccagcgaggatcactgcagtgacctcccaagcagcgtggggctctgcatcgtcaccctcctgctccggaagcggcctgccctggtagtccactccatgtggataccccaggacaacgcacatgccccgcagctccaagacgaaaccaatcatgtccaaaccacgacgggtgacgctgccggccatctaccaacaaaaacaaaaagaaaagcaacatttaaaaaggtcagattttggcgataaatgaagcagcaagacagagaaagactagagggttttcacaaataacagaggatttttatttcgaaaatactgctaaggcttgggatctacggctcgtcctagggtcaagggggttctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagataaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgcaaacacgattctagtactatacaatattatttatcaaggccgtgaac

SEQ ID NO: 68563 - DNA, 14981 bp, Oryza sativa
ttacactcacggaggcacaatgacaataggcccaccggccactcattctgtcatccaccgccactcatgttttcaaccagctagatgttacttacacctcaatttggccactatgttctgcaaactttgatggttcgtttaatttacctcttggcccttaatcttaacataaatcgtctaagttgaaaacaaagatcgtctagccatttctctgtgactaccagcggaagacatgacaagagagcaaaaatgtaggttagacaaggacctgcagagatattggggacagaacgtgctgagagctttctcctgtcagttcatcacttgtgatgcatgcactgaactctttaattagaagctaataatgtcagcaaggttgggtcttaattctaaaaataaaagaaaatcagaggaaaaaaaataacgtcagtacaaggtacaagttcaaagaactgcatgtgctccagtattaattattcctttgtatgattcattaagattgtacgacagagggaggacaccatcgttgtattgcacaggaggaagtggagactggaaagtaggagagccatgcatatatggcaatttggaaaccctggagctcagctcgcagcctcaccgtgtgacctcatgatgcttatcatactggtcatgtatacttaattaagctccaattattacgaaactgatctaatgcatgcaacccttatcccccaccctaataaacatattaaagcctgagattagcagccttaagaaatactgctgcaacagccacatgagtccaaagaggtgacaaaaaaaaaactaactccaattccataaagtgagataccatttcggcatttcccaatatggcaagctgcaaatctttgtagagaagaggcgtataaaatactcaccagcgagcgaatcgagctgcgtctccaccctgctgaagaactccgcggcttccaggatcggccgctccagctcctccctgtacctcgtcagcatgctgcagtacgcgtcctgtgatgacaagatcagatcccatgtcgatcgatcagaagaacagtggatatatatgtgtgtgtgtctgtctatatatatgcacgcatgcgagcaaaggagttgatgatctatatatgttgataccatgaactgatcgagctgatccgggtcgtcatcacgctgtggctcgtgccggcgacgagggtggccgtcggcttcgtccagctgctgcgccgccggcacagccgtgagcttggtcagtacatccggcggcgccccgacctgataaaaaaaccaacaaaatcaacttggtcagtacatccggcacggccgtgagcttggtcagcacatggcgtgttgtcgtctgtatctgcatgggtttaaatatatgcatctgctagcttagctactacacctttttgcagcctaagtaggcggctaggagagccgagtactgtggatgcgacatgatctcggccttgaccgccgcctccgcgcctgccggcgagacctgtccctgcacagctgctgctgctgcttcgccgccaccgccgccgtggtgatgcccatcatgcccatgctgccgcgccgacgactccgggccggcgagcagctggtacagcaacgggggcggcgagatgtggtccgggttctccggcgagatcagctccggcaaccgagctgtggtgctgctgctgccacctcctgcgagactggcgaagctctccatggccgacaggacaggtgaggtgaagaagaggcgatagatagtagttatggcaaacaaaccctagcaaagaaaaggaggagatgatctcctgaaatgaggtggtggtggttgagatggatggatgcagggaatgtgaagaggagaggaagctagaaagaagatgaatatgatggtactcctcctagtatacgtatggcccatcttagctttgttctaacgtcaaaatcagagcgagaaattaatgaagaggttaggctattcagtgtttgcaagcagcagcagcagcagcaacagtgaaactactgcaaaacacatgagaaaggagggaataattatactcctgggctaaagcgtagacagagcaatgacggcgaataaaaacagacggggggaaaaaggatctggacaacgtaacagcggcaggcgcagctgatacacatggcacatgcacctctcgtgtgggatgtttcctctcttctcttctcattcgaatactgttcgttttcagacagaaaacagagatattcatatgctggccagtattacgccgcagctcctttcgtctccaggtcgatcggcatgaagcagcagcagtactaagtactactacctccgtcccaaaataagtgcagttgtggatatccgtgcccaacgtttgaccgttcgtcttatttgaaaattttgtgaaaaatttaaaaatatttagtcacacataaagtactatttatgttttatcatctaatagtaataaaaatactaataaaaaaatttcaaataagacgaacggttaatacaaaactgcacttattttgggatggagggagggagttcgtatagcagcgtttgcagtacaaggcgtctcatgaacagcaacaggacagtggacgggacgtacgagagagctacagtctacagcagttgtgtgttagttccatgcgttgagcggtcgaggtccttaacttcttttcactaagatggaaagattctgggaaaagtaatgtgatggaactgtgcatcgatgtggccactctatattctatatagctagagatatctcctaacctcagatatcatatcagaaattcatctgtttagtactacctagtacatcgtcgttgtgctaatagcatcagatatatcagaagtacagtatacttacagtcatcgagacctcgagtagttagctccgatccttcctacgagctccggactgtgtgtgcgaagatcccgtgttttaagctcgtcctgtcaaatccacgtcgaaggatgcacaagtatacggatagttagtttccgctaattaggcagccacagacactccgccaggcatagcgcgcggcacagcacgtgggcgtgtttagagctataataactgcccatcttccagactctagagtaaacggaaacagtagcacaaacaggaaaatcttattaaaaaatagtgtaaatatgaacaatataagtcatgttttaaagttttttttaagttatagaacaaatcgcaataaaataaatgatatttattttgtgaataatacaaataaccagaaattataccaaaaatcaatgacatcgtttattaaaaaaagggagtattttgaaggttacaaaatgtaattttaccatacctctaagggggctgcaatacaacggaatcccgttgggacgggatgataccagttaggtatcaggtcctgatacctctgaggtatcatgtcctgatacctaacctttatcagacgatacttccgaggtatcaggtgatacctataagatatcaggcgattcctatcatgtatcatgtgatacttgcgaagtatcaggtgaaacctgtcaggtatcaggcgattcctaccatgtattaggtgatacttgcaaggtatcaggagccaggcactaaaagcgtcgtcgtcggtgatcccactgtccacgtattgtgccggagcttgtcgccggcggcggcatcctccacgatccacgccggagatcgtcgccggtgatcccaccgtccacgtctcgtgccagagcttgtcgccggcagcggcatcctccacggtccacgccggagatcgtcgccggcgcagccacatcctccgccatccacgttccacgtcggagctcgtcgccggtggccgcgtcctcctccgccacgccccacgccgggctcatcgttagcggccgcgtcctccaccatccatgcctcatgccggagctcgtcgccgaggccgcgtcctccaccgtccacatccccacatcatcatcaagcgttcgcatcggcgcggtcacaggcggtagcgacgagcaggcaatgaccgcgaccatgaagctatcatcagcagcagtgacgcacgcggaaaagacatggctcaaggagatagtgcaggaggaggcgataccgtcccacgcgctcgggacggtatatcccgtggtatagcatttcaacacctctaaacaccttaataaaggataaaaatgagtattgcatcaatgaatataaaggaatgtgtttatttaatttcagacttttgaaattgcattatacacgctattaattactacattcataaatatgacttttaaaataagatttttttggttaaactttcaaaacgttcaccatcaataacattttcaaataatccatttatataaagatagcaaaaaaaaggctacaccatgttttctctataggtagaaactttcacattaatcgaagaaaaagggtaaggcattacagtctatctaaattataatagcgtagattaattgatatagttgtatagaaaatatgattgtatttattaatacacttttattctatgtcaaaattattttcataaaaagaatgatggttaaagtttgacctaatcttagactaaatcaaatgagcggataggtagtgaatatactaattaaatagaaatacaatggacgcagacgcacgtctatttctaataaacctttatcctgggaacccatttctgatggaaattaaacgccacaggccacatgcatcatcgaacgtcgctattttgcatagccgccacagtcatcggataggtgatttaatcaccgagttgttttttgttgaaaagctgctcacataacgtctgtgcaggtggccttgtaaaatcaaatcagcgtacaagtattacctgagatatcttttggatattattggtagtagaatgtaattaatcaaagaatcttatctttaaaagtaaagatgggacaggaagacttgtcaccaatcatatcattttgagtacccatagactcagggtggatggatgcatggatgctcagttggctcactattttgctagtacacatctgtacatgcacggtgcaagttatatactcctatgctttacagtaagcttctaatttttaaatccaagagacattgctgagtacttgaacttacctcactgtttgcatacataaatattgcacctatctgttttgttctgcatgtagctagtttcttctgtattaaccaataaatactattttaccatgaagaaaacggtagaagaatcacaagaagaaaggaagcaacaactggaagagattgaaattttaaagaagtcaccaaaggagacaaatggccttcgtcgtttaattggcctcaatactccctcttttggtcagcctcagtaaggtttgtctatcctctaaatgtccccatgctgattcatgttaagatgactagttttgtggttggtgtgatctggacatgtgactttgttttggttagtgaatgtaaacgactatttggacatgtgacgtcattttggtcactagcgatggctggatttggtcgatgatgatatgcgcaatgtactgatgttgtatcgatgtaattgaacctgttttggtcaatgaacttgtgatgtttgtgttggctaatgaatctgtgcttatattagaacatgtgactgaatttggtcgttaattgggctataagatttgagatttcctggatgttagttgggttgtgtattggatgataattgggctaaaaattggctgataaggtggctgaatacgtgattgtataatgcttgggcctatgtgggcctttcgaattttctgggcccactcattagttgattccaatgcaaatgcatataaatacaagtgggatgaaaatattgtgtaatttgatgcgttttagatgggccaggcctaaatctaatcgggcttgtaactaggcatgacccataaacatgtggaaaaagtatacttcgactccctcaactatgacccgagtatgattcatgacctccaaccacaaaaccgggcatatcgactcctccaaccatcaaaaccagtgcaaactatgcccctgggtggttttggaggcggtttaggctgacgtggcgaccacgtggtggtgttgaccggtcttcgtccagcgtgtcgtcgacgtgtcgcttatctggcacaagagtaaacaaaaaaaacaaaaaattatgggaccgacatgtcattcacacaaaaaaaaaatagtgggccccacatgtcatcttttccacatgtgagctcccggccgtccgcatgctaggggaagagcttgccgtccgcgcgacggtggtggagctcccggccgtccgcacgccgggggaggagctcgtcagcgtccgcgcgcgggggaggagcaaccagccatccgcgcgccgggggaggagctcgccggcgtacgcgcgcgggaaggtgcaatcggccgtccgcacgccgggggaggagctcgccggtgtccacgcgcgggggaggagctctcggccctccgcgcgccaagggaggagctcgccggcgtccgcgtgcggggaggagctcccagcctttcgggtgccacgggaggagctcgctggcatccgcgcacgggggaggagctccggcctttcgcacgacgagggaggagctcgccggcgtccgcgcaacgggggaggagctcgccggcgtccgtgcttgagcaaggagctcccggccgtccgcgcacatggggaagagctcgccgccgtcttgccggtgcccgtcggcatctcgagcaacatgtggcagcgcgcgtcgagggcacgcttcagctcacccatgtaccgccgccgccgccgctgccgctccctaccgccacccccaccgccgcccgctgccactgccgcggccgctccccaccgaagagaaaggccaggggagagagagagaaggagagagagagaggaggggatgaaggaggaagaagggaaggagaaggaggatgacatgtaggtcccacaatactttatttgtgtgaatgacatatgggtcccacatatttctttttatttttttattctaatgccatgtaagagccacgtaggataaagactcggtcaagagcgccacgtaggcgccacgtcatccaaaaccacccaaggtattgtttgtaccggttttgatagttggaggagtcgatatacccgattttgtggttggaggacatgaatcatactcgggcgatagttgagggagtcaaagtatactttttcctaaacatgttgatcattgtatgggccttggcaggccacaagaaattgtgacgaaataaattgacaaaaaaactctgccatatcagctccacgtcatcgtgtgctaaaattttatgacgttttctatccgacatggcatctgtacactcatcaaagtttagtgagttataacgatttctgagctcaataatgacaaaaatgggcgtcatagactcaatgacgatagaaggatcgtcactagattagtgaaaaaaaaaacaagttttcatcataaaacttcattagagacgcatgataggtgacgaatgaattttcgtcacgcaagcatcacaaatttcaaatcatgacgtaaatttcagtttgtgacgtaagtgaaacgtcacctatcataagatttcttgtaaggtcatacacagtgcagatataagaagtggtcgagtgcctccagcttgtcatatcggtgcgatgatgctaggttggctaagtttgtgcaagcccttcggattcctcatgccctctgaagggtgcgggtgcccctacagaccgagcaaaggccaataccacgagccacgttgaccttggatgtaggagagagtagagaggggagagcgtgggatgttgccactaacaagctaaagcgcatctagcaagctagagcgcacctaccacgccatcccccaattcatgtcggctcgaagctcacgtcatggccgaatttgatagccactagctatagccaccctagagccgtggtcatcgatttgagaaggagagaaaatggatggccacgggaactagcgaggaaggactccccatggcataggaatccgcaagggcattcggcttcctcctcatcactgagcttgttcacacccttgttcactcggccaatgcaaggccagatagggagcatgcgactagaggtgaagaagagagcaatgttgacaagaaggggaggggagataggagccgatggagggtagggagtgacgaaggcaatgggaggagccgtcggtaaatggggatttcatggagtggctggggatgggtctagacaatatctacgagattaggtcaagggagctattttataatagtttctagttttaagggtgtttagtgtaaattttagtcgtaatcacacaaaatttgactaaaatagaaaatatgagaggttgacatgcaaaattgaaaacatgacttaattcagcaactttttcactataggagagaatgtgtagcctcaactttgagatccttattggagtggcttgtattatgaatggcctaataaagctagagtgagggatcagctacttatacgtattttgtctcatatgtgctattttatgtggcttcgtatattattagttcactcaaccatttaacatatatacataggagtaaaatatagatattatggtgagtagttatattaactggactggcccaataaggttacttagtagtacatccgttctaaaatgtagctttctagcacaggaccttgtcccaaaataaagtcatttctcaacctaccttctcctctcaaccaatcataaccattttctttcatctactactctgtcctaacaaaaaaagacaaactctagctccaacctggacacgcatgtgtgctaggattagacttttttggggacggagggggcactttctattcttaaccaatcacacactttctcaaatcattctcacatattttcttaatacccgtgccaacctaaaaaaatacttaaattttggcatgaaggaagtagtagatttatttaagatattaatgccagaactacttcctccatctttaaatgtaagcactttttagattgacacgagtattaagaaagtaggtgaaaataattgaaagaaatgtgtgattgattgagaggagaaagtagataaaatagaatgattgtgattggttgaaaggagaaggtatgtgaagaaatagttttatcttgggacaaagtattgtgctagaaatagttacattttaggatggaggtagtagcaaaatttcaataaagcagggatcagtgcaggagtagaaacgtatagtggtaactaaccagtgaggccccatgtatgcaagccagaagcttggagcggccacgggccacgtgcaagaacgtggccagtacattgtgcagcctccatcgacctggtgcttgtgtagttgtgtgcagcggcagcagcagcagcttccgcatgcatccggccatcctacttcctgctgacaagagaacatggaagcaataagtcagtgttccaactctggtaaatacaaatgcttcggccgtacactggcggtcagattaaacatgtaaggagcagaaactgggccttgcattgctgccattcatccacagccagaatatcagcccaacacaaactggtagtgcttccaaacatattgcgttgtatggagtagtcaggattcagcccagttaaaccatctggagcccatttatgcctttcaggagtgctgtccaggagtggacaccatctggagcccatttatgcctttcaggaatgctgtccaggagtggacttatctttctcatgttacagttttattccatataggatgagcccgttttcctatactagatgatatagcttttcaagatcctctcaaaaaaagatagcctctcaagaaaagattgacagctaaatgacaaacaaagcctaatcacacccaccattccaagttactttcagagaggtccttcagaatgtgaaatggttaatatataattacgtgtcaaagctcctgacccgtctgatcaatcttttgctcggatgtcactttctcgtgtccagacctccagatgacttcacttacaaacctgcagtcatatatagaaacaactttttacttccttagtcctcacacatgaatgatactaataccataagtaaatacagcaagaattcaaaccaacgaacaaaaggcgttgcagtttcaatgttaaactcaacagctggaagctcacagatttgtcaaaatacagtatatatcattcaaacggtcacttcaccggattattgcaataaatcagtaaacaagctattgaataggaaaggcataaatcagaggtagggattagtacaggatggcatggtacattaacctcgaatgctttccaaattcctaacaatataatgtacaacagttcaaaaacagaagaagcgtttgaccagatgacaaaggaaaaaacataaaaacaggatcaaacacctcccatcttataactcgagcaaggtggccacctggtgatctattgatatgtcaaattctttatcaattgaaatcatttatccatagagcaataccaagttattttccaaacatccaaatatggcttacaatgtaatatggcacaatgatgtaaattagctttggacctttatttatgatatataatcaatcagtaggaccaatttggtcttccacgtttcattaacatgaattatttttctaaaactaaagtataaataaatcatacaagagccacggtccaaactggaccaactaaaagatcagcatgaacaatgtaaagattgagtagaacagaacaagaataccaatacaacacaaattaacagaaaatctaccctgatgcaagccagcctacatcatccattacaccatagcattgacagtgactgaaggagtaaagggagcaaggaaggccaaatgccagatgccaatgactcgtttattcggtgagtatatttcaaagcacttggaaatcaagcaacttatttaattgacttactatccacaagtagctcaatcgagacacaaaaattatgttgaatatgatagtatgctcgctgggttggtatgcataaatggatggcaatcacacatcaaatggctactccaaaagatagcagaaaaatcccactccccttgaaaaaatagcacaaaggttttgcgacacaacagagcaaattatgaacagaacttctgcagcaggattaggatccagctagagaagaggtaatgtgaagaccaatcatgccacctgattgttgtacctgatattggaaacagggatatttttagaaaatgcaagcactgtacttgttgctagctagtctgtgctatgtaagttactatgcttctaccaaatattctaccaaactgatcaaagaaggatgggcagttgggcactacctttctttaagaaatgatgcttttatacgatgaaatgcatgcattttatttacaatgcatagttagatgggtgttctgagaatgttatttcactatttcagcatgtaatcttgcaaaacttatttcttctctcccataatggaaattaaaaatacattacattttgcaaaacaaaagattatatagtgtacatgggttgcacttccaagttatgatttttacactttattgaactggccactgtctggttgtctgcaatacagtatatatgtgtgcaagagtagtacacagcatgaaccaaaggaattggatcagacatgaaaacttgaagcatacggtgcacaaagaccaggtccaaggaagaggccagcaataagctgctgccttgctgatggccgcatgatggagattctaatccaagggaaacaacaattagaaagaaagcaacccagatcacaccaccacaaattaaaccgtattttattaccatcacacgcagcccccttttcccgtggcaataatacaatcctctattcctctctcatgtctgccttttgagcacataaacacaccaccctcgccatcatcatgcctaaccaagtttaggccctaatcaacgctttgctctgcacacctcgcaagagatcagagcccctgaaagctagaagaggagatagaggataacccacacgccatggggagagcgccgtgctgcgacaaggcgagcgtgaagaaggggccatggtcaccggaggaggacgcgaagctcaaatcctacatcgagcagaacggcaccggcggcaactggatcgccctgccccagaagatcggtatgtgttggcaattctcatgagtcatgagtcgatgtggtggttgtggcagcagcagcagcgatagtggtagaagaaagctaatcaagtgcatgtgtgtctttgttggtttgggtttgtacatgtaggtttgaaaaggtgcggcaagagctgccgcctccggtggctgaactacctccggccgaacatcaagcacggcgggttctcggaggaggaagacaggatcatcctcagcctctacatcagcataggaagcaggtatacttgctaattcagctgggcacacacaagtctagtcactcctatgatcaactcaactgtagaattagctgcgaaaccggtaggcaggcaggcaggttgcacatggggcatgagagtgtagtacaatctatgatctgacatgaccatatatgcatggcacaggtggtcgataatagcagcgcagctgccggggcggacggacaatgacatcaagaactattggaacacgaggctcaagaagaagctctttggcaagcagtcgcgcaaggatcagaggcagcagcagcacctggcgcgccaggcggcagcagctgccagcgacttgcagatcaaacaagaagcgagcaggggtgcaaacgaagccgatggcttggctgccggtgccaattacacttggcatcaccaccacgccatggccgtgcctgtgcacccgatgtcggcaccaatggtggtggaaggaggccgtgtgggagacgatgtcgatgagtcgatccggaagcttctgttcaagctcggagggaacccattcgcggcctcgccggcaccgccatgcatacctccaccaccaatgtacgaggaagccccaagcttcgtgccaccattggcgcacggcgtgccgctcaacgaaggcggcatgcagtgctccagcgtgctgccggcgctggagctggacgagaacttccacttcaaccatgtcaagctggacgggctcgagtgcctcttcgggatgggagatcaccaaaacatgagatggaatgaggtgagcccgttggtttgccctaataacgctgtggcgtccagctcccaagggatgcagcagtactgcctagttgaagaaccagctgacctcgggatgcagtagcaatttggttgtgtttccgtgtacatgcatgattgtgtggtgtaaatctgtagcattcatggggaaattaatggggaaagatgagatcaaacttctttgaactaagagcaataaggtcgagctctcaccactcctagatgagagataggtgcatgcctgattttccaggtgtcttcatgtgagtctagtctttaaatggtattttcctctactctcttactgccctacagaaacattttacattagactgtacgtgttgcatttatctgtcgcttaatttggtgtgttttggcgtatttaatttgtatcaagtgacaagtactgacctaaacttaagacttagggctatagctagaaatttgttttatgttcctaataccgtaccatagggcattatatcccctttttttaaagatcatgctatacgtacacacacttatctttaaaaaaaattctctaatgtttgcttaaatttggcccaaaaaaacagtatacatcatgcgatattaagaaatatactaagacaagcatatctacagaatccgcaatattaacatatcatgcccttttgtatgcaaaggtaagagagaagaatcagtttactcaagtattactcaagtgtctacagccataatttattattcgatattccaaggcactgggcatttatgtgccagaagatatgtcattactggcacatgagattaagatttagtttgtgcaaaaacttcctcatgtgcagtgtcaaatatatttatggtgactaatccgttcaagtttgaaattttggagtctgaaatgatacgggaccttcatttctcttgatgtcatatgcaattatcaaaacgtttatttgacttagcttgtttgatttctcattccgtacattagccaagtaagtgaagcgttggtataatcattagttgacatttgtcttcaacaactagttgtcgtactggggaaagaacagacctctacccaggtaataatcaaactatatttatatctattactaagctagcatgccccttcctacgaccaaggaaaatgtcagcccagctaactgttctagaaaaatgaaaactcaactgacctctcccatcattgacaccacacattgttccagcaagatgtcgtcattgccttttccattcggatgcttgcataaaatgaagtaaagagcatgctttttaggagttcctcataaatatgtaaaagaaatacataacagaatgtaaaaaaaaaaggatagaatactcttatgttgtgggtgataacagccatagcgtttaaacaacaaacacgttacatggatatggttcatttacatgagttgccaatttcgaatatcaccatttctagctgttttgttataggagggtctgaatctacgagaaattagatagatcaatacaatttgatgtctttgatagatatgttttgctaatttaagaaatcacgtggatcaattaaatcaacataacttattttcatcggcaccaataatcagccgaatcagaaaggtcaagtttacatatgttgctttgtttggtaaaagaagttcacagtt

SEQ ID NO: 68564 - DNA, 14748 bp, Oryza sativa
acgtttgttgttgaaccatcaaatcatataaaggataaatgaatggagaaagtgtggttgtgatgcaacactgtcaagcatatgaaacagctaggaaggatacggtaaagttcaagaaatatgatattgttcacgtataagagatcttaccacctttaaagccctcacaatttccacgaggatgatccattctttgaaaaaagggtattatccttggatcactctgttcttaattaaataattatggaacacatatcattaaaaatattcttctctataaattaaatgatggaataagggaatattattgaatcaacatgctaacttatgattcctacagagtaacatttcatccagcagcagatcagacagcatgtcatcaaagtgaacaaaagatgcaagcagagacatataagatatctaagcttctccataaaaacatgttcatgttcaacatgcatgtaatgttctatggcatgtaaacataattattctgaaaataggttttgtgtgttactagctgtgtgtctcctctcatggatattaattcaaccggttaagtaaattccagacgatgtgatgagaagtgaatttgatccaataaacaggaatccaaagttagtatattgcatccttagtcaatgtaactggtttcaccttaggaacacacggtacacattgatgaaatgctataataggcctagagatctaccatttgctctttcggcacaagattggaaccccttttcatggtctctgataaactgatggcccctacttgtgaaaagtaaaaagggggaaaggacagccccttaaccagtaaaggtgtttctccaacatgtaggtctatagctgattataaatagagcttgcggatttcacttcagtaaacaaaggcacttgtgatacgatttcaacaatacatgcctgcaaatacaaaaccacgtcctagtgcaccattcatacatatgagccagatatgaaaggagaagctttcatattaatgttattaagaagagaggtgaacacgcgcgtagaccgctgatagggatcgaatgtgggtgggcatgcacgcaacccagcgctctggccatttgcactaggcgcagcttcccgtacatccatatgtatggatgagaagattaaatatggttatttattgactggattgaatagatcaagattacagttcaataaggtattttctatttaataaaacttgtatatggtcaatttggccaagagttgaaaaacctgcaagagcatgaacgaacaaaaattcaagctatctcactatctcgatgtagcaacactgtattgattgacacaaggaataaatggataagacgtaaactctagttgcaaacatatcaaactgaatgaatgcttgacttcagtacatcattggtctaatcatacagtttaagtccctatacaactagcagaagccaaacggaagacgttctattgcacatttcatgggcccgattatctcaccgtggcacctaacagggacagtttcaacctaatttacaccaccagtcagcttctatcactgcaaacataactagcgatcttctagttgattgacgttaattaataaacgggcatgtttatctaaaaaaaggacatgtctatgtaaaataatatagcactatcaagtcaagagacactagtgtctactcataggctcatagctaccttcaaatgttcttttcatacagagatgaaaactaaaaaccgaaattccacacacaaaatttctccacctctcgttctatctgacctaatcccagatcacagccgtgttagccacctcaatagcatcccgctccctaaactctatatatgattcctcacccaatcgtgcactaccggtaaccgccattgtcgtcacgcgatgtgatccgcagatctgcagagcaaacagagcaacaacgccaccgattcccaacccccaacactccaacaaccaccaaacatgcccctctccccgcatgaacccgtctcgattagttcaacgaactagggatttcgaaggaatcgcgcgaaccatacgatccatccaggagggggaaaaattaagggcaaacctccggatcgatacctctgacgcgcgcgcaggagaggaattcggctcgagcaaatgcgtcggatcgaggaaaccctaggatccgggtctcgagtctccaccgcctcctccgcctccgcctccgccccttcgcaagcctccgatccccacacttgggtgggaaaattttggcggcacagcggagcggggtgaggccgcccgcgctggaccaggaggctggaagccgaggagactggaagcctggaatcctgggcttttataggcccatcaggccttatttccgtcaggcctagcggctgtttcagttgggaatttaagtctattatgactccctaattttttccccttatttaaacaccgacctcaactgcaaaaagtataatgcctcttccttctttaaaaacagatacaaatcagctcctgttgaaagcggtttcaactgacgtgatggttttaccacataaaacccacatgtcaacaactttctcttcatctcatcttcttcctcacctctcacctctcccctctctgtgcgtcaacccgaggcacaacgcgaaaacccgcgggttatcacttatttgacatataagtgggttcgcgggttggttcgcttgcatccctagatagtagaacaggtcgtccaccggatccacgtactattgttgctgccctagacaatgtcacatccacgccacagccacagcacaccgcttggcgtgctcgccgcctccgcgccttgcagaacctccataccacctggtctgcaatggcggtctggttcaggaacccaacgtaggacctgtggttggtcaccgctaggagggagaagtagttgtacccgttggctgccggatgctgcggctccgtcctaatggccgcgacggccttttgaggcatgcgcagcggcgctggtccaacatgttgcatagccggatcaaggtgtagcctccccttccttctcggtgaactaatggagccactaaaagggagggaggctgaaagagaaaggggagaggtgaggaagaagacgagatgaagaggaactcactgacacgtcgatcccacatgctgactcatcgagtcgaccatgattaaattgccaccgttttcaacaccatcacgtgagttgatttgccctgattttcgaagatgggggaggctttatatctggttttgtggctgagtaaggcgattaaatcaggagcaagagtgagggaaaataatagacttattccttccaagttgctgtcaggccgaggccgcaggcccgcgaggcttcaactgctccattctaattgggccggagtgtgacagctagtttcggcccgatatttacgggcctccgttaaaacctaattgggtcgctcaggagacagtataccttcaacttttatttaccgtcttctctttctactcccaattaaggcattataagtaatgaccttgcacccaaaaaaaattatggttaacctgtcagtgataagctttcaagcaatcttctcaatctcgttctcactgaatttacttcgactcctttgctgcaaaaataaccgcagatcagatcatcagaacccggtgtttttttacatcgggtattttctgattcagtttcacacttgttactgcgtgccaacggctaatgggctctcgtggagaccgtgccatgtgccggtagcattcgtttttttttttcttttgttctttcaaaaatgagccgctccaacggctagttcgcgagcagtcgatcgcactaaaaattccattggcccaactgaagcaaaacacatcgcccccaaatccaatcctccccccaccatcggacagcgagatggtcatggagatcccgagctcgaagcgcgacatggcgcggggagcggaggacgacggcgaggaggaggaggaggaggagtacgaccgcgtgttctacgaggacatcgaggcgcccaagttcgtcgacctcaccgcccccgacgccgcccgcccctccgacgacccctcctggttctgcctccgcatcggtacggcaacacacacacacacacacacacacatcgctgcaagattttcttgagatgaaattgctgaattcttgagatgaattgcaggttgtgaccagaaccacgagcatgtcgacccggaggcgctgcacaggagcttcttcatgcgggtgcgcgctgcttcttcctggtatgcgcgcgatttcgtggtaggggaggttgtaatccttgtggtttttaatggtggcaggtcatggcagcgaggagccccaacgtgcggctgcagaaggcgatcaggaggaggaaccagaggtagaatttccgattcatccctcactgcctgcgtcgaaattgttgtgtggttggttggttcatccgattgacgtagcccatcctctcgtgatctggtgcagctcgatgctgaaatgcccgcactccgcgccgccgaagcctccaaggtcacggatcgcgaggctaagcacggcgacggaggccgcggcgaagcccaggctgaagacccaccggatttgcaccctgcgggcgtctccgacccggaccaaggcggcgaaggtggaggcctccggcgcgaggaagaaagccctgacgacgccgaggagcaagcccgtccggccgaggcaggatccgttcctcagcgtgaagcaccagaagcaggagcccgtcgcggcggcggcgaggaaggggaccgtcgcgaaagctctgttcatggccacgccgaagaaggacgccagcaagacgccggcgaaggcccaggcggcgccgccgctgtccgaggtctgctccaagatgaggaagctgaatttggcgtgccgggaggtgcctagcagatacctctgtcagtcatcgaatccgaagagttccaagaaatgcgaccagactgcagtgaagagtgtcaaggcagctcaaaattccaggccggatgagaggaagaagaagaagattctaggctgctcgttgcaacatgccagttctgaagctggtagagagaacagaaatggccgtgagaacacagctgcagatgagaatgcttgtccagaagctgcgagctccagcgaggaaccgaaggaggtgatgcaggaatccagaattgaggtggagacatcacaagctgacaattgtgatgacgataaggagaatttgtcatatgttgatcagccaaccgaacaaatggtgatcatctcgcattctgatggtgaaaacctgcagcagctggagaacaatgagaatgtccctcggaaggtactgaaattgccttcttctttgttactgtagctaagacatgttgaaactgaaatgctgtaatggacaatatgcaggtagccaaaatgcagagcaaactgaacgcagagcaaggaggaaagctcaagaaaactaccaatccgaagccatttcggctaaggactgatgtgagttactggttacattgtgaaagctcgttgttgtggagtgtttcactcgttcactaaccttcctcactccatcttctgcattttaggaaagaggagtgttgaaagaagcaaatccagaaagacaccagacgctcaccgagaacaactccacggccgcagttcaggtaagttgctcacgcgcaccaactataagattcctaatgtagtggtcacccactgatctgtatgcatgtacgctgatgcagcaaataggaaggtgtcgtgacggaaagggacgagacaaaccgacgtgcggcgagaaacaggtgagcattgatatctcccccaaacataatttgcaggtccaaatcaatttagaaagcactcatgctgaattgctgatctgcgcaaactgtatatccagaagaagcaaatcagaaatgttgcaacgggtcaggttgatgaagccaaaagggtcttgaacagcattcgttgcaacaaggtgaagcctgcgatgacgaatggaaaaacagttgggaaatcacagggagcttccagagtagcatcatcaacaagaagtaccaagataacaaggtttgcccccacaaaaaaagagtaaatttgcagccccggttattgttttacagaattgccatcatgtaatatttttcttgcgttttcacagtggctccatggcaccttctaaggttggaaaagagaagagtacatcggtgaaactatccaggctacaagcagctgctgcttaactgaagtgacaaatgttttattgtcagctccaagcatgaaaatatgtatttaccgcgtcgaattcgttccattgtattcttgaactactctctagtctgcacactcactcacaccaacaaggatgtatcatgttcccttgttttgtccgtgccattggtatgttgagtgaaatttttttctctgtactaccatcatcatctagattattttgtaacctgaaagaaaaatcagggaagaagaagaggcccaacccaggagaaaattcagatcggcatctgatttcacatggttcttggtgttgtaaattcaagcccattggccttggctgaacaaaatacagaatggcagggacataaatttgaatccagaatgtcacgagatgcccagccgcccaaccaatccaagccaggcagctgaccctctctgcatccatccaaacgcagagaccgaagtcgaacagcgtcgccatctcgccacacggccagaggccgagatagatgccatatgatatgccatccatagaccacacgcagagacgcactgcatatgcctgcgtgtacagagctgttagctgtactatgcaaggggcgcatcccctacggatacggctgccatcaactctgccattgaatccatccacaccatgatcaactggctgtgcgacagcgtgcgatccggtgaacagtttccacggatctgcaacagatcgatcgacgtttatgtgtgcatcgctctgccatctggtaatgttttcatttcagaggtaaataatgttagcactaggaagcttcagcagggtccatggcccaaatggaccaaaccaaaatcttctcttgcaccatactctctccatccaaaaaaaagataaaccttggatttccgtgtccaactttgactgtccgtcttatatgaaatttttttataattcgtattttcattgttgttagatgataaaacacgattaatattttatgcgtgacttatctttttaattcttttcataattttttcaaataagatggacggtcaaatgttaggcacggaaaccagggtttgtcttttttttttggacagagcgattatttgatcacttgatgcttgtagcatcgcacgagcagcaccccccctcccccggcaaaaaaaaaagaagaaaagcactagtatttgcacgactccacttgcccctaagaacgaacgaacgaatgtaaatcctacatttataagcatttttggaaactggatcggcaaatccttgaaattaacgaggtcaccacagatagcgagacggtacgtcgtctaccaccgaaagcacaatgctgttaaatccaaaaaaatcttccatggaaaatcgaaccaagaacttaaggtgctgctgagattcttgtaaccactaggttacatgacctttcgccactccacacagatttgagacaaacggcaagaagcttcctttttctcgagctgcccggcgagacattcttccaaaaacggcggggcctcgagatcggagaacccagtaaacaaagtgcgtaaaaagcgctttccgtctcagttaaaccgacgaacagtcgatgtggaagcaattaagattcgtgatttatgcgtggtagggtagtggactagtggtggtagccgtgctaaagcgccgagattaatttaggaggggcgtacgtactctcgctgcaacttgcaggacgtggtggggtcaggggtgccggccgccggaaatggcgcagagatcacggcggccgccggcgatgcgcggcgcgtcctttacctgatctggcacgcacgtggacacgtggtacgtgacaggcaagaggtgcacgcacgcacgcacgcacccgtaccattcgtttgtgcacatgtcggtgtgtgtttgtccagtgtgcgcagacctgcgagcagtacacttttgtataggcaagcctctttgaatcaggcaaagttaatctactattctctctctgtttcaggtataaaacattttaatttgatcaatatcagttttaagttctactaagtttataacaaatacaataatatttataatgctaaattagtttcatcaaatcaataattagatatatttttataatacatttgttttgaattgaaaatatttttttttacaaacttggtctaatttaaagcaatttgattttaactagagttaaaacgtaacctgaaacggagggagtagtatcgtataaacattaacaatcacactctttttttattcacgctatcgtaatgatcatcgtggctcgggggaagtcgggatggtccaggcgaagcagaaaaagggaaaaagaagagaaaagcgattaaatccaggtcacatgcgactcccccgcgagttgaggcatgagatcgcgcggactggggggctcaaccgagatcgatcggaattgcgattcatcccccatcaccatcgccggtttttccatcgatgtttgcaacgcgatttgcctgattggcgccgggagtttggtagtcctgacaaatggcgtcaagaacacacaaatccttgtgagattgcgagaaacagacagacatgccgcgtctttgtggccatggatggatgtcacgttgacagttttgacgccgccttgccggcccgacatggctgtgtgttcgccattactgttagcacgcgattaattaagtattaaatttttttaaaaatggattaattttattttttttaaacaacttccgtatagaaacttttacttaaaaaaaacataccgtttaacagtttaaaaaatatgtacgcggaaaacaagcaaaaggggtgaaaaaaatgggcattccaacacagccttagcctagccagcagtggccagctaaccaagcatacgggcatttccgttagccgcggccgccggaatacgtacgcctagtattcgatttcggcgaacatcaaaatcggccggcgcgcgggcgggcgccaaaggctttcgcggcgggcggcgtccgaaaccgggtggcttcaggctaaacagctactactagtagctcgccggccgctcgttcttaattgaacgatgacaagtcgacgtcgcagaaaagggtcatcgatcgactgctgctagtagtgctgccagtgtacacgtacgtgccgctagctgttaatgtctgtgtacgttcacgaggagaaatacgcgtattaatttggtttcatcgcttttctgaaaaaaggaattgtactaaccttatagcaaggtcaatggtgcagctagcagtaagctctaaatttttgtcatgtcaaatagctaactactacaagttaactataagctgccttggttaaagcatacatacattaaatacttgtatggatacatcagttgttggacccacataacatattttttattgtctctcatagctgcacgcgagctatatggtttggggtattgtgcaagcgccggggctaaaacaagcgcctggttgtttcattcttgctgaatttctttccttaatcttagattaggctgattaacaggttttggagccgacttaatagagctattgtacccactcttatgggaaaaaaatcatcctcatatcttacagatttgggggcaccagatgtacttcacggttcacgaatgcttcatgcccttctcctccaactctgacaacattcttttattatccgacaccaacaacacaacgaaaccacattaaagaatttacggattaaagtcatgcgccgtgatggaggtagtaggggggtgaggaggagaaagatcaagggaaatcgtcgtgcttagaggatgaccgtagaatgaggtgcaacaagtgggcataaacaacgttgttgaagtcgcgcaatcggcagctagcggtgggccggtgttagtggcagggtaaaaagagcaacatgttacaatgtggcagttggtggtggtggatccggcagtagggatccgcctcaacaggtcacccacttgaggtgtagagggggagggcgcggggaaggaggaggggaggaagctgaccagataaacctcactggcaccatcgacatcttccggccacccaatgaggttgggcgacattggtgaggagtcaagcaggggcatcaaagtgttcagaaaatgcggtgctcaagaaaaatgaaaatgctcaagaaaaatgaaaaaaagagagggaaattaggtttgagtgtttgcacgaatcttacaatcattgaacgaaccaaaattataagattttaaaaggtattctctatccaatgtgtaatagactgtaaaaaaaaagagatttgctctgatccaacaaaaagtaccggtatcagatcgtttccgatcattggatttaatattgcccatcatgcccagttagatctaacggtccgaaacgatttggtaccgtaagataccggtacctcgaggcactttttgttggaccggagcaaatatatatttttttaaaaagttttcctctcccaaagcgtttgctcgttttacaccaacctgacaattgccatcactggtataagagcaagtttaatagtacagttaatcgtgagcgctgaaaatttaacacgtcatctaacagctaattaaaccacgctaaatacagtaaccggctatagtgttgctttacccaacgtaaagttctatttttctattggctgttcacagctatctcatcccttgcacagggctgcgttagagaaagtttataggcgctcgcgcctgagccgacgataatatagtcgttcgcttttctctctccgctctttctctctctgtcatttatattaaaaatctgatgtaagcatactatcactattgtactggtctaacacgggttgcgtacacatgcaagtgtccatgtgttatccgtagtagcctaccttgctgctgctaccactgcaccacacagctagcctgtattgctgacgcttgcatagttgcacgggtgttaatgaacaccgtgcatgcgtactcgtaccgatcgatcgatggcgccaacgccggccacgcaacgccaaggcgatctacaaacctgcacgcgtactaacaaacacgaggacgacgtagtacgttactactctctccatcccaaataaaacacaacctaaacaccgataagatattacatagcacaacgaatctgaatatgttcgtgtccagattcgttatactatttaatgtcccatagataaatctaaacatgttcatgtccagatttattgtactatttaatgtcccatggatgtctaggttatttttttaagttattttttttaaggatggagggagtacgtgggagttttcactctcgtgccgtacttgttcagcttgcagcctgcagctggctgcctttgctgaattgctgatactactactactagctactctagtgatagccaagcatgcatccagcccggccactcattcatggcgatattgattgaccacacgcatcgcatgctcggtggtgtagggtcaatcctttcgtccttcggtgtagcacagtaggggtagtagctcgtttagcgaagggattttccaggggacgacgtttcatgatccgatcgaactagtgtatcatctactatgaatgcatgatcacgctcttgtcacaatcgagaacagtgcaccacaaaaccacaaaaaaggaggagctgaatgaatatgggtgtgaattaccacgatcgaccaccaagctagcttaagcacaggccatcggccggcaccatccgcttggcacgtatggtttgtcgtcgcccatggtgctcgacagaagggtacaaagccatggccaaactgcttggcagctagagtatgatcagttaatatgaagtcaatcagcatgagtttgaggcacccgatttaattccaacgacaaacttacaaaccttagcgaaatcaaggacaatgattttattttgtttttgtgttgtttgattgtgtaaaaataaataaataaaattataccttttaccattaaaaaaacacacacccatcatatattactcactctgtttaaaaaaaaagccaacctaagaggggatgtgacccctcctaatacaatgaatctgaatagcccaacctcttctagtactacgaatctagacaaagggttatccagattcattgtattatgatgttttttttgggacggagggattacgtacatactcatgagcatgttacttttaaattaaagttccatggtaaaaaagaaatacatatgtgctagttgccatagtagcacatctttaaacgtgtattcgggacatatcgattcactaataatacatgggtgatctatgtgagaattgagggggatttgaacataattaattggaaaaattacaaaaatcaccccataaatcatttgaagtttgacattccaccctataaattattttgttgcaaatatccacccacctactcatttttgttgcaaaaaccaccccagtaaacatatgcttaaccgaatcaacatgtttttataaaatgtgagccatcaatatggtctttaccaaaactaaatacttctagagtattcttgatacattttttgtgagattccacatacaaaattgttgacgagagcctaaacattgttgcactgagtttcgctatatgaaaaaaaaatcaatcaaatatggaaaataagtctaatgcaagcacttagacaagattgacttggctaacttagcatgtggtaatcctacatcggcaataacgaattgattcggttaaacacgtgcgcattggggtggtttttgaaacaaaacttagtagcaggtgggtatttgaaacaaaatgacttatggggtggaatgtcaaaattcaagtgacttccggggtggtttttgcaatttttcctaattaattccacacctataataatttgaaactaaccttctcaattctcttcaactctatttttataggattaaacgattaaggcttactactacacaggaaaaaacaatagcctcgtgtagtggaaaaaaaagtgtaataaaaggtcgttgccggtggaagtagaaactagaaaagggataagcgcgtgtgacaaaggcggccgctggccagcacgcacgcagcaaacgaacacggataaataaaccggagtcgcgcgcagaaaaaaccgaccacggaccaaacccggtcgagccgcgcctttttctagaacagcggcgatgtatgagatgactcggcgccgcgcccgcctcctcctcctcctccccgtgtgggaccaccgaccgccccctccgccggtagggcccacatgcccgtctccgctccccagcgcgggacccaccctcttgtggggcccacatgcccgcctctgcgtcggacccacccctgcgcgctttccctcgggcgcccgtcgctttccttttttatttttatttttttgactcctgcgagatgcggaggagatcggacggcgcggtttgaaaagggccgcgtcggtgcggatcctgggccgtccgatcgggccacgatcccgagccgcggctactgttcacgggggtggacgacagcgcagtcacagccacgtcacaggagttacggcttcgttcgtttcggcctcttttgcagtaacaccctccaagaagaagttaatttccctgttgtaccaatccatacctggttctgtctacgaaggaccgatttgtacagtgcaggagtagagaggtgctttgtgcaaaaaaattcgtcgatctgaaaagcaggctactgtttctcccgtggtaaagaaagggaaaacaaaacagagcatcgccatctctctcccctcccctgaaagagctaaaaatacaaaaacatttggcgtactcaacacaacgatcaaaccaaacaaacgcaaattacgtgaaaaaaaaggaacgaaatttgcgaggagaaaaaaaattcaacgcgaggaccacagtccaaagccgctccaaacattccacacacacagcaagattagaaaaaaaaagaaaataaaaaaagccataaagaatagcagtacgatttgttccccttttgcccttccaccccgggggtttaaaccgcgggaaccgcgtaatttgccccccctaattaactccgacataaaaaccttaccaaaccaaggggggtttagggggaaaaaacacgcacggaaagacaagaaaaatattaaaaaattcgcttcctcttcttcctcctcctcctgccgatctctctcctcctcttgacgtgttgagctgagctgttcccacttcccactccgtcctcttcttcttcttcttcttcttcttcttcctctcgctctcgcttcttcttgagcttaaatggcagtgggatcagctgcgtaggtgtgagggggagggattggcattgaggggtggggggaggtggaggtccaggaatagggtgtgggtgaagtgtgggaggctaatttgggggtgagagaggagaaggagaggtgaggggtggggggaggaggagggggaggctggttcttggaccgg

SEQ ID NO: 68565 - DNA, 5733 bp, Oryza sativa
  unsure (1)..(5733): unsure at all n locations
agttcctcaccgacgcatgcgtcgtgctcttcctcatccagagcgccgaccgcctcatccagtgcctcggctgcttctacatccatctcaagcgcatcaagcctaaccccaagtcaccggcattgcccgacgccgaagaccccgacgccgcgtactaccccatggtactcgtgcagataccaatgtgcaacgagaaggaggttggtttgtgctgttgctatcgctctaaaacatgccattttttgtctccgaagtagcaaccttttgatgtttgtttgttggtctgtccaggtttatcagcaatcaattgcggccgtgtgcaatcttgattggccgaggtccaacttcttggttcaggtattggatgattcggacgatccgacgacgcagacactgatcagagaagaggtgctcaagtggcagcagaacggcgctcggattgtgtaccggcatcgtgtccttagggatggttataaggctggaaatctcaagtcggcgatgagctgcagctatgtcaaggactatgagtttgttgccatctttgatgcggacttccaaccgaatccggacttcttgaagcgaaccgtgccacatttcaaggtaaattgagatgaattttgtgcctatagtttgtggtgataatgtatatggtttagggttctaattatgattcatttgtttgctgttgcaggacaatgatgaattggggctagtgcaagcaagatggtcatttgtgaataaggatgagaacctattgactcgtctgcaaaacattaatctttgcttccactttgaggtagaacagcaagtgaatgggatattcctaaacttcttcgggttcaatggcactgctggtgtgtggagaatcaaggcattggatgactcgggagggtggatggagcgtacaacagtggaggacatggacattgcagtccgggcacaccttaggggctggaaatttatcttcctgaatgacgtcgaggtactatatatgacaaactttctgaataacttgttgggttatgtttcttcaccttttcagttgaaataacccatttccctcattatggacagtgccaatgtgaattgccagagtcatacgaagcttataggaagcagcagcatcggtggcattctggtccaatgcagctattcagactctgcttaccagacattatcaaatgcaaggtactgatttgctcttatttgttgtagtactttatttttgtaaacatctaaacaatgaacttatataaccaaatgttgttatgagatatccgattggtctggataaatatatctgttaatgcaaacacgaaataaaattaaggctttacagcattttttcccgtatccattctgtgcaactttgtcttcaaatagcatgtcagatatatcatttaatccgtttattacttaaagtgaaaatttgaacatcaacaggtaaataatgtgatcttgacaaaaaaaagtgtgttcggtgcttttgttggatacacaacannnnnnnnnnnnnnnnnnnnnnnnnnccaaggatgttaacatgatgaaattctaaaatgttagaggtttttttatactctttaactgattctcgaaatattaattcacatattgatatgtcctgtaccattagccttttctctcaagtacttaggtttatacacttcaataaagacgcatgctcatcgagcagcatccatctcactagaatataaaatgttgatatctaattgtatatcatttgtgcgcatgttacaactggacctttttttgcattaccatgatagaatatgaatttgcttatcaccttttgttgtcattgtcatcaaaataatgtactacctgataggatgtctggatgaaacaactgacttgttgatagctctgttttaccaatctgattgctagatgaaacaactggcttgttgatagctctgttttaccaatctgattgcttattaattttgttttattctgctgcagattgtgttttggaagaaagccaacttgatcttccttttcttccttctccggaagctcatactaccattctactctttcacgctcttctgcatcatcctcccaatgacgatgtttgtgcctgaagccgagcttcctgactgggtcgtatgctacattcctgccctgatgtccttgctcaacatcctgccttctccgaagtctttccctttcatcatcccatacctacttttcgagaacaccatgtccgtgacaaaattcaatgccatgatctctggtctgttccagcttggaaatgcatacgagtgggtggtgaccaagaagtcaggccgatcatcggagggcgacctcatttctttggcacccaaagagttgaaacaccaaaaaactgaatcggcgcctaacctcgacgctattgcaaaggagcagtccgctcctagaaaggacgtaaagaagaagcacaaccggatatacaagaaagagcttgcactctcattgctcctcctaaccgctgcagctcgcagtttgctctcgaaacagggtatacatttctacttcctcctgttccagggcatatctttcttgttagtaggccttgatctcataggcgagcagattgagtaaactgtgaaaagcatgatagatgttaaaaaaacagtgacaatggagggtgctccagggatgttgtgtcgaagctctttggcgatattgaaatgttgcatgacgcaattgtgtcgtccaattgatttatgtcacgacttcacacaacatgatccacaatgtacacgcccaaataggcccctcccccctcggttgtgtagatatagttgttcttggactgtaaatttgcctagttattccaagactatccgattcttttgtaaaccaattttggtgttcatgtggggattttatgttaggaggcaattactgcctgtacgagtgattcggaatccacaatgcccttaattagaagccattccttccttatgtgtctacttctgaattctgatgaccatctttgcccaacctgctatgttggtcaatctacctttgctgatgccattctgcatgactccagcaaaactgatactgtccattacaatgtcacatgactggaagctttattttttcctcttaaatgtacgcgtccagattccagcaggtagtcaataaagaagctgcccttctgataatcgccgagagtataaatgttgacaaacttttcaaaaaagtgtcaaaaccggaagagaacttgtgaaacggcatgctttttccaagtgatacaactacactacatggtgtaacgtacaagaccagaaaacatcatcctacatacagctggacaccaccaccacacacctgctgctgatgtagtatcccaattccatcccagttgcccaagaaaattccaatccggctcaattcaggcggcagcagcacacacgtctccagctgaatgtcaattacctgaatctataaaaaataggagtcccatctccatttcaaggggccagaaatgaattccagatagtgaagtgagatggaaacaaaaactaataaacccggatgttgtctcaattggagatgagctgtgagtagccgagaacggtggcggcagcatcagctgcagatagtgagagaccagtgccgagtccatcgccttatctgcacgggcatgtggccgggagacagctgtgtcgcgccaaggcgtccgtccgtccggcccttctgctggtccagcggctgccgtaagcgagcgtttcacatgacgacgctttctgtcgtgctgaactggagatacaaatcattactgtacaatatacaatacaccaaatgtcctccttttttttctttttttttctttcggtagaacaacaattgtactaggagtgagtattaggtgcgagtgctcgagtgcaagtatatatgcagctttgtcagccgtttgccttcttgcagtataagccaagggaaatgccattggtaggagtagcaaacaatggcggacacggcgacacggcttagttgcgttcttgcatctggtgaatctggatcgctctatgtagagtatcactcgatcgatctcttctgatcatggcgaatgattgccgcagctcagcaaagcttgggggaagtgagttacccatagcttaatcatgatgtcacgcattaaaaccgggcagtacctgacttctagcttagctttgctgtaacgatctgcctttgtgtgatttttgaccgtgtgacgtaaaaaggcgattatataatggtccaattatttgcacaaattgccccaccgacgacatgcatgcccaaccggtgaacaacaatgagagctagcacacgtgtaaagtacacccggcgctccattgagtgagtggcggtcgtcacagtaacttagtctcgaagcctaattagattaagaaaaaaacgcgtgcagtgcaccaaaatacgtatataatactaaacacttttaggtggtgttattttctcctgaagatgaagatgaaaattaagtttttttttacgcaaaatgaggtggtattaatacatgattgattgtgttttaattattataaacttgaaaaatagattaatatgatattttagagcaactttcatatataaagtttttacataaaacgcaccgtttagcagtttaaaaagcgagccacaaaaattttaatcttcattcaactcttgttggagaaaagaaatggaccttactccatgatgtattgcttgtgcatgaactatggtagaacatccgtttcacaatgtaagtcattctagcatatgaatatgggaaatactagatatatgtctagattcatcaacaccaatataaatatgggaaatgctagaatgacttacattgtgaaaggagtacattatgtgtactgaagtacttaatattacacagcacagcagagtcatcggttcacaaaagcccgatcaaccgaaacacgaagcccaaccctcctatctaaacaggccgaggccttaaaccaatccagatttcagggcccaacctcctcggccctagccacgcgacaccagcccagggcgaacaacgcacgtacgtttccgttgatttcgagtatggctcgaggggtcggagaataattctccgaaccctcttgggttcacgtgaaccgtccgatcgtgaacgtgcgggcaggaagtggcccggggaactgcgagggtgggtttgatcgcgaggtcatgcccaactgtggccctgtttagttcacaccaaactttcccccaactctcaacttttcatcacatctaaaactttccaacacacataaactcgaaaaatgcctcagttcggacgtccgatctcagagaaaaaatcgaatacctataactttgctatgtacagcctcctatccccttttgcataccctttacatatgcttcatcactaagcattagcatgcatgaaggagaggggacacgaggctatttacatgtacacccttttagcaaacttgaaaatgactattctcccaaattacttatccaatctacgatccgattatactattatattcattacaattaaatatttacaacaagatgttacatgattatattataatgaaaaaacacacatatgtttcaaccatttaaatttaatgtttcgcatgtgagattcggatgtttcagctgagattatattatgttgcacattttataattattgtgttgcgatgtatgtttctttaatgtatcacatgg

SEQ ID NO: 68566 - DNA, 7367 bp, Oryza sativa
aacaagtatttactagttaattaaaaatgttgcacatagtattattcatatgtttcagtaaatattatacgatgtttcaatagttaacatcatgtgattaaattataaaaaaatcatgtgagatctttttataaaaatttaattataatgaataaaaagatataatcggatcgcggatcagataaacagtttaaaacataaaatagttaaacgtatgcaaataaagttaacaacctagaacctaggcatgatgcacggtcaatatgtaagctaagcacagtaggagggctatccgatctttagaatattatcggacatccgatggttagttggctcctaactttttttccaaactaccaactttctctaaacttctccccaatttcaggaactaaacacagcctgtataacacatgtaatgcccatatatgcatctcaccgttgagacgataaacacaattaagatgtttgagaagaaaattggttctgttagctaagctgatgaatcaaaacattctaccacaatttgcatgcaaggaggcaacaaaatgtgccaatctcgtaatcaccttaggtagaaggaagcttttttaagtttcactccaccaattcataatatgaacatacatgataatgtgcacggtcacagctgttcttgctaagtaaatgagaaaagaaccacataaagacatggtttactgaagtccataagtcagtaacattcaatccacatgaatccggcaagcattttacactttacatattctaatccgtcaatttgcactcagaagatggctggacgtatctcacaaaggatggctgtgcggagggaatgagttcccaagtcagagagtagtgtaggaaaacacatgagagggcgacgtcctctgtgacgcgcggcgaggcggcgaccgatgacacacctaactgatcaataagaccacacgtctgagtacttaatataagtttcgagggagcgtatcctatgcacataggccctcgcgtgtacacaccgtgtacaccaactaaaaattatcacaaaaaattttagaaaaattcatacatgcactttcaatagtattacatctacatgcaaagtcgcatcttcaaattcattctacatagagaataacaaaaaagataaaattctgacaaaattgtaaccttaaaactgtcagttttttttgttacggctaaaatataatgaatttgacgttaagattttaaccctaggtgtaatacaactgaaagtatgtgtatgattttttctagattttttggtgacattttttagttggtatgcacgtgtgtacacgtgagggcctgtgtgcataggatatgttgccaagtttcgaaccctaagtagactatataaatagagaacaaaatcaaaataggggtacttacaactgagtagtaatgtactccccgtcaaaaaaaactaacctatgatagaatttgatataatctaatataacgaatttgtatatctaatcatatattagttttttataagataggggaggatgcacaagcagttagcacagactgactgcacagggcacgacgtggcatgcttcgtgtagtttcaaaacgcacaaaaaaaccatacacgcccgcgacgaaacgaaggcagaaggttcaaggagccccgtcgctagacctgttgaacaagcccatgacaccaagaggcctagcccgttaaccaatcctgatttcacggccccgtccactccgaccactcggcctaaccagccggcggccgcgacgcccgccgaccagaccagcggaaacaacgcgcgccgctgctgcggacggatcgttcacggcacgcgtgaatgcgtgatccgcctcggcaaaaccggggcatcctcgttcgtagccgcagcgggacattctccgaacccccttggtttcatacgtaccgtccgatcgagagaagctgagaaggtcatgcaggggttcggaggatttttctccgaacctctggagggtttacggccgccgttcgatcgagaatgtgctttcaatttactttgagatgataaacaccaccacagtgagttcggctttgcaaaaccaacacgttgttcctgttgaagttaagtgagaacactaaaaccaaccaactccaataagtgtggctgtgagcctgtgatagaggatctgctgatctactagtatgctgctgctgttgcattgccccaatattacaaaaacccttctactactggagaaggtgatgaacgaggcaaacgcacgcatatgcatatcgcgaatttcaccctaattcttgctcatctaccactaactaaccagcttcctaagctaaagtggctatggacctcgcctaacgacaaggatgctttgctgctcatgcgtcggtccacgcggcgaacattggcaggtgcgcgatggacacgccggccctcgccggcaccgagctcaccgccggcgagggcgaggcccaggtgttcagcggcaccgggctgtacagcttcgacgccgccgcgggcttggcgaacagcgtggcgaggacgccgccgccgccgccgccgccgacgcccctgtcagggctctgctcccgggagttgcccaggctcgtcgccgccatcgacatgtgcggcgcgcgcggcggcgcgcccgccgcgtccacggtcgacacgatgtcctgcagcaccgagaaggcgtcgctcggcaggaggtcatggtgttggtggccgccgtgcccatgctgctgctgctgctccgttctcgccgccgctggcagcgcggcggcggtggccatcttccactccgccacgttcccggcctgcaccaaggcggccgcggcgtcggcgaccgccgccgcgccgccgccgtcgccgaccttacccttgcgccgcgccagctcccccgggaggagcgtgctgctctccaggatcttgtccacgtcgtacctcgtgatgtcgaagttggtgacggcgttgagcccccggaacttgatcgccgccacgtcgtacgcctccgccgcctcctcctgcgtgcctgcatccacaaatacaaccaatcacacacgacgacgaactcactcaccatcaatcaaaagtaaaatccgagttttcgccgccgccgccgcgcgcggtcaggtcacaggtcaaaccggcatggcgcgcgcgccgcgccgcggcaaaagccgacgcgactgcggcgaggggcacagcctttggaaaggaagcgaacaaaaggcaaaccaaaccaaccgcgcatgcatgcgcatgcatgcatgcgcaaaagcaccgctgctgcagcaatcaaaagcatgcaagaaacggcagggcgaaacattctttcgagctgggccatggtggtggccatggccgtgcagaagcagcagaattggcatcattgaatctagccatagctgactgaaggtcttatgatcattgtgacaggacacaccctgcgtccttaaaccgtgacagcctctgcaaagccaacctcatacacactttgctgctcatcgctgatcgatcacatgatgagaagaatccggacaagaataactactagtagatcatagtgcagttgcagagattggggaggaagaacactcactgaatgtccccaagtaaaggtccttgttgcccgagacgcggccgattcgcgcctgccatctcccgtgctgatgatgcctgcaaacattgacagaaaacacaccaagttaatcactcagttaacatgcttccaagatccatttgccgtatttttgctgcaaccatgtgattaacaacgacctggtgactccacggtagatcgaagcgccacgcgagaagccactgcttttcctgcagcaaacagacatggaggtttacagatgtcagtgtcacaatcttgttcgttcagtgacttggcgatttcataggtagctacgcagtgtaccttctgaggtgagccacatactcctgcctgctcatgttcttcatctcctccagctcctcctggtagtcctccaactgcccagaaaatggtgaaaacaaacgtcaatgatagccgtaacatcataactacagtcattcacagtgcccttgagctagcactctaaaatctaaactaaaatgtgtactgtttgcttgcaagaaaagcaacaaatgaactaatcagagttggtaatttaatcaccgggaagttgatgtgcgtggaagggccccagtacttgagcgcagcaagatcatacgccctggcagccttctcctccatgtcatacccacctagcaaaggttacattgcaatctcacaatcaaatctttgtttccaaaaactaatcaattcatcccaagtacttgtgtactggtactcaccaagatacactgcagcccatgccaaaagattcagcaggatgatcatgcaagaacatacatatacatttcatcagcatttaaaacataagaaagtgtgattaatcacaatgtcaagtttctctaaccttggcgtccttttctggtctggccttccttcttgcagctgttgtcccagaggtgtgcctcatatctcccagtccacctatgcctgctttttacaaggtttttttacttgaggttaagtgaagctgtgaaggtggaagccatggcggcatggtggcgagaggtgtctgtcactatggcgctgctagctactacctggtgacgcctctgtactgcgacgtcctctggccgaacgtgtcaatggacttgcggtgcaccggctgcttctgcccggcgcggtccgcgccgccgcgcttcttgctcacggcgtccatggccatgtacggctcgccggcggcggcggcctgcacggtgacgcagctggactgggacccggccgagctcatggacagggtgagagggtgcaggtggccgccggtggggatgatggggccggcggcgcagacgtcgtcggcggcggcgttggcgatgtcgtagccgccgccgtgcatcgccgcccagccggccgccactgccgcggcggactggtcgtgcaccagcgccgcgtcgtggccggcgccggcgccggggatgacagcgcactgcaggaagccgccgccgccgtggtgcgggtcgccaccgacggcgccgccgtcctgggcgtgtccctggtggtgaccgtggccgccgtagtagaaggcggagttgtccaggctcagcgccatggcggggcccgcgcctaggaaatcctccagcttgggcgacgccgacaccaccacccctggtcacgagtcaaagccaaccaagcgacataaagagacgcatttgctacaagccaaagcgaccatgaacgcaactgtagccacagcccaagtaagaagaacccgcgctgtctagacgaacaccagcacgagctagccatctctctatccagctactacttaagctagctagctcaccttgctgttcttggtcgcctccccggagtgcctccatgatgcagagcgagccgtcggacttgagcggcatggaggagaacccggcgccatagtacgatccgccgccggccgcggaggtgacgacggcgtcatgcccgccgccgtagtagaaggaggaggcgacggcggcagggttgtagaacagcccacctccatgctgctgctgatgctggtgcacgtggtggtggtggtggtggccgacatcgtcgacgccgccggcgcagtacgtcgccatgtgcggcgacagcgagaatcccagccagccgccgacacctccggcggtggcagccatgctgccgctgctgctgctgctgttgccactggccattgcttcggttatcgatgaggagggattcaggaggaggaggaggaggaggagggaatgaggcgatcaatcattggcgagtacatggcgcaatgatgccgccacatcctccatttctatcgacgcgcgttcggtttctgtgtgtgtgtgtttctgtgcgcgtgtggcgaagcaaaccgtggtggcggatgaggcgaggaggaggaatggccggtgttgttattaaggggaagaaggagaggagagtggagtgggggctttgaaagtgtgcaaaaggaataagttgctgatattggtcttgagcttgacccgttctcttttttttttcaaaaaagaaaggggaaagagtagtactactacaacattctgtcttctttacctctatgttttgcatggggatctgtgttcgtagaggtagaaaatattttccatattgcccatattgcggtggtaatctcgtgggtaatatatcttgatttttcttagtagtcttattatgattttcttcgagtaacccgcgtggttatcgtgataaccgtgataagaatcggtaactaactcttatactaaattggcaggagaaaaccttcgtgatatcaactatagtagctaacctctattaagggtcttttgatttggaggaaaaaatataggaattttggagaattttaatcttgtaagaaaagttcttatggatggctttgaatcaaaggattaaatcctatccaatcctttaaaattactatagaatggacaatcatatagagattttgaaaggaaaattagcaagagctcaaagctcttggaaaatttctttgagttatctctctcattcgattcaggtgtttttcctaagaaatcaaacagtcatttctatgtttttttttctatgttttgcaattttttgttacggcttcaaaatcatgtgttttttcttgtttctttatttttttaatccctataatttaaagggacccttaaaaccggtaagtgaaaacccagggtttgatattggcgatattgtccaatgatatgtactcttacaacaccaaatctcagcttctgtttttgaaatgatccgagtttgattttttataataaaatgggataaagccggtctcaactctctttaaccaacccaaaattatatttttagacgatgagtggagtagtacgacgagagtaaagagattcatttgcaagtctataaagttaaccaacctttaaatggcatcctcaatttatgttgtgtatagctagaaatacacactagcgctttgtttagttccacgctaaaattaaaagtttaagtaaattggaacgatgtgacggaaaagttggaagtttgtgtatgcaggaaagttcgatgtgacagaaaagttggaaatttgaagaaaaaaagtttaaatctaaacatggccctgtttggatccggagggctattaaatagccctccagaatcttgctatttaggagtattaaacgtagattactgacaaaacgcattccttaacccctaggctattttgcgagacgaatctaacgaggtatattaatccatgatttgctacagtgatgctacagtaatcagtcgctaattat

SEQ ID NO: 68567 - DNA, 799 bp, Oryza sativa
aatggtagtatgagcttccggagaaggaagaaaaggaagatcaagttggctttcttccaaaacacaatctgcagcagaataaaacaaaattaataagcaatcagattggtaaaacagagctatcaacaagccagttgtttcatctagcaatcagattggtaaaacagagctatcaacaagtcagttgtttcatccagacatcctatcaggtagtacattattttgatgacaatgacaacaaaaggtgataagcaaattcatattctatcatggtaatgcaaaaaaaggtccagttgtaacatgcgcacaaatgatatacaattagatatcaacattttatattctagtgagatggatgctgctcgatgagcatgcgtctttattgaagtgtataaacctaagtacttgagagaaaaggctaatggtacaggacatatcaatatgtgaattaatatttcgagaatcagttaaagagtataaaaaaacctctaacattttagaatttcatcatgttaacatccttggagcatattcccgatgccatgagcgcgtgttgtgtatccaacaaaagcaccgaacacacttttttttgtcaagatcacattatttacctgttgatgttcaaattttcactttaagtaataaacggattaaatgatatatctgacatgctatttgaagacaaagttgcacagaatggatacgggaaaaaatgctgtaaagccttaattttatttcgtgtttgcattaacagatatatttatccagaccaatcggatatctcataacaacatttggt

SEQ ID NO: 68568 - DNA, 3288 bp, Oryza sativa
  unsure (1)..(3288): unsure at all n locations
nnnnnnnnnnnnnnnnnnnnnnnnnnnnnnnnnnnnnnnnnnnnnnnnnnnnnnnnnnnnnnnnnnnnnnnnctgaaggagaatagcagctgtaccagtacatctgtggatatctatgctgagactctctacagctcttgccagaattgcctggaatccttgttgaccttgtttcgacaagcgactgccgacgattttgctgagcaatccttagaccttaaagagccagtttttcgacaaattgctctagaagcagataatctcctttggttaactgagattttggccgacaggaatgctgctggtgagtttgcagtcatgtggtctaaccagggtgagttggctgagcttcactccaagttaccaaccaagtcgcgccatcttgtcagctgcgtcacagcaaggctctttgtggcaattgggaaaggagacatgctcccttcaaaggacacaaggaagcttctcttggatgtctggctgcagcctctcatggatgactacaactggttacagcatggctgcaggtcatttgaccgcaaagttgtcgaggaagggatcgggcgtactatcttgacactcccgctcgaggatcagcagacgatattgctttcatggctcgggagcttcttgaaggttggggatagctgccccaatctgcagaaggcctttgaggtgtggtggaagaggactttcgtgcggccttatgttgaacaagggaatcaatctcagccgggtcggagttgaggtctcaagtggttatagactgcaagaaaaaattgtcatcttttttcatgtagaatatcactgagaaagtagtggtaatgtcttactttttagataatgggtaatgtcttactcggtttgctgttagggagaaccccaggaaatgaaaacaaaatggggatgtaaattagtacttatcttgcaaggcttgagaatatgtgcgcgttgtgcttctgatgcttcattttatcaaatataagtgaagctctctgaattctggttgcagaatttcttatctgcttgttactatcatgacatcagtttgttgcactgcaatgaatattgcagcattgtgcaatagtagctttttttttactgtaatatggattcatgtacaaactcaatgtttacaatgcaactgtaaagatttccctgagatgtgccctctaaaatttgaaagaaaaacaaccttcatatttgaattttacttaatttacagttacccaatcgaattatactatgtgaaaataaagttggtacatttccttgttatgtcggcatattgttatctgtcatttccagatgatgaaaccatggtctcattgtatttcaaatggtattgcataaccaatcaaaactcaaaagggtgagcggagtgagtgattgaaaaaaaaattgttatttgtctgtcctatctatttgttgtttgtctgttcttttgttttctttttagctcactggctatcctctaggagttaataccaatatttttgtaacaaatctaataaatttaactgtggtggttggcatattgaatttttttggtgttttttttttttgggggggggggggggaggagtgtgtgcaaattgtctattttaagaatatattggatctatccggctatattttagaatatttcagtgtttttggataataagaaaagggtgcacgatctcgacgatttattcctgaacaaatacaggtgaagccaagaaatcaactgtaactgtttcttttcttttgaaagaaggaaatcaactgtaactttactgatacactggattaagtgtgtggcacaccaaacaactcaagatgacaacaacaaatttgctccaggcaagcaaaagagctctgaagaactcttctgccctgtaaacaatctgcaatgtgtcatctggatgcagcagacttatcaacaacctatagtagcagtataattttctcaggactctgaaactgaaaaacacctcgctgagtcactcactcgctgtagcagcttcaagctgaggcattccatggacttagctcatcatcctctggaactcatggaagtcgaggccgccgtcgccgtcgacgtcgtaggccctgatcatggcctcgcagtcggcgaccgaccgctcgtcaccgagctgcgcgagcaccctctgcaggcccctcgccgtgatccggccggcggactcgacggcgttgaacacctcgaaggcgctcctcaggtcctcttcttggctgtcacctctctccatcagggcaacgaatccggcgaagtcgagcatgtagccggcggcggcgccgccgccgcccggcgacggcgccggcatctcgtcgcccatggacgcgaagaacgcgctcagctcggcgccggagatcttgccgtcgttgtccctgtcgaagtgctggaagatcctgtgcagctcgccctgccttctccccgacgacgacgaacgggcggcggcggcggcgccgccgccgccgcgtgggctcgccacgtcggactgcccgcagagcagcggcaggccgagcctgaagctcctcttgcgcgacaggcgcttcgccggcttaggaacactcgcgttcgccattcaagaaacccaagaaaatgtagtagaaaagctgtgtggtcttgtacacttgtcagcaaatgccaaattgccaatgcagctatggaagaagtgaagaacaggtgaggtgtgctcctccatttataggtgttgagcaatcatctttgtgtgtgtgttttgacttgactgaatgccatgatcacaaggtagttagggctgcatctgcatggcaactaaccttgcacagtgcctcagatactgtcagcttggcattatctaactcccaacagacagtgccatcacatgctcatgatcctcgcgccgccgcccaacgaacaacgatatctcggaatccgtgatttagttatgagttcaagattccgttggtttgaattagtgctaatttgagagagacccttgacctgacgagtgagatttcagtctttcactcaaaaaattcagtctttgctggcttgcaggtcttcagaagctgacagggaagagtaaactgaatgcagtgaagcagtgagtgacttgtgaagaattcagattcagtagacatttcagttggtcagtgacttctccttgtatttcagagaaggggggaagtatctaaaaatagggaagatcattcagtcctaaatgattttcggtgatcatgttttcatcaaatgcccagatttgcatatttcttttcagtggatattgagatctgaagagagat

SEQ ID NO: 68569 - DNA, 4454 bp, Oryza sativa
atggaaagcttacattaggaactgagagtggcacatgtctgtgtagcatcaccacatggcagtagatgtgaccggttaattagttatagataaatgacctacctgaaactcatgattgggttcaagcatcgaaaatgaccggttagaagaatctttgcttgttagtttatgttcatccttgatttgaccggtatggaaaatggtatgtaccaacgtgatctagatggacctaacaaaacaaggtactccattgatgctccaatgtcaccacaccgaccacagcaataatgattctcgttgacaatacaccttccattcctatctcaatgcaatactgccatggaggtatttacacacatatctcaaaaaccaaccaaccaatcaagcatctattgtaatatataagtttgtatgattttctacaaataggctcccaaaaacagttacaaaaccagctcaaggagggtacatctagtaatttggcacattgttctgttgtaaatttgttatgtagttacattgtcagttcagtttcttctcggtatattgtatcatgaccgtctgataaacaaaatattgctgtgtgccgttttgggttgtatacagagtgggatcagttgaatcatagcctatcttccaccgaaaagacggtataattttatgtcctcgaagatgatttgtgaaatccagcctcaaccacaagtgaacatttgcaaattttttcgaacagcccaatctcaaaataaaaattccttaagtagcactttgtttactatcgatttttttctcattgacgctaatcaattctggcaccttatcaagtaatctgttcatctcttctgaaaattcaagcttggctcgatttgtctttcctccgatgactactgtacttccgtcttgcaatgcccatatctagacagaaatcaaatcgtaaatctgtagcagttttacaatacttatatttcaaaaataatcataggaagtgccatatgcacacacctgagaatgtgaaagataactaatgcaggtcgttaacatgagtgcaccaaatccagcatacacaataggaattcctggatcagtctgatggcaagggaaataaatacaaggcacgtttaatgatatatcaaacatgtacaaaatttctgcaaattcaaaacaatttatcaggagcactgaccttaagatcgagaccggtgctaccgatggcatcttcaataactatttcgttaccatctatttcaatcggtagttttgagcttggccgacgaacccccacaaacttaccctcttgatcatacaacacaatagactgcagatctcgagcaagcatcgatctacaagccatcaagagaagaagttaatagcttatagggaatgtgtccagtttatcatttagctccaaacaggggaagtgttaaaacttacattcctttgacattggaagaaccggagttttcaagtggcaacaatgttccaaataacttcttatcaccattcaatttcaagggggccatggccaaattgaaaggaccttcaccatttttctttacttgcaatgctgaaaatccccaatcggtttggtagattgtgaccccaccatacctcaaggggtcgttcactttgatagtcttcctcatgacctctttgccatcaaggtcgaaaagtgaaagatcgctatagaattgtgaaacctggaaagccaaaaatatttgccacatgtaaatctgacatcacacaagcatatgaaatgctgggcaaaattgactacctctccactatcatagtactccatgtagaaccgattgacatggacttcagtattaaaaacatcaggcacaaaagagagaactcctttaggtttcatcacatctccgattacaaagttcaacccttggggtacatccaccgatcctttaaagctccctgttgcgctaagcgtggcacctgccatgatgaaaatcatagctatgtgcacaccgataggcgcaaaccgaccagccagtcctttgaaagcatacagagatggacccttagtgaatacctgaaacacacatcaaacacacatgatttaaatgcatatcggagcaaatgaaatgcacagaatgtgactaaaatcacctcatatccataacccatcaatataactcctaaatcctggatggatgcgcggggaagtgactccgcaaattcttgcttccggatgcttcctgctgaatgcatgaacgaccatctgcaagaaacaattgatcagcgcttgcaattatctacaagtataactcatgttctgaattctgatcagacaaactatcattatcaagaagagaaaacctgcacatcagaaaatggccatttctaccttctggcaaccttgacaatggggatttgagtggtgtaagtgcaggccatgagcgacgccgcgagcagcgcgaggaggccgaggaacaccggcgaggagaacatgtgatcgaacccgggagtgaggatccacctccacgtgatgaacccgaacaccgggttgtcctcggggaacttctcgaagtagtagctcggcgcctccccttgatcaatcaccgtgcctgcaattgcaaatcgcaaattgcaaattgcaatcacaatcatgaataaaaaaaaacagcaatcacatactggcaaatgggcaatccattccggagaagctaagctagcgaattcgaagtagtatcaaataagcagcgaatcacctaaggccatgagcgcggcaatggcgaacatctcggagatggcgagcgggaggttggagagcagcgacagcgtcctcttcgtcaacctcctaaccaaccccaacgcggcgttctccttcctcctcgccaccttcccctccccctccccctccccctccccctccccgccgccgccgccgccccgctgcgagaccggtggcgcggcgtcgaagaacacgacctgcttcttggccttgccggttccagcaggtatggcctcgcgcttcaccccaccgccaccgccaccgccgcccgtcctccgcgcgtcgcaggagacatggacccgcctgcgcggcggcgcggcggcggggagggggaggcggggacggtggtgggacctggaggcggtggggttgaggagcaagtagcaggtcggggaaggcatggcggggtggaggagggagtgacgacgacgacgaggaggcgcatccgcatcgcgtccgttggctcccccgcgcccgcgcgaaaaatagggcggttgatgtggataaggcgcgcgtcgggtcgtacgtggagcggcgaagacgaaggcgtatgggaggaaattatcttgcaactgggccggatatttcgagggattaactaagggcccatgatgtgaacaacgacggccctggatagatgggccggttgcaagggtccagtcttcatttcatggtctgactagtatttcttgccagtggcagaggacggaaaaaatagtaggtgtggcccatggactagcgcgagaattcgagcagaacaagaagtaaggggaaaaaaacaatctcaatgcccgatattatatgacgcaacattatcccatcatgacacaatctcaagcatggcaacaagcactagtccaaagttcacaatttatcatccatttgccaaaattgtaaatagaataggcattcaaaaatacctcaagattccagcgttcagtaacacatataggaacaagtgaggatagtagataaacatgtagaaactgcaaaacaaatagcaaaaaataaagattgattagtatattatatacttgagattgataaggtaaacagctatgagtggaataaaatgtaaaagcataccaaacataaaatatttaattgcttctaggtctaggagatttaggcaattgcatttgcctagttttctttttatgaaatgcttttttgattttttgaaaatcaagtcctttgaatatatctctctcaatgttctgaaattgtcaaaaattcaagaatatgtacctcttttgtgaagccaatgcctttccttttctctttctatccattttgtgttgatttcttcagttgaatccttctctttcttttgttgtttgctcggcctgcctgcagcctgcctctgcctggcaccgccccgccgcacccaccctgccgcctgcgggctaccggcggccgttagcccgctcccctcctcgaggccgccctgcgcggcagcgccgccgccacaccgcacggctgccggctgccgcttccctccgcgaccgcgagcaagcccgccgcgccgccgcacgccggcgcgcccgctcccctcagcgccgtgacgccgttgaatttcaccgatttgactaggtgctcggattggagaattggggaaatagggattagggtttcaaggtcatggtcccactcccatttacacaaaaacaagtccaatgggcctaattggggtggggggggggggggg

SEQ ID NO: 68570 - DNA, 9860 bp, Oryza sativa
cttcttacgaaaagagtatttcttcgcatatgtgtctgcgtataatgaaaatgggaaaatgtgtaactctttttatattatacgcagtcacatacgcgagcgtacaccactacataagtaacaccacattcacacccctgtgaatacgctcctaacatatactcagagggatataaaaacctgcggtacatctctaatctcactaattacatgttagaatcacacctacatgtgcgcaatatttgtaggcatcaatattaaaatcctggtgggtgaagtcatgcatacagaactacaccatcccattaattatacttttcccgagaaaaggtgtaacttggctctcatttcttttcgatcaatttggtcaccacaagttttggggaaagtttagccactaggaagtgtgtgattctgtccatttcaaaaggtgtaccccccttgatggaatgagttggacatcgtcatgaccgaacaatacaaaaccttattatatttcgaattttgaacaggtattaggtgagtcagtgttataaaaaaaattgtaaatggaactagcgcatccgtgtgagcgacgggggcttatgcatggtgttcttccgtctgaattgatcggaagaaaaactgtctccagcagaaacgtccagtattatcgagaaagtcaagaaatcccctcctgtcaatccgatcgagctacggaagcacataaacacggccgtctctgtcatcgtaccagtcaccagtccacgccggttcaacagttaatgacgctcccgtcagctgaaaggtgcctgcgcccctgcaaatcattcagctgctgctgcatcctgtcgatctcacgcttcgttgaaccaaccgacagcacggcggtgactcaccccggcgactccgccgtcatccagaaccaaaaaaagccgtcctacgcagttttacgtgctactactaccgtcccaaaataagtgtagttttagcactattcatatttaacgtttgaccgtttgtcttatttaaaaaaaaattataattagtatttttattgttattatatgataaaacataaatagtactttatttgtgactaatttttttaatattttttataaatttttcaaataagacggatagtaaaaacgctaaatacggatatttatagatacacttattttagaacggaagtaagtactaaaattgcacgtatcgaattcaaaccgaacctctgatcgcatcgaagcttccattgccacgttgtgtctttggactgcagagacgtgctcctacgcggctcttggggctggaacccgcgccgccggtttcgagcgtcgtcgggcgggcgttcgctcaccgcggctccgtcgccaccggcggcgcgcggcactcgcgcgcgtttgcccaactgaatcaactgaagtgatgagttttctattccaaaatactatatgacgtggtagattttcctacagcgtttaattatttatcttattaaatattatttattttgttatcacttgtagcacaatattattttatgattttgaaatgaaggtacgtacggcatcgagtagtttcttcaaatttccttgtcgaggctgatggataggtttgctgcctgccaagatttaaacaagcaagcaggaatcccgttttctaacaaaaaaagcgagattggtagtatttctatattttactaccagttggcgcaccacgcaggatgaaaatatttgtaaaaggcgacggcccgctccagcggtccagccatgatagcaactcctctactgcacagtagtgcgatgaaactgatgatgatttgtgtgtactaattccactgaaactttcaaggctagcagtaacaacaactgtaaaaccaatcagcaacccaatccaaccttcctccgtccgaccagggcatgtaaaattctgtcacgaactgtgtaccggatgccacgtcacacagttgtctctgactctgtgactcacgcgccgccatctagaaggataacaggagcacgagagtgagtggtgggcgcgcgcgcgcacacaggtctttctcaattctcccctttcctacgcagttttcgcccaccgccgccgacgcccctcccgtcccgtctcctcttctcttcttccgcacccaccgttgttttgaccctgttttcacaaaacaaaaattttttcactcatcacattaaatgtttagacatatacatagaatattaaatgtgaaaaaaaatcaattacataatttacgtgtaaattacgaaacgaatcttttaagcttaattgcgtcatgatttgacaatgtgacgttacaataaacatttgctaataacatattaattaggtttaataaattcatctcgcagttacctggcagaatctatgatttattttgttattaaactacgtttaatattttaaatgtgtatccgtatatccgatgtaacacaaaatccaaattttttccccatccataaacaaggccattgtataagaggcagccctaccctccaccggtgagagctccacgtctccaaccaaattccatcgtcttcaacccaacccaacccaaacaccaccatgagcagggggaggagcaggctgagctggctgtggagggcgccggcgagggcgctggggagggcgcgggacatgtacgtgcgggggatgacggggtgcgcgcgctgcgtgccggcggacgccgcgttcggctacccggtgttcgtgccgtcctccgccgccgcctcgatgaggagcaacagcttcgggtcggactcgcggttcggcggcggcgccgacgacgacctccgggagctgatccgcgcggcgtcgcagaggcgcgccgcggagcaggagcgggaggcgcgggccgtggccaggagccagagcatggcgtcggggatctccatggcgcggatcgacgaggacgcgccgtgcgaggagttcggcgacgccggcgtgatgcactaccccaggagccagagctgcgtcggcggcgtcggcgggaggatcgctcactgtcacaggaaggtggcggccttggcctgagctgctgcccgccggtcgtgctcgcgacggtgttcatcgccattaatggtcttctctggaggtctagtagccattcaaactttgggattttgcgtttgtaaatatgatttttgttgagaattcgtgagtcgtaattgctatttttgctgctgcaaaacaggggcaaatgcaagaaactgaatagtattttcggaattgctatatgtcacgcaaaagttagcttaacttagtttttttttcccttttagcgtatggtttaataattcacctgtcacgttacgcactcatctatccaaatcccccacgtaagcatacaccagttcgttaaacaaaaaacagcgccaccagcttggtatggccacgtctgaattgaaagcaggactgcagcttgccaattgagtacgcctaatccaattaagtgccaaattgtagaaaattaacggccaaactgtagctaaatttatgtagcacagtggagcagtggacttcattctggaatgcacctatcattagtcaaagtacactagttcggcttcatcattagtcaacggcaacatctaaatatgagccaaacgtcggctgcccaatggctcatttgaaacatagggggtggattttagaaatacgtaaataggaaaatttgtagaagtgagatgtcaaataaatccggcagacatagaaaagacagaaatttacaaagtgtttggatagctgataaggacaataacataggatttttataggttttagagagagaagagagacagagcattggacttctcgaagaaaaaaaagtttggagctcctattcaaaattccctatggaattggagtataggattgcaatccaaatgaattttcctatgttcaatcctatattccaaataacctagcaaggaaattttccatacgatttaaatcatttgaaatcatcaatcaataactcccctaaccccaccgtttttctccttttttttgaattatttttaggctccttgtttaatttagacgttgtcttttactgttttgggctcctcatgcagattagcttgactgctaataagcagttttcggttagtgtactgttcaaagattactaagctttgccttgtgtccggtaccatcaaccgggtgttggatgtttatgccgtgcatgcagggcacgtatgctctatgcgttttttcaaaaaaactctcaatcctctaggaaacaacgaagcagtcctcctggagattcatccttattctaatttttactaaaaaagccttacctttatatgaaatacaatgtgaagaagagaaaattcggattttagggacagcgctgtaatcccaaaaagtacgagggcattctaaaaaaacagatcctaatccaatccctcctctttctctgctgccaacccatccccaacacgcaacatctctctgcccaatcctcctcccggccaatccgccatccccatccccggccaatccatgcggcctcctcctcccggccgggggcaaggacggcgccggcgtttacaaagacgacggagcaaggggacgacaacattgccgccctccaccatgcctcctgtgctgccctcctctaccatgatggcctcctcgaccttgtggttgcgtccacggggggagggaggaggcggcacccgcccgagctgccgccggtgctcccctcctccttctccatccacttgtggtgacggcggcggcgggtggagggacgcccgctgaatccgccaccggttctccttccctccttgttctccctccacttaggccggcggcggcggtggtggcggggggagggcagatccggcgcccgacgccggcggatccgccgtcgtgccccctcccttcccttgtggcggcagtggcgagggtacctacgttggcggcagagccggctgcgcgtctgccgccgatgcccttccctcatggcggcgtcggaccggccgcctgcgcaggactgccgtacgtcttcccccgtcgccgcgttgcctctccgtcctctcctccgcagcttcccaaccgttcccctctcaactctcgacctctcctctctacgtggaacaccatgaccgtcgccgccgaggtcgacgcatcccctgacggagaggagaggaggaagcaagcttgcaatcgcacaaccatctatcgatttctcccttccttctctttcttctttctttctttcgtttccccctctcacatgtcaggttattttttctcctcatcctctccggatgatttcacttttgctcgaaatctctcaggttgttgttgtgttgaaggtggcgaagggggaaactttggtggtggtggtggccggagtggaggatggcggcagcggtggcgatgcccgatgcggagcggcagcggcagtgacggcagcgggtacgacaaggccgggatggactccggcaagtacgtgcactacacgccgggtcaggtggaggcgctggagcgggtgtacgccgagtgccccaagcccagattctctcgccgccagcagttactctgcgagttatccatcctcgccaacatcgagcccaagcagaagatcaaggtctggttcccaaaacagaaggtgagcaaaagcatgcagggatatactatcaaactggtttgccttttgtgtgtctggctgtgaaatgttctggacaaattggttgacaatggagcaatagcaatagtagtgttcaattgtttgccttggttgtgcatactctgcttcaactatatttaggaattgcaagtctatgtatttatttgttttgcttcctttcttgcataatggaacaacctttatataatcaaggaagaatactgtacttaccagagtatgtgccagattaagccatccattaattagatgctgaagtaaactatatgactatattgcgatgtattctaattccactacttacaaaactgtagggtataagatttgcttatttttagaagataggctaaacgagggtcatttaggtcacatggccaaactaagacacatatacataacgtattatcatgcatctgatagtaatgcaaaacaatgcagtactatttactttcactgcaggtatttaggctctatcttttatttttctcaagaggcacttaacatgatatacaaaatttgaagagttacattttttaaaaaacttctatgagttctgcctaaatgattgttatccatggtgtgcctaaataattgttcgatctagaggtgatccaaagattcgtctatattagacgtaacaataatgcagtgttttttttgtttattttttagcctacaaatgtttgacaagaagaggatgaaagagtgacataggcgagctctgtagcatatatagaatgtttgctatccactggtacatctttaacccgagcctacctactgtatagatgtgtttagtacgtgcttactatgcttaattttggggataatatagtacgacgtgtaagaaaattcagaactatgttgtatgctctagctgaatttgtttacttcctacaaaaaaatggatgaactactgatccagttcatgttgtgatcctcctccaaggagtttttttttgtttctttgctatctgaaagattccttttttttttttgctttgttgaagtggaaggagctcattggtgtacctttgttgaaatggctcctttgcatcctcattgtttcacatgtctgtttcatttccgtttttaagggactggccttattaaaggttgtttaaaagcttgaacaagacttctatttgattgatctttagtccctattttacctaccaggtgaattgtcgcctcgggtaagatattgctaacagggaattaactctatttcattgccttgtaattaacttgttatactaaatcagaagattctccggaggaggggatcagggggagaagaaaccaaagaaatggcagcaaccctcttttttccggaggcgatacattgatactacttcgatagtagtagcagtagtagtcgtcgtctatatggatatagaacgctacagagttcactactgctttagctattgatactacttcaatagtagtagcagtagtaatattttggaactaaacacggtcatatatataagcaactgcaacgaggctatagggtcgtaaacaattcactgacacgtaccgggcctctccatgtttcatgagacacacgtcatacatgtagcatgaattatgacggtaacagtacactattcactatttatataatcttggtgggccacagaagccggtggagagtgtcaaagtttacaagaagactcatctcccagctaaggaagcatattttctgcatcaaatcctctttttatgcaagcaaattaggcattaataagtatgttgttgattatatgataaacaacttatactatgaacaaataaaatgcatccgtataagccgactctgtttacttgcaacctgtacactaaccattttaactgtgcgtttttttaatccatgtaaacaatttgcatgctcgccaagtgttgcattctctgttttacagacatgctacctgcccttgcaactgtttagtgaagaattttagatatctactcggctaattccacacgaaacacaccttcctcttcattatatcatctccactcattgacatacgtatctaaacccggaaaggcaaagttaacttaagcgtaaagcccagaactaatagcccaccgataaaataacttttcaacacgtacataggctggtgaattgtactcttcacaggctgagctgaaccttaggttggctctaagtttgtctctattagcatcatggataaatgcacaaaccattagacaaatattaattactcgttgcaattttatttaatatacgttctgcataataaacctattggttctcgttatcaaacccatttacaactaaactctgcttttttgaccaatctctgttgtccttacatcacatgttaccatttgctttttcaaactgccccattttcacctgcccttacttcataaaaaaaatctttcccaatttctgttaaacaaaaaagccccatatcatactgtgttgttcaatcaaattaatatacatataatataccatagcgtaaggtctaactgaacttgattacgtacacttctacctacgcaagtgttagcgtgcgcggcgtggcgccgcgctcgcatttctagtttataaaacaactctccattccaaaggcgccctaattggaccgccacatatgttttaatcgcgtctagcccactgaatgtagtcctcaagtatgctaggaataggttcactttatgtccaccttaaaatcattcgaactgatgtgtctctcaacttgtaaactggtgtgtctgaggtccaggagcagtataggggcaatatagtatccggttttgactaacgtgacaaattaattaatccccgcaccaaatccgcagcctcggtatttgcaacattgccctacacctccacgtcgccctacaagttgagagagatagagagatggggcaagacaggggagagagggagagaggagtaataagactaggtctctgacatgtgggtcccacatagaccccacactgactcagctaacctgatcatagtcaactagcatggtgacccgcgcagattgcgcggctagcatcattatattttatctcatataatagcatatatgttttctcattatattattcaaatatattaaaatgacaatataattttaaattttgcaataactttacaaaactactaatgtgcaatattcatattatattttatatacgtgttagttattaattatttttaatatcaaattttagttatttttaaattatatatattcctatatggactctagactcgtcttttaatatatttttttaattccgaattttctgtaaattgtatttctatatagactctatgctcttcttccaatattatttatttttatttttgaatttttattatttctaattgtatttcaacgtgggctctactcatctttcaatattctttaatttttaatttcgaatttcagttacttctaaattgtattctatattgactttaaactcttattcccatgtttttcttaattttgaattttagttatttgtaaattatatttttatacggactctaaactctacttttaattttattatgtttattccaaattttagttagttttaaattccaatatggactctatactctacttccaatattccttattttttaatttcgaattttttttcttaattgtatttctatatggaatctataatctacttcaaatattccttatttttaattttaaatttctattatttcctaattgtatttatatatggactctatactctacttctaatatcccttatttttaatttcaaatttcagttattttctaattgtatttctatatggactatatactctacttctagtattccttttttttaattccgaatttcaactatttctaaattgtatttctatatggactctagtctcctcttctaatattccttattttttaattacgaatttcaactatttctaaattgtatttctatatgcactctgccttttctttttctccgattaatgtgagaatttctaggccatgagagcgaacgtggaggctcttttttctatttctttaataatataatagattcttcatgtcagcgaaaaccgaacacaatactgttttaggacctaaggaccctaaggtgctttggttttgcaagtcgaggaacacgtatctag

SEQ ID NO: 68571 - DNA, 2527 bp, Oryza sativa
attcctgcagcccagtcccgttcggattacgcgagatttcttcgtgcggaccacaaactcaaccaactccgtgtaggccccacaattccccatcgccattatccgccggtcgctcgccggagtccccacgaaaaacacgcgaagggaaaaaaaaagggccaaaaaaaaaagaaaaaaaaacagagagagggagaccggcacggtacgcgcaccgcaccacacgaaccaatccgaaaccctagctccggcgagccgccgccgccatggacagccgcctcgtggccttctcccaccgccgccggcgctggatcctcctcgcggcgggcggggcggcggcggtgttcggggcgtacaagatctaccaccacccggccgtggcggcccgccgccgccgcctcgcgcggctggccggcgcggtcgcggccttcctcgacgccgccgcggcctccgccgacgcggcggccctggtggcctccgacctctccgacttcgtccgctccggctcggacgagctcccccgcagcgtcacgcagctggccaagctcgccgcgtcccccgaggtctccgcgaccgtctccgcgatctcggaggccatcaccgccgggatactccgcggagtcggatccgactccgggcccggctccggcggtggcgtggccctctccgatcgcctcgtcgacaggctcttctcggagtccggggagcgccttgcggctgccatcgccgggagcttcgcccgccatctcgtagctgctatctactccgcctcttcgactcccggggagacctcctcgccgatgaagtgggtcaacttgattgccactggaaagggccagaaggcgattagtaattgggttgaggtgttcgtgagcacagccgtgggggtgttcgttgacaagacaatccacatcaatacctatgatcagctattccaaggccttaccaatgcaagccatgatgctaaggttaaagaattgcttgtttcggtatgcaacggggcagtggagactatggtgaaggccactcaccatgttatgtccaatgccaattataaatcggttggcagtggcagcaatggtgctggggaagggtgggtcgagacagtgtcgagcacattggcagttccaagcaacaggaagtttgtgcttgatgttactggtagagttacatttgagacagtgaggtcgttccttgagttcgcactgtggaaaatgcacgctggggcgaagaagggtggcaacacagtgatggatagcggactgcgcgcgatgcaatacatgactgataagtctatggttatcgccacaatatgcattacactttgtttgcatgttttgaatggcactcggctcctggtaacagcttgatgatgtgttcaagatcaacacgggtgtatttggattgcattgttggtacatgacttgtaggaaaatttatactgaaactgtaaattcatctagaaaagaagagctgaaatgacgtaaatgatttcgtgttgtgtttgagattgttattcaaaactgctgtgccgggattgttgatttgttgtgcccttggggaagtgtatacacgggaacttttatagtgtcatgtgtttagattgttattcaaaattgctgtgccgggattgttgatttgttgtgcccttggggaaatgtatacacgggatttattgataaaggagatgtgatttgcattttgaatgaactagtgtcattgttacatcgctgatatcatcaggcaatttttatcagtttaagattgattatgcccattactaagctttctggtgatccggttgctccaccaatttgcgtagttatgtatttcgttcttgttaccaaaattctacttccaccaaattgtttgttatgttgcagcatcttttttagccttgtattgtccagctgaactcaactttctcatgtgaagtatcaagtatctaaagtttcggtttattgttctgaaccagtttagactagtcctgagtaaagaattagcaatttgctatccatcttgagtatcataaaaattttagcaggtcatacctagtgtatattatctattgatgagatctcacaatcagtgctctgtagtgacctttattctttgttcttggtccaaaagataagactagtataccagagcttagttcatcctatccccatgtgatgcatcttggtattaggttcagctggcagtaataattctcaagtggtttttgacaccgtggtagattcagttccttttaattccttttggacatatggactgaaaggtcagaaagaggaggaaagtaacttttcattatccattgtggatttgtggttggcggaggccgttttatacaattttcagtgtttgtgtgtttgtcttaccaaagtcatacaaatgccttttcttgttttctctgcaaaatctgacatatccagttttacactttagtaattggaatggccgcaatatgaggttcaagtcttcaagaagacttgcccaacgatgtcatctgcaccatgtttatcatgta

SEQ ID NO: 68572 - DNA, 4479 bp, Oryza sativa
gccgccacacgtcgccgccgcgatccattgccgtgatacgcttcgcttagccgcatcagctataagcttagctaagctaagctacctcacactcatcagctcgcctttctacgagcaccaccacgctgtggccttatcactcgatcgactgatcggctactgatcgatcggtgacaggctgagagaaagccaagctaaaacagcagcgaaagcagctgcagctagcaaaggtgaagagagagagagaagaaaaaaaaaagcaaaaccttaaaaactaaaggtgagatcgctgtgtatgcaatcgtctcccaaatctttgctttgccgtgatggttctaatcaagcaaaaagcctcgccgtggcctacctatccgaacattacatgtagaaaccgcagctttagagcctggtccaaagcaattttttttcctgcctgtccgagaagaacaccccatgtgtacgcttaccatatgcatatgttcatatatccatctgaatcctggctttatgcgaaagtttgcttttggttcttgggcagctgcaggtttggttaagtgtttggtcactagagcttcttcagaaaaaggaggctctagcaaactgtagctgtggaatttcgatcgatcgatcacacatgtcgtttttgtgttggcactgctgcgtttcttatccgcgaattaaagagtggtcgtcgctggtgaaatggtgattcctagaacagtgcagaggggggtcaactcggatgccaccaaaaattgcaggataaaaaaatggtgtgctttagataagatgatgaaccaagtgttgagagtgattaggacgcatggttggagtgctttattgcggtgtcttttgaagataatatgttgattatgaccacagaaacagggtggaagcagagtgaaggagtagcatcagttgggcaaatatccagtgcaatccggccgggtgcattggcatagaaaataaaaaattattgaaaaatcgaggtctacactgttaaaaaaaatctggtctaatttattttattagaggatgagggaaaaaaattctgaaaaagaaattggaaaaaggagaaagaaactgcacatcggaatttgtattgcctaacgagttcagattaatttctttgacagataaatccatgttctgtcaatgttattatactctttcatcaccatttacatcatatttttccagacagagggtccgtgcacttctaagagtcccattggttggtctaataaaccaaaggaaaaatcaaaatttgaatttttctaacttaattttaaatttaatttttcaagatatttttgacataatttttttagcgttggcttttaaatcactacgaacaaaaacgttttacctataaattaatttttattctctaatgaaccattttggtttattagggaatatggacgaccgataaggttcaaacttcatctgcctttatatgaggtccgatcgattggcaaagatgtgtaaaatggacatacaaataaccttttggtggtatacaatgcaacttgttctttttttcaacaaaaggtgtttgctatatctcgtgttgcatagggatgttagtgagtttaacgcggactatattctctcctttcttggagagaaggataccacaatttttatgcatttattggattcccttgagacaagtaggagtagttgtttcttcttcttcttcttcttcttcgaatagtggctgtttctcttttcacctcaatcgttccttttctaatcaaatcatgctgataggcgccattacctgtggaggactaactaaaagtaaatgacagccaatcctgtcaaatattaaagactcacaagcacaatcccaaagtgcagaaaccatagcacaaataaattgtggtgcctttttgtctaattaaattactcactttagctcatcacttcatcagtcctttctggatgtttcctttgctacactactgaagtaacattcttttagaccactagtactagtactatatactccctccgatcaacgacacactctacaagatatacctttaaccttatttttctattataatatatacaataaataaatgcatgtttacttttattatagtgttttaaaaaacaaatctagtttctttaaactaaatatttttaaagttattgatggtgaaagttataaaagtttaacctcaaccttattcaaaacgtcaattaatatagaatcagagggagggagtagcacttaaacctaccccttaattgcattggtcaaataagtaatacgtctaggtgtcaagctgctaatcgaccataaaagcagattagtgcaacaaattaggccaggtgtccctacggcttatcaatttgtggtttcgtcgacatgaccggtaaaccggccggtgtacttgttgggagggaaagacaaaaaaacgagttcatcatcaggcagaaacagtagtagcaaaagtaaaggtttttccataatcactaataatgcaatccaaagcttagaaaaaaggcagagtttagtttgttctgatgcatgcaagcactacaactatatagctccggtagtgttgttgaactggatatttagagtgacattgtcctttagttagctgtcgtcatggagcccatgatgtacttaatttgtcgatcgatgatggtatatgtcaatccttgttaaggtagtggtatgcattgtagacggtgatgggatgcagctcatcagttgcccataacatggtcactcacttagtcctggatagatactcttttctttgtactagagaattgctatttagtcgccggccagcagcaaaataattaacaacatccttgagttgatcgatctgtttgcttgtaggcgcaatgcatacgacgaggcatacgggtcatacatgtaagtgcaatatagattaatcattgttagaaccaatataacagattttaggttaattcataagtttgactaaattttacagggaagagtgtattaacgtcaacgacattgataaaaaatgaaaactaaaaaaacttatgaatctaagatgctcatttgatattgtaaatattcttttatatatagaaatttagcttaaatttacgacaaggcaatatatacccttgtatttgggacggtgggagttccggttcctctgcagtaagagccactattgatgtgagtagaacagtgaacaacttcagtgaatatatagtagcactttactgtgactatacagtatgacatcacttgttttaatttttaagacaaatttgattaattgtagctcttttattgtacagtttatccaaaccattcatgacatatcaaacgattgtttccctagtacgatatattgtagatatgtaagaataactaacatcagcacgatactcttgtatgtattagttctagtacctctaataatagagatatatgataccctgttggtatcagatctgatatctatgtaccatgctgacgtcagtatgataccgtaggtatcgaatctgataccttcgatatcaaacatgatactctataggtattaaatctgatatctaggtactataagtactacacagacgtcgttatagtatttcggtatcggatttggtacctttagtactagcctactaggcatgatacaagattatatctggtatcatcatgataatattattatgatattagccattccgttaaaacttgtataccgttttgtagcatttctgtatattttagctctttgccgtattacatgctacggtagtgaatcccaagtccggagtatataccatgtgcgacacacgtgctggcagaacatgctcgatcctggtagtagattcatgtactccagttgttagctcgactgatcgatcgcactcatcgccgaaactcgatctgtcacgatacttgctttaatctcgatcgattagcaaccgaaggggacactcttgaaagtgcaactaatcacatgaacacacagttaattacttaatttctctgtagcaactatcaaacgataaccaaccatatgtttgcatgcagcttgcccacgtacctgatgatcactctcgtacagttaaagttaggcacagatcaccgtcatcacttggcacgtatacgtgtaacacaactacattacccacctaaacacgtgtcacccacgctttgagctcgccgctgtcacgtttttttccatgtgagatgcagttgcctctcctctcctctagctaggacatgtttagttgggaaaataattttaccccttcatatcatattggatataccgatatatatttaaagtattaagtgtagtctaataacaaaacaaataacatattcccttattaaactaaatttattaagcctaattaatctatcattagcaaatgtttactgtagcacaacattgtcaaatcatgacgcaattagacttaaggcctgttcactttgataaaaaaaaaacc

SEQ ID NO: 68573 - DNA, 5076 bp, Oryza sativa
tggtaaggttgaaaagggagtacctatacatctttcgaaagatttttatgatcgtatcacacagatttttaatctttggattaaaatccgatagatataataaaaagcaaaaagcaattaagaaacaccataatggacactaaattaccataacctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgggttgaaaatgacatcaaagtgaaaagcccttaaaaaattcgtctcgtaattttctagcgacctgtataattgtttttttctacatttaatactttatatatgtgttcagacatttgacagctaaaaaattccatcgcgtgcatgtgtgtgcatcgtgattcgtgcccgccgcggatacgacaataacatatgccgtgcatgccaggtggcggcatccgccaccaccaacggcgacacgtaggacggctggagggtcccgcgcgtcagatccgggctgggcttgtggcgcacgcgcctgacacgtgcgcagcgtccgcgagccatcgatccggtgcatcgcgcggcggccatttacttcgcgattaagctaaagacgaacgacgacgaggtggggcccacgcccacgtcgcaccaaccggggcacccacaaaagcagcgcgaccgcgacgtcgtcatctaacgcggacgcccatctccaccgtccgatctcgccactaggagtgtttccaaccgtcggatcgtttgcgcgcgtagatacggatatacttgtaagcgaggggtagaatctctctctcggtgccacagctttaaagttagtttttaaaagttacggggggaaattttaactctcacgaagaagaagaaaccccacgtaaccgttgggcccgcgaagtgggtggggcccactgctcgagtgtcggggtatggtctcgggtggtctgcctataaataccagccatttcctcatcgttcctcccttttccccgattctctacttcccccctctagttttctgaaattgcggataggtccttcttttttgtgtgttgggacttgggagagtgagaaaaatgctgtcagtgcaggaggcgcttgactttgacctggacgcgatgacgtccgggttcgggttcacgccgtgggcggctgacacgtgccctaccttggagcagctgatggcgtcgtccgcgtcgccctcgccgtcgtcgtcgcttgatgacaacgcggcggcggcggaggaggagaacggtgaggtggaggaggaggaggagcggaggcggcagcggcggaaggtgtcgaaccggctgtcggcgcggcggtcgcgggcgcggaagcagcagcggctggaggagctgcgtggggagagcgcccgcctccgcgccgagaaccgggagctggcggccaggctgcacgccgtggcgcgccacggcctcgccgcgcggtgccagaacgcgcgcctccgcgccgaggccgccgcgctcgcccgccgcctcctcgcgctccagcggctcgcccgcggccgccacatgatgatcacggcgtcgccgccgcagttctcgcgtcgctgatggcgtagaaggcgcacacaggtgaagttttggaacggacgatgggtaactttgtcgtgagatggaatggacgacgctgtgcatggcgcactacttagctagtgaaaggggtctctcgtgtcgacgtagtatacagtgcacgtacgtgtacattgcatggacgtatgactgatataagtacatggaacttgatgtaaattattacgatcactactaccattctaccaaagttaaaattaaatatattaccagtttttgttgcatcgacgacgtcgacgcctgtacgtgtccgaatccacgtgctctcatttttgtaacgggatgatcgaggactcgatcgtgtgtactgtctgtgggcaaacggaaaggagctgtccatgtcttgtttgtacagcgagattaggagagccacaaatgagatcagtgtgggacactagttgtctacttgcttagttgctcctctcgtggactccaaattaatcatactgtgggtcgctgtgtatgcaatcgaagtaacccggcaaatacgacaagcacagctgcacatgtccacacacaacacaatgcatagcagtaacaccaacttgctaaaacagtgttacgcgaaatgaacaaataaattgtgcttgtataaaaattttggctagctgtcgcaaaccaaagtaggagtacctagtaccggtaaaaaaacttgttaaacactcgtgcgtacggattgaatcaaagccaaatagcacatgatactcaacattactgattactactactactacttagtatactagtataaaaatttaaaatagtgttcacttccccctaacgttgtgttttgtcgtttctttttgagaatgactcatatttatattttttgtactttgaatttgcaaaatacttcaacaataatgtcgtgttctttcagtaaacagctcgtgcagatttatcctagagtggccctatgtggtatcctaatttatgttaaacctagcaagatcagttacgatatatcctaatttcttctgtcttggttcataggcaccaaagaagttcatgcatctgaacaaacattttacattttgtttacgtactacttcctccgtttcacaatgtaagactttctagcattgtctacattcatttaaatgttaataaatctaaacacatacatatgtctagattcattaatatttatatgtatgtggctgtgggcaatgctagaaagtcttacattgtgaaacggatggaatagattgatattacgcacccacaaattcatgtaggagtacttcttactagattgatactacacaggaaaacttgttcatgtggtgcttcgatccggtgggtccgtcagtcagccggtcataaggagtaccgttgtgctagtatgcgcatgcttagctttttaagcgccatgtttcttccaagtttcgttatgtaaataattttatcaacgaataaaaaaataagtgtttaattaaaattttgaaaatttgaggtagaatttgtttattcaaattttagtataaacattttaaaaattatgttgaaatattcaaattttggttgaagttttctaaatgttcaatataacgttttaataactgagttgaaagtttcaaattttcagtagaaagtttcaaagcttttattgtgaaccacctaataagagaaaaacgattttgctatatctcactcgaaagattttttcttatctctcactcgattttctcactcaaatttacagttcattttcttgtaagttacagtgtaatttatgaaacttacactgtaacttttgtaagttacactgtaatttttgaatcttcgcatgtaaattttaaattttgtattagatttggtctttttcttgaggatatggtaatttattgtctattatggtttttcttaattgctttttgtattttattatatatatcggattttaatctaaagattaaaaatctgtgtgatacaatcataaaaatctttcgaaagatgtataggtactccctataaatcttgcgacagatttcatgttacatatcattcgatttttggaccgtttgattgcgtcaagattcgtgcttacacgggtgggaaaataaaatgtgcgtgttcacgtgtaagcgaggagtcgaccgcacgatctcttgttgccgaacaaaggcctttaattttaccaactgagcaaggaaccaatattgattttgtatctaaagaacagacttacatactacgtacaaattaattacagtgtaattatgtaataatcacactgtaactactaaaattacagtgtaactatactaaaattataatgtaactatactaaaagtacattgtaactttttaatgcatatgttgatgacatttttatttttttattaaacctctttagacttataactgtcagattgggtccgttgttacgattaagctagcccgtttccctcttcaacgtggcgcacatccatatgttaaaaaatccgagtgagatgaatgaaaaaatcattcgaatgattgctagacactcccgacccaaaatgactccaggcccgcttcggtcggcatgcgcacgtgggcatcggcgctccgagtcctacgaggccggaggtagaagagacccacaagggtacgagcaaaatctgaaggaatccaatccacgaacggcccagcaagagcccaccatactatccagcccgtctcatctccgccgcttaaaacccccggccgccggcgaagcccaccgcaaatatcgcaattagccctaaccccctttcttccttttcttccttcctacgcacacgcacgcagccgagagcaacggcagcggcaacgggggcggtctcgccggaggcggtcacggggggatcgatgctggaagagaggaagctgttcgtggcgggcctcccgcagcagacgcgggagggcgacctgcggggccacttcgcccggtacggcgaggtggtgcacacccgggtggtgctcgacatggccagcggcaacagccgcggcttcggcttcgtggagttcgccgacgaggcggcgacgctgagggcgctcgccgacgacgagatgcccaaccacgtcttccgtggccgcaaggtgaggcgacccctccccccgctcgatcgcggcttgccgctgtcgagatcgatgcttgttgattactgctgattagttcaacctgtgcttgtttcgggttgaacctggcttgctgtgatcatcgggcggtgtctattggattagtagattaaatgtggctaatttccggttgtatacctgggtttaccatgatcatcgggtggtggattagtattaggttagtagattacatttgttcgaattgatggggttaagtgataaggaagctt

SEQ ID NO: 68574 - DNA, 2544 bp, Oryza sativa
atagggatgaaacccatatatatatatatatatatatatatatatatatatgaaaataagcttgataggttacatctgtggaatcaaggttctatacttctattcttatgtagatatagtaaaatacactactgaaattaatgcattcggcaaaacttgcaaccacaatgtaatttacaaaggagttaagcttgtcgtgataattttgttctacctaattggaagttttgccacctctttgtaatttacaaacgagttaagcttgtcgtgataattttgttctacctaactggaaattcccttagatatcttctgggtggtgtttactttacatctcacacctttactcctaagcacattggagttatgatctagttttgtcattatttgagttttatttgtttatataattatttttagtatgtttttaatcaaacaacttattgatgcatttgataggttgatgttaagagagccgagcgtagacatgatcataagcaaaccagtccatctattaagaaccaaaacgacagcgtgcagaaaaatcaatttatttttcaaaagaaggtctttgttggtggtttgcacgaaactgttacagtgaaggacctcataagttattttgagaaatttggcaccataacggatgctgtggtcatgcgtaatagaactacaaatagagcaaggggatttggtttcatatcttttgattcacatgaagctgtgtgcaagatactactaaataggttccataatttaaatggaagggatgtcgaagttaaaattgccgtcccaaagagtccaacctactcagaggcaaaatattatcacatgagaatggatatgagtttaagtcctatcacttattatgatggaatggtccatgtccatccatacacaccatacacatttggctgtgttacacctcttgctcacttaactcattcaggttatggttatggaggacctattgattattcatgttatgcttatggaggaccaattggacatcagcatgatcttgtgggttcttactattatgctaaagattatagcaaaactactcctatcgacctcgataccacagataccacaaagaaatgacttgctggtgagtgctacttatgtggatttaattatttttataatatattttagtagatcaatagtctcttatatctttaaatttttacttgatttgctaccatttgtttatagtgtttcagatttacttcaaatatatatgccccatgtttttagttgttgattgttgattgagtaactaatgactaatggatgtgtcttaccatgacatagttgacttttattttatgttgtatataatttggattgtctttgtggtttgctttactgggcaccacaactctttcgatatttgcctttcatacaaattgatattataaattcagattaaaaaaatgatttaaccatttattcagttatcctcttcccactcattttaagttattactccattacaaaataaatgtttataggagacaatgttcacaaactctcaaaagttttacattgaggaaagttttactgtacaatcgatttttgtttcccctattacatatcccttaaggtctatttataggtttataggcaggtttacaacctagggtttagtgtgctaataatttttatatataattgtttctctgatagggacatatatataactagcatcttttggctcattaggctggttcatcgtcattattcggccaccaccatgccgcctacagggccttcctcttcttttttttttggctttcgtcttacattgttaggctttcacaacctggtgctttgctcccttgtttcgcctagctccgcgtcgcctagacttcataccgcgccgcttcgacaagctcacttgttattatttcacctagcctcgtgtcatctggccttcgccttgcgctgcttcgccaggctcattagttgcttcggcatgccagtcaaaggccctcatagcatgcctccaacaatctttaaatatcaaaaatatttgattgaacaaaaggattttaatttgtcattctgttatataatatcatttatgaaggacactatttgatacatataggaagttgtctgtaaatgggttgacacttaccgctacagttgggtccaaagtttaagtagatgcacacaacaagcctaataaaacaatataactaacataccattattggattcatggtttgaatgtgtaacataaactaatgatattattgtcgcgtacaaccacacaaacttgtccggattcatggtttgaatgtgtaacataaactaatgatatttttatcgcgtacaaccacacaaacttgtccgtattcattcagttgtgttgtttcttagtataatggtactccttttgtcctggtgtactttactcttactttcattgcaaggattatttatatatttcctttatatgatgattttgtcgatagtttcattgctaagattttatatatatatatatatatatatatatatatatatatatat

SEQ ID NO: 68575 - DNA, 3867 bp, Oryza sativa
ccatcaaataatgatggtgagaggttctcatcctcttatcctagccggagtcggtcctcccgctctggtcaaagcaaggctcccgtttcccggtataataggagcccagaagtcctcacctattaaatggtgactgacgggggcaccccccgtgtcaggcggcaatatttgacaggcctcatcatcaagatgacgtgcgcttgcttcccaggtcaaagagacaagacatgcatttaatgcaaagattgtaatccttctccactaagttatgtttttgggcccatgtgataaccccttaagatataaaaggaggtccagacctagtaggagaggggagggttggagcccctgatgatcaacaccttctaccccaacaaggagatcttgtaatttctcacaagatcagctaagcacaggagtagggtattacgcttctcagcttgatttctttcttgtagtgtgagttttcaataatactttagtttatagtgttactctcggtctcacaaaataaacctagtgaacatatattagtacaaaaaaatctgaataaaaggctgtctagatttgtcacacataaaaaagacaaaccatatccaggttcatagcgtcacgaacctggacacgcatatgtccatatgtcttggacacgcatatgtccatatgtccagtttcgggtttttttagtcatatgtccaagttcatagctaggattggggttttcttttgagtcatatgtccaggttcgtagctaggattggggtttttttggagtgtcctggttcgtagttaggattgggggtttttcttttttattacggtggggtagtattataagcatcctcccaagaatgtgggaaatgctagaatgacttacattgtgaaatggtgggagtatggttgaaaatgtcatcaacctgaacagccccataaactttttttaatctagttaccactcatgatactaattatattcatagtttttgtctaatccgtttttaagtatggagtagctatattttagaatgagtgagtatataagtctaagagcaacttagttaaaatgtaatgattgtttggttttctttgaaagatgacttgttttggtatggaaagaatattacttattgcatcggagcatttgtttatttaatcagtcttcaatgtgtttggtgtgcacaaggttgtgtgcggtaagattttctactacaatatttcttttagaaaaaagacagaaagaaaagattgttagaataggtgtcgaatatactagttctatttggttacagttggacttaaagatgcaataggtgttagggggtggggttagagtcgaactctataacccggcatctctcttaaataaagaggttgcaccacaatgtaatcatggcgattacaatgtaacgtagatacgcagggagatgatggcggcgaggccatagactcgtagcggctaggagctattttggttggggaggagtgcccataatcaaagcctatgggatgtaggctttgactaaacctcgttaacaaatatagtgtgttcatgtgtcgtcatctagcatgtattgggtgatcaatgattgaatcgatcgagaaggttagtcatcgttccgttatatggactaaggccctgtttaggtggtgtttgggtggtttagtccctctcaccaaaagacttatattttgatgagaggggctagaggtgtgtttagttcgcgccaaaattaaaagtttagttgaaattggaatgatatgatagaaaagttggaggtttttgtgtgtaggaaagttttgatgtgatggaaaagttgaaagtttgaaaaaaaaatttgcaactaaacacggactaaactttagtccctctcccacccaaacaccaccttagatcccaacttttttctttaaactttcaacttttccatcacattgaactttcctacacacacaaatggtgtgtttagttcacaccaaaattaaaagtttggttaaaattaaaacaatgtgatggaaaagttgaaagtttgtgtgtgtagaaaagttttgatgtgttagaaaagttgaaattttgaagaaaaaaattggaactaaactctactcccactagaaggagtagaagccgtagcagcaacaactaggctagtgctttaggcatggcaaggcccacagaagctatggtgagtgagctgacccctcgtgtcattccttgtccctcttccgcctattactactagctcttcgtcctcatcaatgcgtgcttgcatggccatgtccatggaacacgagacgccagaaagaaagatggagtcgaatgctctcatctcatctctctcgcaaagtcgtctactcgatccttttcacatgctcttattataccctaaaattgatgtcgatatcgatgtggtgagatgatggatggatggagaagacgggcgagtacgtgatggatgggcgatgcgccatggaatcgccgatttcggggcgccgaacattttccgtccggccaccgatccatccatcgattgatttgaatccgcggtttggttttgctgctgctccgcctgtctttgctttgctttcgcttggacaggagctggaagcctggaactgctgttgctgttgcttggttttgttggttgcttgccgtctccatgcattactccgttttgatgccggggtagatgaggaggagtagatatattgatggggtcaactgtgactttttacaatggtggtcagcaactgcaattgaggtcttgaatgctgccatattgggaggagtactgagagatttggcctgagaccaaagggcctgttttagttcccagaacaaaaatgtttgcacacatacattgagtattagatatatgaaaaaaactaattatacagaatacgtgtaaattgcaagacaaatcttttaagactaattgcgccgtgatttggtaatgtgttcatacagtaaatatttgctaatgacgaattaattaggcttaataaattcgtctcgcaatttcctggcagaacctgtaatttgttttgttattagagtacgtttaatacttcaaatgtgtgtacgtatatccgatgtgacaaccaaacctaaaaattttccccaactaaacaaggccttagtttgcgagacgaaaagttttaacgtgtcacatcggatatgaattaacctaattttctcctactggggcatccatcgaagcggcagcgtcggtcctggatggggcggaggtgatgggtagcgccttgtgaggatggtgctccgagaagactgtgcggttggtgccaacgccgacgcggaacggggtggtgagtgcgaagccagcagcggaacggggtggtgggtgcgaagccgtcagcgtccaacaggagcgaggtggagccgaggagtgtgaggttgctcgtccacgagatgtgctggtaggaggcgccggtcccttatttcctctgccatcagcacaaccccctacggcgccggcttggagatcgggcggaggcttcccaagacgatgacgcctcttgctccttccttccatggcttcggttgggacgatacgagacggtaacggacgaggacgtaggcagtggaggcggtgacccggcgggcgggaggcctctccgtccactggcggaagaggcgacgacacagcgggcagattccggtggatcagagagtattcagggaaagagagataggggaagaaggcatgggccccactgatggtaagccggctttggctggccatgtttggttagtgaaggaggtttggctagggagatggcttggccatctagattgtaagtctgttggaatccattttttatttaaaattgttaaattttgatttggagagt

SEQ ID NO: 68576 - DNA, 8478 bp, Oryza sativa
attcctgcagccctgcaggagtaaacaagctgatttgaatgagaactgtgcctctgactccccagcattgctcaccatgcaaaccaacccagtctgccgaattcctaaagaggagaaatcaaagatgcatccctgccctcccgaccaaactctactcatgtgtgggcgatgcctcactggtgacgaagcagtacatataaacagtattttgtcctccatggacaatttattggcaaaatttcatggccaagcaggcaagcactgtgtgtcgtcttggtctcttagagaccataattcagtctgagttccggacaaaaaatattcaggtcgaaattgattgctgttactattgctagattgcaacgcggcttagttttgcctttcctttttctccatctttgaataatcaattattcatatttgaacgtacgcgccatttttttcttatcttagatcaaagttgaattactctgatcagagttcagctcgtacaatgtactttcacttcaagtttataaagcatcttcagattagtttttattaaattcaccattaaatatattaaattttctagtatatttgtttagtgttaaaaatattactgcattttgtcaacttgatcaaactctaaaaaaaaacttagagtaaacctaaaataacttatggggctcgcgatgaggacatcactccttgatactaggtgaaaccccgcgcattgctgcgggaatttagtatgaagatatacatcgaaacattatgtgaattatgttggatgataatttaacatgtttgtatttgaaaagctcttaaattataaaaactataaagatatagcatgtttgcatgatgtttaaatgtgatgattgttagtggatgatgatgtgacatcttgttaattagtgaatgatgatgtggcatcttgttagtggatgatgatgtggcatctttgcatattaagcttaaggagttagtggggtataactttatagtaagataggatacgcgtgaggggaagtgagaagcacttagagagaggcttgagacagaggtataattcatatcaagttcgaggacacctcggaatccaagagtagcacacactaaaattgacacctagaactcattcggactcggttttttacgttctatatatgtatgaaaaggtaacgagatcgcctttccaatgggtctggtctcatatcaaaactcctattgagtatcaggaatcatcaaaacaaaagagcgtccataatcttttcagatgatgtgttagcatctttaggcccgtgtaccatattggagtttgttcgggggtcctaggttgatcctagaacttaatcatttagtagttgtcattggattagggttgagttttatttagattattccgtcgttgcagtttcaccacttagttcagtttgtgcaaccccaacttgtgagcttcattgtatatttgcaatatattcagattgcttcttatactctcttgtttgtgttcttgattcgcttgctggagatagacttctccacgaggttaaccgcgttttggcacggttgataaccaacggagcaattgtgtagtgaatgataatggttcgatcgttctggtcggagcctttggatcatcaacatcgagtctacacaattgatttatccttacctatcggaagattggaacctggttcctcatcagctcgttcaaactgttatcaaaatcatccataccaaatttttaatatggccaaattaattttggcaaggcaacaaactgaacaagattttaacatcgcaacatcgccaatccctaccaacatttgatagtttcagaaaaacttctactcacaaaattataccaaattttggtaagatatcaaatcaagcattacctttttacatattgatcttgtaaaaaaaaactggcattgccaaattttaactttaccaacaaattgtaagtttttttttctttttttgcaatatacttcaaagtaatcaacaagcccatagtataaaacgaggggagcgctctgtatttatagctcatttggaacgcacgattcttaacataggaacgggaaaaaagaaacgtaagattgaaagtgtcatgtcaccttaaatcctatgaattaaagaaacacgagaaattaactgcaagaataaccgtttggattgagaaaaaaaatgtagaaatcataagagaaatacacatatatagatgattttcctaagaggttaaatctcatgttaaaatccctaaaatttcctatttttgagccaattcaaataaaggaccacacgatttttttgtccgtaggagtagatccctaaaacaaaaaactttttccaaagaagtccggcatgtaggaactagctatatcattccaacgtactaatcttctagtatatatccgtattctcctagtaggcaccttgtctcatagtagcactctcttttctttctttctaatcttgttgccaacttgaggcactcgactgatctagtactaccagactacctctccacaagaggccaggccaggacaaactatgcacacatagaaacgacgccggtgtgcattgcatgcagctgtttcgcttgctgcagaggcatgaagaaaaagcaagacagaatgagaaaaaaggcaaagcaaaaaaggcacagagagagagaacacaggttgcacagcacaatggggagcaaagtggcctattttcagccttgcacactgcacccctctctctgatgagagagatgatgatcgatcgatcagccatggctggccatctctactgctccccttggctttaatcggccatggccatggcagctgggtggggaatgtggaggcatgcatcacgagtacctgtgcccccacacacgcacgagacccaaccgtttccagcggcgccgcggcagcagcagccagcaggaggtgtatctctctcatcgctgcaggaattagggctcctaggcatgtacatttcggtgtaaaatctccatcaatggctctctctccttctcagaagttcagataccagcattgcaagtttttcaaccacctactgttcattggtctcaggcagtcaaaagctatagtatctgtctacttcgtacaaggatagcataaaattaaatcacagtagtagaatgtttaattagcgatgcagataatatcctttgggtatgagtgacggtgatgatgacgaactgcagcaaagtaggagtatctcccttggcgtacgagacgctagctgaatgattgatacatcacgtaccaatctccatcggtttcatactctcatcatgtactggtgtgtgcatgttctgacagactacgtacaaaaaaaaaacgtgaaataccacacagcatctcaagctgattctgtattctgtagtagtacgtaccatctctgcaggcggctcgtgtaagagcatctccagcagggacactaaatatagcccctaaacagattttgggtgttagaggctaaaaaactcaatccagcagagcccctatcaaggatcctaaattaggtaggcacccaaataacctttcctagcccccagtctcaggggctctactgcacagcccccatccacagttagaaaagcgcgggagccgcccgacgtggtcttggtccgccggcacctcccctgcccagggctcatccccggctggtgcggctcctccctgcctaccgtgtcatccctcaggtgcattcctctacccgacgctccttcccggccgacgcgtctgctgtacctggagtctcctctagcctgcaccctctgcctaaactcgatgaaaaacatggcccagtggccgagtcatgcgatggcgtcgaggcactggatgattcaagtgttgttgcaggctgcgaaattgagaaagtagtagcagggtagcactagcagttacgattgtgggacttagaagaatggggaaagtgatacatgcgatgtgctatgcagcttttttgttgctttgcttggttgttgcttcgtgagagaagtagctggtctattggtggatgagaagacgggaaaaatcaacacatgtgagaaaatgcatggaagcgccacagcagcataagctcgttttacccgagctatgaatacatgctactaggatttgtatttccattttattttttttaaaagaatcgaatttgaattgtgaatttaaatatggttggattattatggttttatactaggagtagcgtagagtatagaactatagatttgtactttaaagtatatgttaaaatagaagatgaaatgaaataaggggcgagaaaagagactgctgttagagttaaaggtattttttaggtacttagaaaataggggaagctcccattaaatgatgctctaacactgctccagtttgctcgtacagtacgtactaagttaaactacagtgacgaccaaaagtaaaaaaaaaatggaatctgcaatggcctacggagtactatactaacccccacaaaattctcatatgaaacaaacaaaaactccagcagcttcacgccaacgaaccagaccagagaccccccaaagtgaacaaaaaatcacaacttttcaacctgaatctgccgcaagtcgccattggttggcatgcagattcaaacttcagcgatggcgtcggcaaacggcatcatcgcctacgcatgtaaatctaccgagaaaaatggaacaaaatgtcgatcgcctagctagctactacgtggacgcatggaccacgaactgtcaccaaccatggcgccatttgcagggacgatcagctagaaagaaacaaagataaagcctgagatgtgagccaaagttaccagtttgcatgccaattaaggacaatgagtttgtagataaggaccatgcaggctgctgcaggcagaagctagcagggcgcctgccgatgatgatgcagattcagaatttcagatgtgtgtggcatgtatcctactccctccgtcccataatataagagattttgagtttttgtttatattgtttgaccactcttcttatttaaaaaatttgtgcaaatataaaaaataaaaagttgtgcttaaaatactttgaataataaagtaagtcacacaaaaataaataataattccattttttttaataagatgagtggtcaaacagtacaagcaaaaactcaaaatcctatattatggtacggagggagtagcaaattccaaatgcgattaattatcgattcgattcgatcggatcgtgctatagtaggtgtctctgcatcctccgttctgaaggtgtgttcagagaatgggagcagcacatgcgcgaggacatggacgcaccttcagatggcgacccctcagtgcaggcaagcagctagctatagtgcagatgcagggaaaggtgaggatgagtatgcatgtgtcatgtgtgtgttacatttgtagctgtgtaaatgagagcactgtgttagtggcattaggggttgttttgttatggcaggcaggaggggcaggagggagctaaagttgcttttaatgaaacaattcaatgtgtgtactgtaccacatgtgggggcatggctcatttgcaggtttataggagtataactaaactgatgggagcagaagaagttttaggagtaaattccctctgtaccctgaaaactcactcaatcccttttatgtcactaaaatttatccgatcccttctatacccctgaaattttaacttgatccctttcatgctcctaccattatattttctttcatttcactattacccctgaaaactcactcaatcccttttatgtccctaaatttacccgatcccttctatacacctgaaatttttaacttgatccctttcatgctcctaccattatattttccttcatttcactattacgtttggttgcaaatgtcttttttttttgcccttgatgctttatatttgaatataagctgaaaaaatgattgaaaattttgtttgagtgcatagtatgtgcattttatgaaactaatgagactaaatatttagtgcagaaaattttgacataaattttgaaaataaaataaatgaaataaattaaaacttttatttaaaattttaataggacaatagatttttttatcgggagcattcataaaaaaaattatcgtgagcattggtagtcctatctttataggaatgcttctcttttttatgacttttttataaaaaaataaatatatattttattatttcattacctaaaaataaattttgtgataaataatgcatcgcacgacaaactcataactataatagtctcatgcgacaaacttttacatttttaataatgtaattaataaatttctatgttcatccaaagggtaaaatagttatttttatagaaattagacggtcaactgacagcatgggtatggaaggaatcaaaatcaaattttagggtatacaaggaagtaagcaaaattcaggggcatagaagggattagctaaaaattcaggggtatacaagagattttctcaagttttattgggtttgtagggaaagagaatgatatcattccagcattttaacttaaaggaaaatacctccgaaaaagaccgaactgcccccacctctcctactctaccgcccttcctcctcccaaaattaaccaacctataaaaccggataaaaatactaaaccctataaaatcattatttgtattctttttagattcggttgtaacaccctagtatagcactaacatatagaaaaacctattccttgcccctccttccaatcacacgtcgcagcaaatgctcctacggccctaactcctcatgcaccacatcgctcctcacactggtgaggggtgccaacaaccgctccttggctgccaacatttaaaataaggagagcgtcatcgcactccttcccgcgctcttcgtgctactctcaactcccacgagattccccataccgccattgttagtgatctaggagccaggacccccaaagcatacaacgtgcaccatgaagttgccatgtatccgctcatctggctcatcactcatgccaatgatcaattcaggggcaacacgtggcctctcctaggtcgagaaggctaggatagaatccttggggaacccaaaggtcaaatccaagacggaagttgaataacatgtctaagtggcctcgggtccttaacttgtccccatttaaatgggatggttatccaccacagaggtgagggcatggaagacagggcaacgattgttgtagccgttgctcatcacctcacccatgtcgggcctgatatgggcgtgggaaaccagaggatcgtggttgactactcctcccttcctcgagacacacacctttgactacctcttgcgaggcaatggtcggcaggccccatgcccagcgaggcatggtgaaccctattcaccattgtagattaagcaagcatgcatggcaatgctatgaccacgccccactcaaagatgccccgaggccccagtggattgggtgggtcaacgtagcaagatctagctcgccatacctcatccgcagtgtgccctgttaaggcccgccccgaagctagcgatgggggcgagaaaaggagttgctgataaaacgtaccatactcaaatgttgatacgaataaaaccttacatcgaattttgaccgtatggtatcccctagagatgttataagggaagagttgggaccaagagagatggggtcggatcctagtgactaaggagggacttcaacacatttagtaaagttcttaagtaacccggaagagaaaggaagagaaactactaatccgagtagtcgataaacttgtaagatctttcaaggacaaatagagaaatcaccacaacaataggagtagggtattacaccttcgggtgacccaaacttgtacatatctttgtgtttatccattctagagtgatagaggggcccaagccccttactttgatgcgactagctccttggctgaactcagaaaaggcagtcccaccggatccccgcttttgggttccacaatccgacggtcgtcctccttatctctaatggctccctccacctgatactgtaccattgaccgctactttggaaacaaccgcttgagatgcccccgttgcccacattgccctcctctattccttcgtcttcaacgtctcatcgcctccacctcccctcctccctccttcatcgtcgagtctccaccgcccaccgctaggctgatgtcaccccggtctccgtctaattgcaagggatccccccccaccctcgccacccctcctaacccactcttacccctaccccacacctggacactaaattgtctgagcttgatggagttggagaacgaggtcatagcacatgaattgtggagtagatcccaaggacaagaattcatagtattttgcataggttttccgcctaatgccatttagcaaatctgtttaatttaatcaatgc

SEQ ID NO: 68577 - DNA, 2349 bp, Oryza sativa
atgcatccactcgtgaagagacaatgaaaaaccacagccccagccggcccagggccagtgccacagccacagccaccttcaattgcaagcattgcagctgcagctgcaacaacagcagcagcagcagcagcagctataccactgtgcttttcagaagcagcagtagtagtctactgctacggccacagccatgcacatcactagctacatcactcactcaactcaaacacaggctgatactgtaccagctgctagagttgcattgccaacggatcgaccggatgatggatgcgtggacagattggagcactggcatatggatggatggatcggtctaccggtcgctgggtggttggaggcatcgatctcgatcgcccgcggtcgccgtgcgtgtgtcaggccatatatgggaacgcatgcaaccgttgggcagtagaggccaaggggagacgacgacgacgacgacgaagactgagggagctgctgatcgatcgccggtagctccagctgagctgcatagtagtcgcctgtgagctcggtctggctagctgctgctgcgtactagcttggctgaagtagctatggctgatcagcagcagcagctagctgggtgtggctacactctggtcatctggtgccatgttatctattctcgtgatccactgatccccctgtgtatgtgtatattctagtgcttgttaacttgtagcttctcctgcttgttggcttcttgtgatcgatcttgtgctagcgctctgacctttctccagtttgagcttgtactgcttgctgcatcttcatcagcacgactttttttttcttcatcaattatatgcatgcatggaaccatcaaatttatataccccaccatggttaggttttgttataactaaactctactacggacctgtttaaatcccaccctaaaattttacatactattacatcaaacatttaaatacatgcataaagtattaaatgtacatttaaaaaaataactaattgcacagattgcgactaatttgcgagacggatcttttaagcctaattgctacatgatttgacaatgtggtgctgtagtaaacatttgctaatgacggattaattaggcttaataaattcgtctcgcggtttactgacggattctgtaattagttttttattagtgctcaaacaccccatgcgacactctataatatctgatgtgatacgccaaaactttacacccctagggccatgtttagattccaacttttttcttcaaacttctaacttttccgtcacatcgaactttcctacacacacaaacttccaacttttccgtcatatcgttccaatttcttcaaattttcaattttggcgtggaactaaatacaaccgatgtactccctctgtttcaggttataatttgttttgactttggttaaagtcaaactgcttcaagttttattaagtttatagacaaatatagtaataattacaataccaaattagtttcatcaaatcaataattgaatatattttcataataaatttgtcttgagctaaaaatgttactacttttttctacaaacttgatcaaacttaaagcagtttaactttgaccaaagttaaaataacttataatctaaaacagattgagtaatattcagaggtgaatgctactcctgacataataggagtacttactccgtctcaaaatgtagctatgttatataggatgtgttattacctagtactacaaatctggataagaggtagtatatatctctcctgacataataggagtactccattcatcccaaaaaaactcaacctagtattagatggacattttctaatacaacaaatttagacagaagtctagaaaatatcacattcaatattaggaaggtttttttggaaggagtgagtataggtgaagcttcacccctgttcgttctaaaacgtgcccacgttaagatatcgcgaagcaaagacgacattacgacttgtcacttttcatgcgccgctagctagctggagtatagcctaatcccaagttccaagccgtgcgagagagattgacaaacaatttgacatgactcggattattggcttgcgtgcgctagctggttgcatgaaattgaccagggcggtatatatgacacgtgtgtgtcacgtaagttagctggcttgatgatcggccacaggtagagcaattccagctgtatatgcagaagtagatgcatatatgcatggttggttggtgccacgaaaagatgtcgttgttggttagtaattcggcagatggttcgcacgcgtgtactgaattcgtctgagaaaagaatgaatgctgcaaaaattgct

SEQ ID NO: 68578 - DNA, 3719 bp, Oryza sativa
  unsure (1)..(3719): unsure at all n locations
gaccgttcgttttatttaaaaaaatttaagtaattattaattatttttctataatttgatttattgttaaatatacttttatgtatacatatagttttacatatttcacaaaagtttttctgaataagacgaacggtcagacatgttttaaaaagtcaacggcgtcaaacatttagggaaggagggagtagtaaacatttacgtagctctgttaataatacctcaaaggctgtttgtacaggtgatgtgtctgaaaatagctctgactagaaaaattgtcgcatggtacccatttatttgaaagaaaaatatataattttttattctgtataggaacaataaatttttatataggaaatttttctatatgatttttgaactaaaggattattgaaaactattaaatcctatcaaatttctaaggaatacccaaattttacataagttttggagcatttttaacatgtaagtctctcatgaccttatctctctcatcctatgtaatcaacttcatgtaatctgaatacctgatgtgacattggctactatagatacaaccgtcgttcacatcaagatcaagccgtacaagttctgcaatccagttcggccacctgctacagtctcgacttcaaacggccgccaaatatgcatgcgagctccattttgggtctatgagtacttgatggaaagctctcggagtcatctttccaatggatccagcttcatcgccaaattccatcccagtcggccgaaatcacaaaaaaaaaagtgttgcgtcacctataatgggcctatgggcttgtaacttcgtctgggaccccggcccaagtggggcccatgtggggtgcgccccaagctggtggagcacgaccctaggcacccctaggtcgtccttccacccctatatatagctaattaccccttcagggtttctcgagttttgattaattgtaagtttagccattgctacttcgcttgcagcgcgcgtgtcggctagaccgtccgtctgcttgttcggaccccactttatcgtgtatcaatttatctttgtgcgtcttgtctatctagcaattcagttgctttatatcttgttcttgcttgttctcgattgcttgcaggaataaggttaatatacaccggcaagatcaataacccacggagaggtgtatcgatcgctaaggcgcaacgcaacgtcttgtacggttgtagtcggatcgtcaacgtttctcccaaatcgtagttatcatcaactcaccgaaagatcgggccaaacaactgccttgagtgtcgagtggaactcagggtctatcaggtggtatcagagctttcgttgctcggtgagttcttatctacccataaccagaaaatagccataaaaaaaagaattgaatcctttacctagccatacttgtgccattgcattgttcttttcagttttgctttgttgaattttgtgttgcatcgtcacgtcgtgttgctggtcttagcgtctagttcgtttagagtttcgagttctggtcacgttttgtaccacagtcgtcgctggccccgtgtctcagttgtcgtcaggacctacgaaaacggaatcggctcgctgccacggttctattttcgtagttttcagaagtttctgtcggttagtttttgagttcttgagttgcatagcttctgttcggtgctgtgtcgtgatggtgtgtcgtgatggtgcacctgtgatgttgcgtgtgaggaagaaggaaggaggatattagattagatcagtttttggtagtagattggatcggtttcaatttgaaccggattcggtttccttgcatgcgacttttccttttattcggccgtggtgcccttcacattaacatgccgagtgagtccgactcctccctctcctctcggtttgcatctatgtcgtggcttcccatatagatacattggtgattttcttttccgagtgttggattggaaatctgttagcaaaaacggaaactaccggacgagagcattccatttttgtataaatttaatttttgagttcgcacttttgcatctgagtccctgtaatttttgatatttacaattcagtccctgtaactttgcattttggtccttggtcagttctggtcaggaaaaaaaaaagaaaaggcagaaaggtgctaaaaaagagaaaagagaaaagccgcaccgaaaaaaaaagtgtgaaaaaaaagaaaaaaaaagaagagacaaggaaaaattcagtttattcttgatcttggttttggatatcagagtgatgcttgagttgttcctagtgctatcttgtggtatcgtttgtgtctaggttcgcgtctctagtacgttctagcctaggaccagcacggtacttgactttgaaccattattcaactttgcattctctgatttgagcatttgctatccctttgctacatatttaagcctacccagagctccacagatctgattgcagccgtacagcaagtgtttgccaaggaatcgatacatccaacctcaattggggtgcttggttaagtcggtgtacatcaccattccgcttgctttggtaagaacttgtaagagcttggttaaaagcttgagtgtgtgtgatatttgagctgccactacctagtagttgataggagcgtgcatatttttgtgtgtttcttgtttgctactaaccatggcaggattgcgtaagggaatacgagaacatcgacttctacaccttcgacgagatatgacgacttctccacgcgggcnnatgaggtacatgactataattttgaacaagttgcatctaagttaccattctttgatgggaaatatgattctattacatacattgattgggagctagcagtagacaatgaatttgatatatatgatttttctgatgctcaaatgattaaggctgctagtaataagtttacctcttctgcattattttggtggacttatgttagtaataaacctgaaacttgggatgaattgaaaaccatgataagaaaacgctttatgacatcttattacaaatgtactcttcgggagaaattagaacatctgaaacaaggtgatagaactgttagggagtacattcatgaatttaaggtctgtatcatctacagtggtctcaaagagtgcaatgaaaatacaatgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttatgaatctccaatatacttatgtaatgatgatgtgcaaacattggaggagcaatcttttgtctcccctgttactaacgttttgcaggaagatcagcacatccaagaaaaggagaatgatatacttgagaagaaagaggatgaagcacctgcgatgtctgaagaaagctcgcaaggtaaattaaatggtgctgagagaaatgaaggtgagtattctcaaggtgagctacacttgtccacttttcatgctatagtagagcaaccattagtggaatcaattgctgagttacctttgtcacaagttgatttacttgctgttccttgtgataaagaagagttgtgcgataatgcttcacttatattcatgccacaactagtgaatgaacatgctattcctgttgttaatactaa

SEQ ID NO: 68579 - DNA, 2798 bp, Oryza sativa
agatacaaccgtcgttcacatcaaaatcaagccgtccaagttctgcaatccagttcggccacctgctacagtgttgacttcaaacggccaccaaatatgcatgcgagctccattttgggtccatgagtacttgatggaaagctctcggagccatctttccaatggatccagcttcatcgccaaattccatcccagttggccgaaatcacaaaaagaaggtgttgtgtcacctataatgagcctataggctcgtaacttcgtctgggaccctaacccaagtggagcccatgtggggtgcgccccaagctggtggagcatgaccctaggcacccctaggtcgtcctcccacccctatatatagctagttacccctttagggtttctcgggttttgattaattgtaagtttagccattgctacttcgcttgcagcgcgcgtgtcggctagaccgtccgtctgcttgttcggaaccccactttattgtgtatcaatttatctttgtgcgtcttgtctatctagcaattcagttgctttatatcttgttcttgcttgttctcgattgcttgcaggaataaggttgatatgcaccggcaagatcaacaacccacagagaggtgtatcgatcgctaaggcgcaacgcaacgtcttgtacagttgtagtcggatcgtcaacgtttctcccaaatcgtagttatcatcaactcaccgaaagatcgggctaaacaactgccttgagtgtcgagtggaactcagggtccatcaataccccatccatctcaagctctctctctctctacatacaagttctatgcaatcaacttcctataatccgaataccctcaactttcttgtttctttgtttatcattcctatttcgatacactttctatcctatgtttttcccatccagtaatccgaacaagccctgaaaatggttgggatgaatagccccatttttttggcttatacttgagcttatgtcaaattttgtattttaaaacttaattttaaagttgattttgtgctttttttcatcgaaatttatttggtagcatttgcttttgtatttttttaaatagtgataagcgtttgagcaaagatagtgtcagaagtgatgtcggccgggctgttggtaatggtctcagcgcattctctcccacaaccttttttttccctagttaatgcattgggtatttgtatgctacatgcatacgtaatatctcatacgtttcacctagtgtgttcttgtgccatcacatagcctgctgaaccatgacgttatacccatggacctaaatcatctagttgcttcattgatagaaacttttggatgcccgttgcatgaacgcacacgagcgttttaggatcactgcccgcgcgctagcaagatcgagcctttgttccacgaaactggtgctgccacgtggcacaattttccttgggatttttttgcatcgaattcgtattataagataagataagataagatagcaagcttgtccagatgggtatataactcaagttggtaaacaaccaaacgtggcctaatagtttttaccttattcaactgccgttttatttaaaaacctgcaaataaaaaatatttttgcaagatgctggcagtcctcaaaatataaagttttgcatataagattttagaatttgtaagatttaataaatttatattatcacattacagaagaaggattttctaaaagcctctataatctactacatactggtgtttgtatatatttattcttttttttttcgatcgacggttttactatttagctccgaagttttttttttacctaagcaaaattcctagatttatctggaagttacacgggatattacacaaccaacgctctaactgaatcagaacaaaatcagcgattgcacaggggacacgtggctaattttcacgggagctaaccctaaattctcaggaggccacgtggcccaatcacatgcctgattttcatccctgaaatcggtttataagatttgatcggttcctattcttatataggagacgataatgctactactatctgaagtgcaaatgcacgtgttataattttattaaaccatccaccatattataacttacgagcagtaggtagtactagtacgtagctacatgtacaaggccacgccaaaaatatgcgagacaaaatttgtgctcatgatgcaaatattcttattctatgaatagtactcctaccaattgttgcatgcagcttcagccatgcaagcatgatggaacatggatggagctttaggttttccatggtggagacggagatggagtagtaccttgctccgtgaattgtcaaatcgcatgcaatggacaaaattggacccggccatgtctctcgagcgcttgcatgcatgacaacctcccatctacaactccaagtcaccaacgtacagataagcacaggaattgaactcctgataaactctcaagttccctaagaaaaataatcatccaccatgggtgtgtttagttcctgaaaaaagttgtaagtttaaagaaagttgggagtttagaaaaaaaagttaaaaatttagtgtaggaaagtttttgatgtgatagaaagttgggaataagggggaaactaaacacggcccatattaatccatcgttcataaaataagtttatttttagcccttccatttgtaaaaaataaggtacttttaagtaatcattgcatcggagtttgtgaaagttagagaataaataaattggggtagagataaagaaagaaataattgtgctggaatttga

SEQ ID NO: 68580 - DNA, 1004 bp, Oryza sativa
ttaaccgtttgcgcacttccagcgttctatacttctattgcagtgctctgttgtgcaatggatttcctggcagttcatatctgatatcttggcagtcagaaactcctctcatcgtccactagcttatcagctacaagcctacaaccaaaattttaattttaaaaattaattttagagttgttttcttttctcgtcataacatattttccagcattagctttcgaaccgctactaacaacaatataaaagttttactaaactatttgggttcctcgttcattttcctaatagcttatcagtcgtagcttcaaactgaaaaaacaccctcctaaaaccgtgctggtggtttaacatcatacaagatcccaacagtgtgaaatgcaaacctctgtctgctttttaccactcggtgtgtacagtgccatacgcgggcacacgaaaaacattcagaaaaggcgacaggttctttctttgcggttgcaggaaaagaggccacaactacttgcacaagggaagcgaagaaggacaggcgaataccagaagcaaaggtttgcacataaagccaggccccaatttgtagcagatgggccaagttttcaccgtgtttttcacctcttttcagctgggggacacgggcaaggcaaacaaagcaaatggaccattttccccatggcccaggcttcagtccagtgcactccagggctctaggccatccgttttgagatattttcaggcctgaattttccctctcaaaaaccagaaacacccagatggacacaccccggcacagtactctcaccgacgaaaggactgtcttttcccttatacttatcagccaaaatttaaattttcaactttaaatttaaatctgattttgaggttttttcatcgaaatttatttttcaacctttacttgtaagtcgctaacaacacgtatataaatgttttattcagaaattatttttcgtttgcaaatataccgttttgcttattccgcgaataag

SEQ ID NO: 68581 - DNA, 2367 bp, Oryza sativa
tgtggagtgccaatagctggagtagtttttgtcacttagtgtgttgcttatgcttcaaaaattttcatttcttgagcatgcaacgaaccattccatgtaggagccccttgcctgacctggaaaacatggtaattttggaaagtaagcagacaatgccaatattttactggattatcttgacatgttggatatcttggttaatcttgcctttgaccagctggcagccatgcatgcccagtcattgaggcaaaggtaaagacaccaccctagtatttactcatgcttgtgtcagttgtagttttcacatgttgactattgtccgctgagagactccagactgcatgaatgtgttatgcgcaaatgcagtttgaggaatccctcctcatggatggttggtacttaccaccagaggaaacaggaatggtgataagttggatggttacaccgtggtctcttgaaccgtaaacaactttcatgttcttctcacacaattacacttatatacgagttttattggatatagtagaaacttatggatggcattcttttattgaagactgtgtcagtgtactaaactacaaattaatccagcttactaccaatgaaagtggtaactgacaacacattgatcacttgcagagaaggtaaacaatacagctgtataatgctagagaaaactaatacagctgcataagttttatacttttacacttatacctattgaattcagttgtcttttgtagaaacttgtggttgatattctctgttgaatagtgaagtatatcaatttaactaaactgcataagaccctttttgtatcagttacatatttgatcacatggacataaatggttctgacttttaaatctagccatgaatttgttgattctgttgtgatccaatacatgttaacagtagcttgttgctaagttccttgaattgagctcaagcatctcttttattgtgaaaatgaccaggtatttaagaaccatggtgcatctgctggggcctcaatggcacactcacatagccagatgttaggaactccctttgtccctccctctgttaccacccggcttaactgcatgaaggaggttttcgagagattggggaagtgcagcctttgtgagttccagtccaaggatattttggtccgtgaaacacacaatttttctgcaattgtcccttttgcagcatcgtatccttttgagatatggattattcccagacagcatagttcctatttccatgaaatagacaaggatacggtatgtactgttcctaattcgtttttatgtgccattatcatattatgcttagtggttcatactacagtttcgtttacaagtttatgtgattcacaatttgtatattttttccttctttgcttgtatcatattaccttctgtgtatgtgattcacaatttgttactcattgttgaagtaagtccatctgtctatatttcaagcttcaatgtgtatgctagaatggtagttaagtggttaaacgtggacttaaccagccaagtttaaatattcaacgcctgtatgcccagtgattgtaattgccaggtgtaagtgttggctgccatgagaaccaagttcaatgcagtggcaataatgcaatatgctttcagctattggttcgattgacttagggtgcttagatatcttgttgctttttgtgatatgcctatactactgctagaattcagtaattagtgttttacatttactctggtgtgtcacatggaaattagcaaattgtctttctaaatcctgattaaatgttggcctgtaaatgctgtgcattagctattaaataaccacacctttaatactacagctacgttatgtgccatgtcatttcctacagccacaagcagcacatgacacgtttgtgtctctctggaaatttatgagttcctcatctggctttgagcgcaccatactgggtcacatatgctgtgggacatctgtgcactaaatcattttgatttactttactttttttttccctttcagtgcttattgatgctttctgtgttctctttcttttgatgtaaatgagacgtgagttctatttcatccatgttggtgtgctctagtcattgatcctgttgctcatttcttggtttgtccatttcagtttcttgtatgctcatactgcctgactatttctattgcctttttgttgcattaactgattgcaatgatgtctgcaagcactggatcttgaatctttattgaggaccatgctggcaagagttgtctaaacagctcaacgaccctccattcaactttatgatacacagcgcaccatttggagtctcatcatcctgtcttccttacacacattggttcctt

SEQ ID NO: 68582 - DNA, 2396 bp, Oryza sativa
gtcctccctctccagtcactgcaaccgcaaaacatccacggaaacaaaattaaaaacaagcttcagagattgctcccttgatccctaaacctcatgtccgtacggtgaacaaagaaccctagactaacataacagatgagacgggaatcaatcaaatcgagagagcaaccaaaaacagcagcagagagaaggaatcaagaaacacagagagagccttgccgtgcgatgatgctccagctccctccccgccgctcgcggagtcgccggccgagctaccctggtcgtcgaggcgcggaggcggaagccggaaggggaagagagagagagagagcgagagaggaggaggaggaagaggagtgggccgggttagggtagtagtagggtttcggaggctaagtaggccgtattattgggcttccacggcctagtgggcctctcatatcttcctccatccttcccactcttctctcttcctcgtatctccccacccaattttgctatatatttgaacttgcaccaatcgtttcattgctcatggttaatagtatgccccaagtttactgcgagcataaatgtatgtgagcatttgcaaatttgccgctagtttttttattttacaaaaatgccatttgaatgactgttctagtggcaattttgtaatattctagcggaagttttacaagatttaaaacagtggcaattttacaattgcctcaaatgtataacttctgaaattcttgcatagttcacacgcggtgaattaatttacggtcgctacaagcatcgtacgacgcaggcccatgacgatgaggggaggggtagaggtggaggggcctctgatggtggatgatgagttgaagcacaagaagcaaaagcaggttaccagagtaatgacatcaagatcaaccgaacctcaattttcagagaatatttacactgctagaagaatgtgcagccaaaaacaatgctggctgagtatgaagtatgatgacagccacagttctctgaaggaaatcatagtgatgtacaaaaaaccttaatacaaggatatcatttcttctatactttctaaatcaatttactacagagagggtgtacaaagatgtcaaaattggtacccagtttctatcctctacaagagcatttccctccacagaaaatatgaaacccagccgagtccctgaccaagatctctttaccggtagctgcagaagtatactccaggaatgagtggcaatcaccacacatgcggacgttcttcacgacgcggatggtttcaccatgtcctgacattagaaggccatacatggcagctagcttcacgctatggtacatcaggaagtgcctcttctggtattcctcgacgtcgtgtagcacgaaggtggtgtccggttcatacccagccttcatgcactcaaggattagcacgtcgaggccagcgtagatgtccttggactggggatgtgacctatcccgtgcgaaaaatgagtgaatagagttgccatgaaatgtccagctccttgctggaatcttacgcatacccttttcacgcatcttcagccttgtgctctcagagcattgccatcttgctgattctgagtagagatttgatgccaggacatatgtggatggatcctgtggttccagtgcgagtagatgcctcattgctagcctccgcatggtcatgttgggctgcctgttacagctgtctagacaagatcgccaaaccaatgcactaggcttgaacggcattttaccgataagctgctctgcctcctcaaaatgaccccagcatccaaggacatgaacaaatgctgcgtagtgttccacagctggttcaatgccatatatgcttgacatagaaaggaatagctccctacatttatcagcagaatttgagcttgtgtagctgcaagatgatatgaccaggagaaaggtaacagaatcaggtttgatgggcaatctctccatctgagaccacaggtccagtatctcatctccctggcgatgaagaagatgagaagtgatcagagcattccatgaaaccaagtctctacaaagcattcgcttaaagacattgactgcagtttccaatgccccacacttgccatacatactaatgatcgcattaccaactccctgagcactcagaagcccagattttgcagcaaagcaatgcatttgctttccgaattcagcaaaacctaaggctccacatgctccaagaacagtagtcaagatgaattcatcaatgaactgaacatcattgcttctaaacatcttaaggaaagtggaaagtgctttctcatactccccatctctgaaacttgcagccagcaaagaattccaagcaatgtgaaaactctcctcgtggcgccatttctcaaacagaagat

SEQ ID NO: 68583 - DNA, 2596 bp, Oryza sativa
aaaaggattaaaaaacctcgcctgtgctgcgctgtgaagtgcttgggcgagtttgaacatattttgacaaactagccaagaacccatatgttccaataaaaaaacaaattatgtcgtgtgttgttattgtgggtggggaactaatcctccacacacgtaaaatggagaaacggattaacggatgattaatggagtattagtttaaaaaacttaaaaaatatcaatatatatttttaaaattaacttgcctataatttttttaaaaaaaatacacattgttaaaacattgtttaacagtttatgaagtgtgcacgtgaaaaaatgtgaaagtagaatgttgagaaagggggaaaagaatgcaccctaaatctaattcaacaaaatcaacgaaaattcaaccttttttgaaactgccacgcatgttgaccaaaacggtcaacttgaaggagtacaaccgttacacactcttagagcaggtacaatagtgagctataaactagctacaaatatatattttaaagagataaataaggagagaagagcagcgggctacagatttatagccagctgtaacacggactccaagacacagtgtgcgtatgacaggtgggaccaggtattaatagtgtagtatgtagctattgtatgaatgggctattagattggctatagataaattggagctagtaattggctatactattaaacttgctcttactagtttccaactttccatctctacatgctaactactccctccgtcccaaaaaaatagtacaataaatctgaacaaaggtatatccagattcgtagcacatgtgtcacattcaatactagtttgatcttttataggacgaagggagcagaatcttgatgatgggtacacgcacactcgtggagggagacgtggagtaaaagaagcacgtccatctctacatgctacagtacacggtactactcataggaaataattttcttctgtcaggaattaatccgaaaatatttctgtgtcattattagcctttgcagggtcacatacgtacgtagtacaaatctcacaaatccatccgattcgtgcgtgcagtcgatcgatcgatcaagctgtaataatgtgaagtacacaccaactatctataattaaacttgctccatctgatcaagaagcatctggctgtcaccgccgccgtcgtgtccctccgccgccgccgccgagaaatctctgatgatggacaggtacaccgtggcttggatgacgacgatgatcgccatgaccagcagcatgaccggcagcatgagcagcgcctccccccagctggtgctgtccaccaccaccatccgcgcgatcacacccagcaccaccaccgtagacacgacgaacaaaacctgcatcatatccacacacagatcatcagctaatcaagtaatccacactgaattacgaggtaattcctgtgtttcattatgaaacatttttcctcgtcaaatttataaaaaaaaatataataatattttcagcacaaaacagatatattattaaaatataaaaattgaaaatgcttctgccggtactttggtacgccattcgtgtataagtcggttttcaagttcgttcgcttttgaaaatacatatccgtatttgagccggtttttaagttcggttttggaagtacataagggagtcgtaaaaaaacttgcatgctaattttagatgaacggactcctaactacagctcataatttatatatatatatatatatatatatatatatataacaaactcatataacaatagtaagattaaatagtttccacccgttgcaacgcacgggttttttctagtattattaaaatatttacaatgttatatttaataaaattaatttgttgttgtaaatgttgcttaatttttcctataaacttaatcaaacctcatatgtttgtctagaaaaaagtcaaaatgacctataatataaaaaaaagtgaaaataacttataatatgaaaaagagaagtactccatccgtttcacaatgtaagactttctagcattacccacatacatatatatatatatatatatgttaatgaatcatgtatatgtctagattcattaaatgaatgtggacaatgctaaaaagttttatattgtgaaacgaaggaagtagtaattaactagcagttgtcagtggtctaggtacgcactgtgacgaagtttttgcaggcgggggtcatggggcggtgggggaggtggtgcgggggcaccctccgccgctcgacgtagttaccgtcatcggcggcggcgacgtcgacgaccgtgtggggcggcgccggcgggagcttctgtagcgggcagtgtaggggatcttcaaggttgtatgcacccatgaaagggaacatcgacatgtcgtcgcacgcgcgagggacggacgtacacgtacggctgtcttccctttcgatcgtgccgccttatttttatagcggggagtccccaatccgattccgtcttagaaacgcagacaggacatatacacgggataaataccccggtaaatatcggcaagtgagtcatgcatttggtttacactagtatcatttt

SEQ ID NO: 68584 - DNA, 2107 bp, Oryza sativa
aacttgatggaggtacctttgaaatcgagatgggtttataacgaatgggctagacaaaatctagaggcacgtggctaagtctagggcactttcacatcacctttctcctccatcgttgcttctcactcctagttgacaactgtcgccaccacggccgagccacactgtcatcgtcgtcaaccatagccacaccaccatcgacctgcgccctcaataacggtggatctggcgttggtggcctcgggagcgacgaatccgccatcgccaggggcttagcaggccttatcatcaccatgatcctgggcattgggatgtcaatgacggcggtaggccttgggacaccggatctaacgttaggccttagtagtgaggacttcattggcgatgacgactacacactatagtgaggatgtcggcgaggctcatcctacgacgacatgtgttaacgatggtggtgcgagggtgtcaacgccagcagttccaccatccaccaaggtcccgaacgaccacttgcttttggaatttgtgaatttttgttttggagtttttttttttgaatttgtgattgtgtctataaaaatttgcaggttgtgattggatcggaattcatgaattgcaggctttaattttatctaatttttcttctttttttgccaacaggcaagccactttatagtaccacctggaaatactaatttttactggtggttccatccgtagaaattgttttcacatatgggtatcttaatttaaccgtctataaaaaatatttgtagacggttatcgaacttcacaatttttaatctgtcagaggcatgtcgctcaaccatctctacaagccgaatttgtccgctagtgaaaactaatttcgcatcagtgcattgacacaatgacaccacaaatagccagattccattggcaggtttataaattcacaaaacctcaggggtatatatatgctattctcccttaatttaaaatttaattaagcatcaatcgtgtaatgggcagtacgtgtacgtctagtaaaaggctggcaatgcaagagtgctagctacacatatgtgcttaatctctaataaagtgctctctaactttgccctttataaactagaaagataaaagtcagctcagcttctaggcatgtctggttatacttatccggtgctcaacaagctaagacaaaggtcactgttttaattctcacctgataaaaagcaccaagtaaatttgttttttttttgggggacaccaagtaaatttgttgcatatgaaattttacacatacatataattttgttactaaaaaaataaagaagtagttaaacacaagaatgccattaattatacttcaaatctcacatatatttccttcaaagctcttacatatatatacatatggcgtatttacaaattagggtcccagtgctaaacatagcgtatatctacaaatatacaggtccgatatcatatatatacacacactgcaattacccaacaataggaaaatgaattctgccatatcattaaactccatagctagctcacacatatacatggcactttttgtacgaagactgtttttatttcagaaacgtgcgtcaacgatcttgcggtcaactccatcgtaggttcatcgaatccaacctagctttaactccaaaaacacatcattttttttttgaacattaaaaacacatcatcaaccccacatatctttcctcctagaatctccccatccatatcaatgatatcatggatatggtacatctccacacagaatttaacacaaaaggggctgtttggttcccagccacactttaccattacttgccaataaaaattgccacaccttgcctaaggtgaggtgattaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggtgtggcaaactgtggtaaagtgtggcttgcaaccaaacacacccaaaatagttatccaaactcccaaggcagcatctcagcaaccatg

SEQ ID NO: 68585 - DNA, 823 bp, Oryza sativa
ctgcaactagaaaattgtaaaaatactactaaaactgtaatttgagttgcattccttgcaaaattggaaaaaaaaagtggtaaatttgcaaatgccccgatgttatcatacacatatctgccattgttgtttcaagagccagctgcctagttttatctttgtgcgtaacatactatttgggataaatttataagcacaatcacaatatatttccttaacatttggttgcttgaatttacaaagtgtatctccatcgactggttacagtaagagggaagactgaaaccgttctgcagaatctcaccaagaatagctaaaactactggtgtgtgaagtgtgaactaatggcagggagaaaaattgaaccgtgtttgccaagtgctatatagcctagcaaagcttcagaagtgttcaactgcagctggagaaaagatgcaatatctcctaccaccatgaccagttcagtgctcatttcttgttgaatccaaacaaggatttgatggcgttgatagcattctcattgatgaacgattcgtcgtacttgttcagcaggacgttgaattcctcagttttcctcaagttttctagatccgggtcggtgcgaattctcttcatgaaatcaagcaaaatgtgtcactagtcatgaagaatgcttatctgtactgcaaaagagttgttgtctggttaccttgaagtcttcataacctgctttcagggcatcttccagtgcagaaataccagcttgtatctgcagaaagaaacatccacatgagttcatggacattcagtggcagatttgcttttcatattgagagaaatatcg

SEQ ID NO: 68586 - DNA, 1153 bp, Oryza sativa
tgggttgaaaatgatctctcttgatggtttaccgcgaaatactggcagtcaacaacgaaaagctgaaggcctcctcaagatgaacaattaccactagttctcaagagatcgctcagaattgaaaagaagcacatatgagttttcttcatgtatgactttgactgtttagcgtgaaaatctcgctagcaactacacagtaagagttaaatgctccctcaatttccccaaggatataagtaattaacatgcaaaaatatatatttaaaaagtcatgaacatcgatttcttccatatttcatgttataattataatttccaccaaaactctttaaaaattttatgtaccacatagccctaacctggtaatcgaaatcaaaaaattttcccttgacctaagggtcaagaaaaatccccaaattataataggcaaaaagtatggcccacttgtcaaagtgtcctctcttattaatcctcattaatcaaaccctactaatcttaatcttggcatccaaaatttcctaaatctatggtgactttatcaattttttcatgatttgtcggtccagtcttcgaacatgctcatagggataggatttgcgtgcacgtattcatatgggtaagtgcacgtgtgttgtgattgtctgcattatactgtataattgaaaaaaaatcccaaatccttttctcctctcataaataagcaaaattaaaacaaaaaaaattaaagcatcactaccatcaccaccaccaccgcgcttgctcttcttcctcccccgttttccccaaggcgcaaaccaccacgaaagcccccgaatccgcagcgcgaatttcaaagcagcctcccccccaacctccgatctcccgctccctcgctctctctctctctctctcgcgcgcgcgcgcgccatctagggttagggtttcgagaggatcccgctgcttgcgagtcccgaccatgagggtgcacccggcgccgcggaagcgcaccatcgccgtgcagcggcggtgcggggtggccgcggcggcggcggggatggccggcgggaagaagctgaggcggctcccgcacatcttcgccaaggtgctcgagctcccgttcgccgcggacgccgacgtctccgtggaggaggacgccgcggcgctccggttcgtg

SEQ ID NO: 68587 - DNA, 2192 bp, Oryza sativa
tccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtgtcgaccgaaccctaggcgggcggctggggaaaaaacggaggaagaactggctggggcggcctcagccgggctccaaggtcaacgccaacttacttggcgctgaggttgggcacctcagcgccgaagcggttggcgctgaggtagctgccacgtcagctaggggatcggcctggccgccacggtggcacaatgtcagcgccagtcccattggcgctgacacggccaacctcagcgccaatgcgtttggcgctgagccgacggcctagttttggttgaagtttttggcaggggttagtttcgaaataagtttttgaaaagggtcaatttgtcaaaaaaacggtccttcgggggtatacgtgtatgtttcggatgagggaagaaacggtacgtacgccgtcaggatcgtagttggactatcttcccgtattccaattctgatcgtctctccatgtcggagtctagtagtagtagcaaattaagattactcaattcgtactacacgtatatgatctcctaatccgagaaagctctgattcgcgcgtgcatcgaggcgccgctaggtttcttttttctttccggaatttcttttcgctgttagatttcttttttcttgcatataaattaactaattcgattagttttagataataatgataattaaggtaatgtttattttttctgaagattttttaagtaacagattgaaaagaaatctatacgtgaagtcaaattttgaaaacttttaacctagatttaaaaactttcaacttaaattttgaattttttgaagtcaaattttaaaaactttcaacttttcatctcaaatttaaaaaactttcaatccagatttgaaaactttcaacccggatttgaaaactttcaagtcaaatttgaaaagtttcaactcaaaatttgaaaattttcaactcaaatttaaaaactttcaagttaaaattaaaagctttcaatgctacatttgtaaagaggtgtgcaaaagattgaaaaaaatcggaaagaaattgccaaaaaaagaaaaacgcggcgccaaaatcgaaaaaaaaaaggtctgaacaaaatcgcactgccaaacccacagtgccacgtactccacaccccggaaaacctccatgcacggacgccgcgcgagcatggagtacatggactccatgacctagtcggagcgaggcgaggcgagggcgcgcggcggcgaggcgtggagtagcgtggggaggaagaggaggagcgagagcgcgcgccccgttggcctctcgcttctcggcgcggcgtggggaggaagacgagagaggcaagtagccgtagagaggagattttgttatttctgaactgggcgacgcgacgcgaggaaggagacgacggcacagacgcatgtctctctctgacaggtgggccctccggtcgggtcaactgtcgtcaatgacttgtaggcccaagcagggtgagtcggcctcgctgcgttaacttggtgtcaaatttgctctctgacaggtgggccctctggtctactgtcgtcaatgacaggtggatccgttcacggagctgtcaaattttgcccaattgaggctcagatttaggattgaatttgagttt

SEQ ID NO: 68588 - DNA, 1466 bp, Oryza sativa
tactatatagtactaaatgtgcttcaatgtgttttatttttgttgctgcaggtagtgtggatgccatatcaggcacaggaagtgctcgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacgagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagagggcggcaccctccgcaacgccctacaggtaatcgttggaaagagatgaaactacggtgttttcttccaaaagcgataacttaacatggattattttttatgcagagactacgacagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatagatgtatggactggatgtatggactcgactggatgtatagccgaggatcgatgggatgtttttatttcttatatgtatggacttcatatatggatgtattgatggattctatggatgtatggaatgatgttgggattgatggatggatgtatg

SEQ ID NO: 68589 - DNA, 4833 bp, Oryza sativa
catatgggtccggagatcatcagaccacatgtcagcgtctttatcactaacatataggttcggagatcatcgggctcacatgttagtgataaaggcatggtgtagtgactgcagaggatttggccaatgcatggcaccatgccattaatcatactttaacatataacgtatacactgttggattttaaaccattcatcttattaaaataacaaaaaatagtataattatattgaagtataatttttacttagaatttttttaatgattaaattacagcagaataaaaaggacatttgacgaatgcctacggtcaacaagtgttaaaaagtgaacgacgtcatctatttaaaaatataggagttagtattgattaaggattttaatcttattattaccaataacaccagcgttttcttaatgcttattaactaattcttaattatttgcatattgcagtggttcttcaacaccgttagtctcgtgctgtttgggatcgtcgttgtgaaggtagttccacactgcaagaccatggaggaggtgtttgcatgcattctcgctatactcaccgtccttgggatactaatcatgggttattgcatgataaaaaacactaaagaggatataaaggccatggagggaagcccgtgagattccaatgtatcatcagcttgactctatctactttctcttttgttattttttcaagttggtacttggatccacttagagcatgtatatatcagttaattaattagcccaatgcgacatatagacagtccataataagggatgaaaacggttgaaaatgttcggaaactgtattgtttttctattattttatggaaacggttgaaaatggttgggaaattttaatttttatgaattaaactgaatttcaatgttaactgcaatgccgcacacataaattagaaaaacggtaacatttggtgaagtcaatattattatattagttttacgaatatcactatgatcgaaaaatttccctactccacatcaccaagagtctgtactgatgaaatagtcatctagcttaaccctttaatttttaatcgctaatcgcccctcgagctcccttctaagatgattatgtgatgaggtggaggaaaaaagttaggagaaagaggatgagatatcccttatatatgtaaatataaggggcaatctccacacaatcttcaagaaaagtttaaaaaaaatagtgtgagagtgaactaataaaaaacattattagggtttgtattagagatggtatgttgtacttgttacctcttaattaattagtagatgatatggctcaaattagaggtaacattcaccttcattataaaacttgctctaacgcttcttttgcatcgtattcctcgtagaattttcatctcagagcaagtttaatagtaggctataagcctattataagattacgcggtggagagaaaatttgaaaaaaaagaagaaggctggctcacatgcaactgttagctattcatatactccaaaataaaaacattaaatgcataggtgaaagatagagaaaggagaaaaaaatagagataagggcacgcacaaattaaggtctctattagtaggctctctcaattaccacgtaagcaaatttaatgacttggaagagagagataaagcaagatgaaaatatcgttgtttgctgtgacatcggcgtaacaacgccctggagtgagcaaaacgcggagacgagaaggaggaggaggagtcggcggtcgtcatggcgacgagcgacgggcggcgtagggaatcgagaagctaataccatgtttgacggatagactcaacgtgaattgtattatcacagagcaatacagatataggcatcataggccatatgctctcaaccgattcatggcaataaaatttgggagaacaaggaaggagagccaatcacatgatacatgccatatatagtctaacatgtgcctcgttgcacaacgcggtgtggggcatagagtttccagggtgttttatctagtacactctgattgtttttaaaagaatttaaacttatgtaatcgagatagaagtgtattgtgctgcatctgatagaagtacactctgaaagcacttttaataatttaactatgttatcaatatagaaatgtaatttgctgcatctgatagagtgcctaatggacaacatttacacaaccattgcttgttcacttaaattattctgcatattttcttgtactttgctctcttaccaatgggtctgttgtgtattagggctgcattgccctaagacaatgttagtactacagctgcattaaaaacttataaaactctttccagtgtgaaaatacagagtttccagctctttgagaatcatattgctgtatatgaaacgtcaaaatggtctaccgaaagttaccgcgtatcgcttaccagccactggagagccaattgggcaacttgagggaggtcgggagattgattttgttgatccagcatatgacgtggaacctgagcaatcacaatttggttcatctgttgttcggttccattatagctcaatgaggaccccaccctcggttttcgactatgacatggattcaggagtgtctgtgctgaaggttgtctttggatccaaactaataatttttttcatcacatcaacctgtcatatacacacaactttttagtcacatcgtaccaatttcaacccaaacttccaactttagaaggaactaaacacaaccgaagaagtatgatatcagtcgcactgctttaaatagctttctgttattttgaacaaactaattaatatgttggcattgtttaataacaaggtatatatgttcctgaaaacaggttagtcatgttaggcatgtattgtgcacctgtttcttaaattccactctgtttgtcaccgttgcttaaagcacaatgaacatcgattacttctaacagtatagttgatgatgatctgtagtacactaacagtatatgttttagcaaacctaatgctcgtaaaaattatgaaagaaataactaatttactgatacgatttttcatgttcagaatgaggtgctgatcataagaggttgtcatcagtgtttttttgtttttattaacatgaactataatttgcacagttatcacatgtgcaagcactattttatgtgcagtaacacctgtattagggatggcaatgggactgtccctagcagggggcacagctcccacctctgtcccctgacacctaaaaatgccctgttccccagcaccagccaggatctggttatgttcagaatgaggtgctgatcataagaggttgtcatcagtgtttttttgtttttattaacatgaactataatttgcacagttatcacgtgtgcaagcactattttatgtgcagtaacacctgtattagggatggcaatgggactgtccctggcagggggcacagctcccacctctgtcccctgacacctaaaaatgccctgttccccagcaccagccaggatctggttagttaagggacctccggtatctggttttacggttgggggacgattttgtaactcgatgacaagttgagggacctttggtgtacttttcccatgtataatcgacttttttttatctcgatttgttcaatgtatcgtttgctgcggcaccttggacattccagcgtatttttggcacctaaaagggtctaattctaactgaataaggtcagctacaactagttttcagagattttgactttgccacggacattgttggcagctgaataaacacatcgtgtagatttgattctttgagaaagttaatataagccaaaactatactttctacgggaagctgaatttatgtagtatgtagaactcatataagatgaaacagttccagtttgtacatatgattcttgcgttccatgggtcccttgaatatactcaaatatatgtatggcaattctcgggatcttgatttttagttatcgcaccatgtcgtaatttgctgccatgaaacatttcaatttccatgtactccagttgcgagccaccagccagacagaaacaccaatcgcattgcaagttttaacaccaaatctccagtgctaattaagtgctaacctaccaggaataatcatggtctatctatgcttgctcactgctatctttgactcgccggtgttcttttctttctaccttcctcgctgagccacctgcaattatgaacgaaaatgaactgtaatctcacatacatatcacattgacaagaaaccaagaatagtactggtctgtagatttatataaattaaaggaccaagtatcaactgaaaaatggatgggtatcatcggagggaggatgctaaatctaacttggactgattaggggcaaagctatcgagcgcaggttggggtctgtaacacaaaaacgcatgctagggtgatgctcttcagactcagagtcactcgcaatgctgggaaaatgcgcatcagaatcacttaagagagccagccagtctatcaaaaccgcttggatcaattgaggtttccttaagtcgttctttcaaagtttccagcaaaacaatccctggaaattaaatcagacaatcgacccaacatggatcagctagcaatgcgagatagataaagaggataaacgagaataagaaataccaagagcacgcccaagcacagcgaggctggcattttccgtgcatatataccatggccaaatccttcaagctgatgagcaaatcctgcattgagcagcccctcaatcggagatgagaaaccggaaaaggaatgaaaggcagtggcgaaagaga

SEQ ID NO: 68590 - DNA, 2282 bp, Oryza sativa
caattgcccacaatcttgcatccttcactcttcatcaccgagtgctacattcctttcaacttcagctgcacatcactcagcccagtcttcatcgctatcatcgtccacattgttatcctgtcatatgctgttaggattagctgggaggaaggcacaacctcataacaacaacaacaacaacaagaacaatggccataatgtaccaatctactacactgtagctatcagaaaaacaatcacctgggaggaacttgagagcacttcaatttcgtcatcttctacctgtgacagaaaaatgagggcaaaggcaatcagcaaagtaaacaatgggcgacattcaaattaaaatccctgatcattgttgctaagtaaagtacctgtgtttttctctttttctgacttctgccagctacatccatgtaaatacaattgtcagcttcatatgaagaacactaacatgtactgatgtactcagttaaagaaaagctgatagatcgttgcacattgcactaagagccactaaaatgcatttgtttccccccatgcatcacagcttttacccagcaatatcaagtcttgtaaaattcaaatagcatatttagtatagagccaccacaatagatgttaattccatcatttattccgattcgacaggcttgagatggtcctaaagcttcatgaaatggattaatattttaaatgccccttacatagacaaaagctgaaagcttctcaagtaagcctcccaaagcctttggattattttagaacaagtcttctccattgaagaaggccttcagaggcttaaaacaaatgtaatcgcaccaaggtctattagatgcttctaacaacagacttgctactgcacttaccactcttcttccctgttggatgtttttcctctggacttgctcgctgcttcttagcagcaggtcctgtagaacaatgccaatcacaagtccaatcaaaaggaattttcgttgtgtaataaaggaaaacacaagaaacctagaattgcgtaaatatgaagaaccttttgttgctggagatcctttcgggcttctagtacatctctgaaatagaaatccttttgtcagatgcttaactaatttatttgtaccaggcatgaaaacagataatgttcaaaacacacatacgaaaaaagaggtatgttgtgaagttggttcaattaatgcatcaagcaaacattatatcgaagttaagggtataactgcccactatcacaaggagagaaactattataataacaggtatgaatttccacctttttttcttctgcttttttaaacatgctagacagagtagcctgaacgagtggctccttcttagctgagataggctgcgcagatgaatctgcaggtttaatgtcttcactttgggattcattcttaactgccggactcttcacctgcttcaaacgaagaaagcaaataaacacaataaaattatttacaaaagataaaagcttgatagacattgattcatatatttgaatcttataaaattgagtaaatttcagaaaactgcaactttagtgacaaaactatcagtttgctgcaacataagcgacatgtttcagtttcctgcaacaatagcgtgggaaattttcacaaaactgcaacttttacattatatgctgctacttttacgttatatgcaacaaaagcgtgggaaattaaattcggtatcactaccttctcatccatgtcctcagggacatcaatctcatcgtcattatcagatgaatcgtctccagaggatatctcagtatacctgcataaagagcgagggatctatcaagtatacctttttattctttgcctttttttgggtgggtgggagatgaatatatttgtttttagaaacattagccgttaagccaaataaatacaggtagtaggcaatctttcagctgctaagcaacaactagagtccgtgtgcttttctgtttatccgagagagcaacagaaaagggtgaaactgacttacttcaaggctttcccagcagttctagcagactgcctaactgaaggtgcttgactagtgctttgtgtgttatcctcgtccttaaggtctgaatcctcggaagaatcaatgtcagattcaatctttggggaaagggatcctgtggtggtttcctttggcggtttattgatggtaacagcttcatcacaggaagcacctgctccacctttaaaatcagaatctgcaacagccccatcctaccagtttgaaatgaagaagcacatgagatgagaggc

SEQ ID NO: 68591 - DNA, 4237 bp, Oryza sativa
agggaagaggcacggaaagtgtccatgactccatgtcaatgaggagggtgatgaaggggagtaggctaaagccaaagtcgatgatgatgccgatgtcagtgtccatgcgggttgtgaggccgagccgctcaagctcattgcggacaaggggtgctggtgtggtgttcccagaacgtgacctccagatgggcgtggatgtggtgccgcacgcgcaccatccagtcccgtgcgccacaacagcgcctcctcgtaacttgcggaggcagaggaaacaatgaggaggaggaagaagagaggagccactctttctccaattcggtcaccacggctacgattcagcctccgctgtacctcctttctcctccacgagctccacctggcctcctcttcatcagctgctccctcatcaatgtgtccactagcccctgaggagattgtttgcaccaacagcccaaagcccgtcatgtggaacaacggcaagatgagcaatgtcactatgaccggcaacgacagcttgccacttcgacttcaatggtttggcggctggaggaggagcagcgctgtcaagccgtcctgatttgaagggaaatagacaaggatgagagtggctgcctgggggaaaaagaagggagtagttgggccgggctgagggagaggaaatgggccgtctgggagagggaaatgggggctggcccaaggaaggagagaggggataagaggataggggttgtgttttttttcttgggaattcgaaggagatttgaattggaattggaatttgaatttgaatttttgtaaatggactgtaaaagggactgtgaactttgatattatgggagtttatttgtggacttggaataagaggtttgagatctttaatggcataggcaaaaatccgaataagaaccaaattttgaaaataattttgtatttaaaataggttttaaacgaaacggaaaaatcgggatgttacagaaactaaggtctcctatacgggtaggcatctccgcctctccggtgagcacctatggttgtggtgtgccacgggaagtttgtcaagactttcgatttcacctccgcaaggggaaaaaagatcaagagtgaaatcgatgagtgtattggtacaacctcatgagaaaaagggttgaaagagactcaatttttgtggccacttaacggaggcttggatcgttcaatggattttatgttggaagttttaatttgaattaaaagttctcaccattttaatatgttatgagatgtgataataagaacgccatttaatttaaccccccccctctcctcgcgtaggaggcatcacggttctttcattagggtggtcaaaaaggcttaaggggattcagctactgtcagcactcatcagaattcacaacatcatgcatgtttctacctagtttagcataaacagtaatatattgctagagttaagtgcgttcttgtcatcaatccgtaatatgcatgaatacaaattgtcctcataaccaatattttcgttagaaacccctgtttcaggcttttcaactataaaactagtatattccaacatcagctgaactggaaattctactctatgtgtctaaccaacacactaatcttttgccgagtttcctgagcctgtcataaattcagcacaaaataatttgctaaatcatgggtctccttcctcggtgacaacaatcaacatcatttagataaattctactaccaaagaaacacaaaatacacccaaagtgcataattttttctggtgttgcctaacattaaaattcatcatataagttcaaccgtcgtcaatgatgggcgggcctgtgtacggtgagttggcgtagacgcccgccgcgttaacttgatgacactactacgaaaatcatcgttcgtggcgggcattttaggttttcgctggcggaatttggagccgccacaaagtaaaggccagtgaagatataagattttcgctggcagtttcgtttcgcttgtgaaaatctattttcgcaagcggacacatgattttttgctggcggttgaggtccacttgagaaaactcattttctctggcggtttcctaaagataaccgccagtgaaaattaacccaccccgccaaaaatcacctaccccagattcaaaattccccagccggccaaatttataacagtcttcaaatccgcatcacaaatacataatattggtatcaatccttaaatcctcatttagatgggcagcatgtacagattgaaatccacatccaaaatttcgagcatccattcaaatcctcgttagattccattaacatgcaagtgaacacgacatacaagcattttgaagatgaaaaagaaaagaaaaacaacatcaacaggagagaggaaggagatcgtcatcgccgtcgccgaccgagcagatgtgggagccccatcgccgatcgagcatcaccgccgccgagctcctcccgccgcaccaagccccgcaacaccagatctgagaagcccagccgctagcgagaccgtgggagggggagggggaggaggaggagaagagaagaagcgcccgcctccgtggccgtcgcgcaccgcttcctatcgcagccgtgcgctcgcctaccaccatcgcagtcttgcgcccgccttccaccaccgtcgtggcgcgctcgccgccgttgttgtcgcgcgcccgccatcatcatcgtcgcgcgcccgcctctcctgctgtcgttgcgggcccacctcccgccgccgtcgcgcgcccgcctctcccgccgtcgccgtgcacctgcctcccgccttcgccatgcgcccacctcccatcgttgtcaccacgccggagccaccaccgccgactgtggggtgggaggaggagagagtgctggtgggggtagaggagaggagaggctggttgatgaggatggatggataagtactactggccgttggatggtgatttttataatggctgtgaattttttcactggtgttggtgctctttagtaccgctagggaaaataggattattgttggtggtctattaagatgtctgccagtaaaaatagggttatttttacaagcggatttcttaagcaaccgctagtgaaaatggacataaaccttccacccctctttaaaatttcgcaagcggatttgttatataaccgccagcgaaaagaataggataccaccataaaaaatcattttctagtagtgtcgaatgaccgaaagctgtgaaaatttgctcaaatagccgcaggttcaggattgaatttgagttgactgtacacaaaattgatttaacgtaccgacttgttttgatcgctgctggagtgagtttgcagaatttaggagcgtcatgcccgccatggatgctcgatcgatcggtccagtgaataaagataacttagctagtacgcgtaccattcaaaaattcgattaatagcgggaaaatattatgttatatagtgtacgacatcttaccaaacagttaggagtggcatagccgcacaagaagattactctttgcaggcatgttgctttacgcaaccgtatgcgataatcaatctttgtgtgcagtcgtattaaacggcctgcctgcgaatctgtgtgctgttggattgcccacacatgaagattgtggtcttcgtagaccttttagagtagacgggccgtccaaccacatcactactggaaaagtgatctttgctgagtcggctgatttccacaatagttccggttctaataagaactgggattaaagattgtttttaatcccggttaaaaatttttttaatccttagtcccgattcatcccctatcagaagcctatcaggggaccgatgatctttaatctttactcccggttggtattaccaatagagactaaatatccatatatctttagtcccggttggagttaccaaccagaactaaaaatccatctttgttttaatctttactcccggttggtaataaaatccatcttaactccagaccaactgggagtaaatatttctctcccatctctggtcggttaagtcacaggtgagactttcctcctcaccaagatatttagataagatcggatcgatcatcccctctcctcctacccctcagatccccttcctcctcctaccctcccatccggcggccgacggcagcgggcaggtggccagcggccggcagggccgcgcccggcgccgcggcaggtgccggccgtggcaagcagcatcaagca

SEQ ID NO: 68592 - DNA, 2421 bp, Oryza sativa
ctttttttttctttccgcggccgatagcaatattttggtctcgtagcgctagctatattcagattacattaagaaatacatgttttatttttttagaaaataatgtaaaaatatacatatgctacgttgagttgtaaaacgaaaatcacaactaaaccaattaaacatgtttgctcccgtagtgatgcatctaactgattgtatatatatttgtatgcgggcgcgctaacgtgtttaattcagcggcccaatagttgatcaactggatcatcggaagcaccgtgcttcatttttgtaattaatgggttgtatgtgcttacatccaaaaatattgagggaaaggacatgactctttgattacatgactaagaagattaagtcttccaactaattaatagaagtccataccaaaattacaacggtaaaatgtatatgagtaaaagagaatttaaggctttgacttcaatttcacaccagctcattcttgtctagccatgttgagcatgtggttcaaccatataagatttatagatctcaaaagtgaaaaacaaataaaaaaagatcagagcgagtcgtacatttggcccattttggttaccgaatttcctttttgccacccggcctttatctaattcttttcaactttggattagatacttctactatttctttttttcttaccactaaacgctcttcccgagcacaacaatagcctttaagcacatcggcaccctaattaacgatctcctctactgatgtgcaacatctctgacggaagataaagataaaagcgtagtccaaagtgtaaattatataaaaatacctagtcgaaaacgaaaagattacgtagaaagtagtctaaagtggaattaactttgttaacaaaaactgcacggccaaaatacagtttattcaacaataaaataagcaacaataataaaattcgatctcgaccggtacggttcgtgcatgttgtgtactccctccattcaaaaaaaaaaagacaaaccgtaggtttccgtgtctaaagtttaaccgtctgtcttatatgaattttttttataattagtattttcattgttgttagatgataaaacatgattaatattttatgtgtgacttgtctttttatttttttcatattttttaaataagatggacggttaaacattgaacacggaaactcagggtttgtctttttttgggaacggagggagtgcatgtatagagaaagaggtatgagcgtacttaccaagaatgctttcgcggcagctcgggcaagagcagtagggtgctttcgtctctcgatcgtcggaggatctgcaggccgtgccggggctagctgcccttgttccagcaagctgcacatgagatcggcctcggccttctccatatatcgctcgcgatcgatcgaggatcaatacagctggatcgatcgaacgttcgcatacgcatatcgatctcgcgaaacacgcagtgtgtatgtatatattggaagataattaaccgtgttcctacgtgtatgtttcggaacaggatcgagttgaacaactttcccgtgctccttagtgatcgtctccgtgttgaactccctactccacgctaatgcacttttaccggacttctattggtcacttggcgcactaaattaacaatcaatttggtcgatccgtggtttagggaactctctccaataatccggatgtcacaccgtgaaaaataaaaaggaataaattcactttaggtctctcaaattgtcaaccattctgattttcgtccttagttcggaaagccggatgtgacgcatcccccaacttataaaaccgtgcaaacgaggtccctcggtagtatactctctgattttggctgacgtggcgctactttgactaggtctttatccaacgtggtattgatgtgttacttacgcgtcaatttaatccagaaaaacaataaaacccgtaggacccacatatcaattacacacacaaataataaaaaatagcggggcccactgtggcccatatgtcatcctcactactctcctcttctctctctcgggcaaagcaaagcagcggtcgcccggtgaagctggttgggcgacagccggagcaggggagggccacgggcagagctgagggatggagcagcgatgggccacgggcggctcctctcctcccgccggccggcgcgcgggccatccactccgccccgctgctctgcccacgatccaacgccgctcctcttctcccccgctcttctccccagccgtcgtcgcgtgctcctcttctcccccacctccgcgcgctgctccttccccccgccgtctactggggcgaggcgggtagaggcgaagagatggctgctccgcccgccggctactggcacccctctactctggccgcacatagagagaagagggag

SEQ ID NO: 68593 - DNA, 3157 bp, Oryza sativa
  unsure (1)..(3157): unsure at all n locations
ccggtgcaatatatgtcntaagtcagtatagtgaatggttttgttctacgtggcaatttcaacagcactgagtcagtgtgggccccacatgtcatatctctatgttctctcggtggtgaggaacacggccgctggcagagggttgtgaggaggacggtgaccgatgagagaagctagctcgatagaggacggacgccgatggttgccgtcaacgatgggtgaccctgacaacgctggtgacaaggcggacaaggaaggcgagaccagggagcacaatgtcgtattcctctcagcgcccactccattatccgcagcaacaaggagaagccgagtatgctgttgtccgcagggccgaggtcctcgctccagggatctggcggctggccgcccgccgtcgtcgggagccgagggggtccgttgcctagtgccctcgccgcttgaccgcccagatctggaggctggccatccgccgcctcgggagcctggaggcccgctacttggtgccttggtgtcctccgtctggtggacctcactcccggggaagacattgctccggtgacaccgccatgagccaatggtggggagcgagaaggcaacatcgggaaaggaagatggcgggcgggatggcgagctcgagctcgccagctccccttccctctcccttgcctttatcttctcatcggctcccgcttgctgcaacctctccgtcaacaacctttggcgccctccctatcccggtcctctgctaactctcggcctcttcagatgatgagtagccagcggcggcggatacaaatggggtcgaggtcagtgttggaggcgagctagagcatgtcacagatgtcgtcctcctcaccgcctgccactgggcgttgtcctcctcaaagcccgtcgccggcctcctcgcagtgcgccgtctgttgagattggaaaaggcaggaagagagatataggtggagagagaggtgaagaatcgctgacatgtggagcccactctaactcagcgatgttactcgggtcaaattgcaaattgccatggaaaacaaaatcactcaccctactgccttgcgacttactccctccgtcacaatatataagggattttggtgagatgtgacgcttatattatgggacggagggagtatattctaccggttttgacagttgagcgatctgttgtatcttgttttctgtttcaatgacgaaaatcagatccgttgtcaagttaagagacctcagatgaacttattcctagcacatttgtgttgttgcatattgcctcagctaatcacgcgtgctggaacaagcagaaataaataggacgatcgaaaaaagagggggaaaacatgcaaaagaattaaagaaagatgaaaaaataattttataaaaatctttagatttgttgttcgttataattatcatttatcgaaaacattttttccagatagcatctataatcatctattgaatacaactacaagtagaaaagaagagtaaatttcataaccccatcaagtcacaaaaacccacaggtattttggcatgtggcacataactcaattattatgatcctaaagttaaaaaaaatgcactgttaactattttgacatatactcttgtatcaaaatttgataaagtggatggaacatttatatggtggatgaaatgctcataaatttgacatgtgattatagaactcaaaagtgtggtagatcaaagttaaaataattagtaatgtagttttgaaaaatattaggaccataatatttttgggtatgtgtcacatgctaaaatttatgtggttttgttcaactttgatcataataggtggagttatataaaattataaaaaaatactaacaatcctaaattccaatcctactttgattcgtctcagtcttcaaacaaacacaaaattaaattacactaatagatctatttaaaagtatgatttgtatgtccgttaaaataaatcatgtaaaataatgtaacttttctatgttctaatatgtatctgttcgattttttaggaccaatcatgtatctgtttatcgtatcaatgtgttagaaatttcttcatgccaggtaattaattaacaaggggagaaaacaccgcacataatagtgtgtatagttaatctcataaggaacacgatcccacagcgtatgacgcatgcaccatctgtcacaggtaaaaaagaggaaaacacctgacagcaggatatagagtggtacgatcgacacagccgtcacagagagagcacactaaactgcaggatagtgtattgttgtataccatgcctaaacgggtctgggatgaacaaaatcaagaaagggatcgagaaacacccatctgtcagctattggaaggaatcttcgacatattgcctgtccccaaaaagtaaccaaaaaacagaggataggaattagagatagctagggaatatgtatacagtacccatagttgtaaaaattgagtttatatatacctgataaaatcaattccatttcctaaaggtccgggtcttgatcaacgcccgtacaacagctctgcattaacaattaatgataatgatacagtattattatctacctaccatgacattatatagaaactaggaatagataagagagaatttaattatttgcttacccttgcccacaaatacaaatgcccaaatagcaccacactgccaatgaagccaaaaaccaacctccaaaaccacaactcattgtcgtgaactgcaggggccaaaggtgacgagggtggaggaggggccaatggcgaagttggcgtactcagtgccaaaagatagatgctgtatatgactagaactgaaaaggccgcatacaggacatgtcccatatgccgactgaagatctttggaaacttctccccaaacatcccggcagggagaccaacgctcccgaagccccagatagttgcaaatgctgcaagcatccatataccataaccagcgggcaacagaggccggagaaagaataacacggctaaagatgtgcccaatatgtagacatagccaatttgtcttttattccaaacgtccttgtctccctgtatatagacattaacattatatgcttgtactgaaaacattaacattatatactttatcgttaacattgcttaaagcac

SEQ ID NO: 68594 - DNA, 2677 bp, Oryza sativa
tcgtcagtcagagttgaggacaacaatttatcatcccctgcacccatagcaaaagaaaaacatgcaattagtgtgatacacaagaagtactactcttgcaagtaaaaacagtaaaagtaattctaagttaaagatgttgaatttcacactaaactgagaagcaaacattaaaactgtatgccagcatcggctgaactgaaaatttactctacgtttctaaccaacacactaatcttttgtccaattcattgagcctgtaagaaattcagcacagaaaagatccgctaaatcatgggtcgccttcgtcggcgacaaaatgcacaacatttggataaatcctactgccaagaaacatatattatacccaaagtgcatacattttttttctggtgttgcctagcacgaaaattcgtcagttaagtgcatatatatttaacttctgatgtcctacaatattctttagagaattcctaactcaacatgcaaagacaggactggattttccacaaattcaaacaaacaaacaaaaaaggacttgtgttatttactgatctcacaatatacagtgctgaatactacacataactgaatactgcatcgtcgcaaaaaaaaaaaagcattactgaatactgcaaaatatacagtgctgaactagcaaaaaggactcgtgttctttactgatctcacaattggtttaggcctttagggtggtcactggaacaagtaaaaaacaccagtaactaacatagcatgtcacatctgcaaattggcagcttcataattcccaaatagaaagtcagaggcatgtcgtgaatgcttcagaatgttcagttactgtcaacactaatcagaattaggttgtcatagaccagtgttaacataccattcagctaccactggtcctgtctatctacaatattcagatgatcatctaaaaatttcgcgacaatcagataaaaatatcgtcaagaaacacaaaatatacccaaagtgaacacaaatttttggtgttgcctaacaataaatttgtcagataagttcagatacatttcacttttgattccctacaacattcttcaaacaagtcctaactcagcattaaacatatgacttgcatttttccacaaattcaacacggacaaaaaagataatacacattgctgaaaactatggtgctgaaaaacagaaacatgtgcattgcccactggattgttaataatctctagtcaatttctagtgatgcatgtcatatgttctttttgcagcaaaattcaagagtacataaacaatattcagcaacatgcatataattgcttaattgaacagtactgaacaatttatggtactgtaaactacaaaatctacattattgaaaggacaaaagggacccgaaaagcagaacattgctcacaggattgtcaatattctagcaaacatggccacaaaaaaatgtcaagcagtcttcatttagtgaactacccaagactcattgatgtagtttaaaatttcaagaactcacttgtgttctaactggtgtaacaattggtcatccgaacaagtaaaatacctctaactaactagattccacatctacaaactgggcagcgtcaaaattccccaataaaaagacagagacaccctaaatgcttcaggaaattcagtcactgtcatcccctatcagaaattcagaattcagaacatctacggcattatcaataatctcaagttacgcaggacatttagaaacaatattcagagtattcagcagcaacatgcatatcaaattagtctgattattacctgtggtgttggtcctaataaggacgatatgtagggtctcctgactgcgaggcaggttgatgagcagaggggtgagccgcccatggaggccggtgcggacgcacagcataaactcatcgtagcccacaatgcccgcaagcttctctctcaggagctgcactgacctcccggcgaactgacatgactcctagtgtacttggccagcgtcagcggctgcggcgtcttcggccgtcacgaaccggatctcccgatacagcgagcacgagctagtcaagttgcactgcacagtagcggaatgaatttgattagttcacatatgattagttctcgcaagaaatctaagattaatctccgacccaatcagcatttgcaacagagaacaaacacaaaaattacgaggggatgaggagacgaagctcacgtacatcggccatgatcggtagctccagcctgtcgacgggcaccacctcccaccgcaacacgttgtttccttgtcaacgttgtcgtcgacggatacgctgcggcggcgagccagaaagtttttgttgccgcgcagatagcgcccggacctgtccagcagaagaacgacgcccgcgggcaccgtgactcacgacgctagagcagccggtggcccgccacatgatggcgccgacctccagctggcaccgcgctcacggtcgccggggtcgagagtcccgaggtagcggccgtaggcaccgcggaggagaacgtaccgcgtgggcggctccccgacgacgagctcgtcaaacggcccacacagcgttgtgctgcaacgcgacgccgccgccgcagccgccgagccggcggtggtagacggaccgcccgtcctcgtcggcgtggaggtacgagtcgcact

SEQ ID NO: 68595 - DNA, 3084 bp, Oryza sativa
cagagagaattttgaaagatacaaaggtcaacatgttcttcctgtgttagcttcttttatggaaaagaaacatcgggagaacgtatgataaaaatgcagagatatcgatttcaacatgcaagaatgtgttagcttcttttatggaaaaaggcccacaaggccggcatccggtaatacaacatttctttacagttgcaaaataccgaaacttctaatgctccctagcccaatgatcatgcgaatcctcttccatctccagatctcctcatctctcgaatggcaatcgcttcaacttcaatggaaggcagccagccagccacaccgtcaacagacggttcgcccgaagcagatcgatgctatgtacagatttttcgcccatttatcctgcgaacagcacaccggctatgttactgaactccgaaacgcgagaaattatgtttgttttttacaagacacggccggatttcaatgagctgcgataatgtatataccttgacatgattactggggaaggcagaggtccggagagtttcttgtgtctcgtctactggcttccgtttcggtatgctcaagataaaagcagcctggtcatttgttgctgctattgaggttattctgtaaccagtctcccatcgccgatggatgccttcacttggatataggaaatccaattctacaacctaaaaagggcatgagaaaaaggttagcttcataagtagatatattctacagtaaataatggaatgctcacaggaatataaattgccaaatttgtggactgaatatgaactaggtcaagcaattattctaacctgttcagagtaacctgagttccttgacataactacaccccagcgatttccagcggtggccatagatgtcacatgaaaaccttctttccactttttattgatccacttgaaggggaatgactcactaaccttgtatgactgttgggagtaaggtgttcctgcaataatggacatatcaaactataggtgatcacaactaagccaggttaactcatggggagcaacaaaatgattaagtccatatgaaacatatggataattcatcgtcaaagaagaatggtcgggatataaaatgactaataagaaacacatcccagacctttggacatcacaactaaagaacttccgttagctgatccagctattgctgttatgtagaaattcttctcccactgatccattatccagtcctatgtataattgaaacagagttaggactctcagcaaacaaataatccaagtactaattatcacacctcaacagattgtactttaccttatgcagaaaaactggtgagagctcatgaacttgagaaaggaaaccagttcctgcatccattatgagggcccaaagatttgctgaagacgccacacaactaatgtatagaccatcttcattacccttctctatatgctgctgaagcctgttgtcagccacgttatagtggtacctaacaaagaagtagcataacttggtattaatttccttgtagcaacaatattgtcacaccataaaagagtgataatgattcatcaaccaaatttcaagacctgttcaagagaaaggcatgcacagagaatcacaacaagatgacattgtaaattttgaaagaaaaaagaaacaagcgcaaactaaaacccatgatcactagcacttacaagctgtattaatatcaggcacgtgctgtctagttagtgaagagttatttagctttttagatttacaactatatatgctgcactcaaatgattccaggactcaggtcacttttagaatgttctaatcagcgcaccagagttaaatgtatcatgctaggttttgggctatcaaaattcagatgtgacaattaataaatagttagtagcaatcaagatcatctgtattgggcctgaaacggtgcatgtttaaaaagtagtttgtctggactcatggagcaggagtaacatgacatgtgatccaaatttaacatgaacaatgtgcaatggattattatcttgaattaaaattaaatggtctgtcaggtacccaaaactgtctttttaagaaaatgtcgagtttgatttgacaattcaaaaaaaattaaatgaaatatttaatttatcacagacaaggcagtaacttgtgttttcaaattactattgtttgcatccaagaaaagcaagtacctagactaaacaaatgcaggtcgatcatgctttatatcatctagttctttgatgtaattacctttgcttcatggcccgcctggcgttataaacagaaatccattgagctgctgggctacctaatctaactttcttcttgggttgctcatcttcttcatggtttcttccacgtttctgcccaacctataatttaagagaagggttcatggacagatatggagcagacctaaacaaaatatggaagtgagtaaaatggtgggtggtacagaccttaagagcgccatcaattctgataggtcttgaggcaggtacccaatcaaactatcaaagagagaaatcagtttggcgtaatttggctcttcatcaaatttcatatttgtgacaacttcaagaaactgtttgaatggaggtggacagaaacagcttagcatctccggagaagtagccattttcttcttgcaaacaaggaaactcttggtatcaccctgcataattaagcaagcaacattagaattggctaatctgaactgaagttggtatcatgaagttaataggcatattaaaatatacctggtaaccttgccaaggcaatcttcctcttattagaaatataagggtgtacgccaatgactctaaatcatccctcctactaccagtacggcctaaatgggcatggacactggcatatctaattgtacccctgaaaaaaaacgaagataaaaataagtaaaaagcactatatgagagacagatagcaggtacagagagaatattgccaacctaaagatatcaggcctttggtcataatcaacatgttgccctgatgactccctccatttcgatgctgtacaatttggacaatgccatatcatacaaaaaatacttg

SEQ ID NO: 68596 - DNA, 2330 bp, Oryza sativa
atggatttgctggggaaggatctcactcaagttaaagaatttgagccaaggtacatacattttttgttcactcccatgtttatttacttacttaattactgtttgttgaaatgtatggtgaattttggtgtgatgtagttgttcatcaatttaggtagagacggcttgttagcagaaatgtgggatgtctctaatctctagaggaatgttctggtcttaggtaatcgcttcacgcgtttgctataagtcatggtcatttgtagttggttgatattaggggttcattatcaaaaaggctgagtcaatggttgttttttttttgccttctgtcccttgatgatggtggacttcttttgttattccgatgtagtggccgtgtaagatgataatggggcaagtcgttaaagtattgtgcaactctactatattttgactttggttttggtgtgtaagcatagatgcggctgctgtgagcacagtccatctggtcatcatcagattaagaaattagatggctggggtcatactctgaagaagtaatatcacaatacattactaataataaaaccccaatttgtcgtgcttggataacggtgaagaccaagccatcttcttcccttattgggtagctgctctagattttttttcttcaatgtgtccaaaattggcggttttcttcaatgcagcaagaaaacataattgaatatccaaattacatttgtcgctatctatatttgtgcaagaccacctgtctaaattgaggcctagccactttgcactgcactgaagttgtcatgtacttcgcttttggtcagtttttctttgtaattttgggtaaaatgtaaacctgaagctctgcaagagatttgatttttaagactgagatgtatccatgcagcagccataatcagatttaaggtgtgacatggacatcatctttgtaaatataggtcatgtccatctgtcagtgaaatgttctgaatatgtgctactcaactaattaattataagtgcatttgccaagtttactctttccagatatttttcttctccaaacttacacgtcaaaatggatatttgattgtcaagctgcaagcaatcttttgtttttgtcatttctatctaaagaactggttaactgttttttcctcaattagtttgcagcaaaccaagtgggtaattgtatatcaccttgtatgaccctctgcacatccaagctaaagaccaagcaagctttcaatctagatcagcagattcagcaccatctttattaaaaaaaaaaaatcaatgcccagggcggttttgtacatgaaccttcatttttcagaaaaagtcattgggtttgttgtggattgcttccatctgctttatattatcgtatcatgagtggatacattgaatgttgattatctatgtctttcacatttaaactagtaatggcacattaacacaaacatctttcatagtcttattctatgatgatgggaacagcataccgacataattatccgttgttgtgtcgctttcgaagttcctttccctttacagctctaattgatttgaaactctccacgctaagtagtgtatatccttgattgccatgactgctcaaacctcttattacaaaaagatcaatgtatcattgttctttgatgcttatactacattttcttgcgtgcagcgaatctggagactcggatgacgaagacggcaacacctgcatctgtgtcatccagtaagcagccccttggagatcatccctgtaaattctctgaaaggaaaaaccgaaaaacaagtgtctgggtcagccattagttgtttatttgtcagtagagagatcagagagccccccattgtgtcgttggtttatctggaattgtggatggaattgggttgtgttgtactatcaatcagcagcagcttcaccagtacatgttgcacatgcatagagtttagattttagaagattcctgcaaagatctgatgattatgttcttgtctgaccttgttctggtaacctggttggggtgttttggtggcagtataatgattataaccagcattgcattaggctgactggattggctgaaatgtgggccccctcttctgtatgcccagcttgatgggctggtctgggctgggcttagcttgggccttaggccgcccagtctgatgacaccgtccggtccgaaactattcgggattcagacttccaggccaacttgattcataagaatccacagaaattttagattaagccctgtatttctcctgaatcctagtaccatttggacgaaaaatcctgtaaaaattgcttgtgaaattaccct

SEQ ID NO: 68597 - DNA, 1280 bp, Oryza sativa
tggcaaaaggagattggggactgttgtgacttgtgagtctagtttccaatatgttccttcttattaacgttatgcgtttacttggttgaggacccaatgattgaggatactagctgatgaccccgctctataacaagtatttttttttctgcaaagctttatatttggtaccacattattgtgtgtattgggttaactgcattttatctcacttctcacaaggaattaaatgcttttgccttttatttcacatcctctctcccattcttttctattggcatcatttttcccattatatacttatgttgcaaaatggtatcatcgaaatggaaggttatgatgattcatataggaaaaatcataaagtgactggtaaatggtttctcatcagtttgcgcttcgcattctatagtagtgtgaactcacttctgctttgccatgtttgaattatattgaacagatacagcttatttctatattccagagttgaaattttgcaatcatcacagcatacaaagttgcatgtagttccattcagtcgctatatttttattcatgtgctatataatgtaaaaaggatatccttatgcatttgatcttcctaataaattttatatttgctcaccctctttcaagattatctcaaagtactcattactatcatggattcatggtatctattgtaggattcattcctagatatcaggtgggctcaagtaaagttgacacaagtgaaagatactttgatgagtggcaaaagaagctgcccaatacagatgaaatccgcaagagcaagcctagatcaagatatttcacaatatctggggtggaactatccccagataatatggcagttgcaactgtgtattttgtgcaaggggttttaggccttgctcgacttgctgtgagtttttacttaaaagatgatcttcatcttgatcctgcagaggtctgtgttcccctctaaatgctatcttttttgttttggtattggtatttatttatgtaatctcattccacccatacagtaagttgattcctatataggtcttgataagtgatcaatatgttttctcccatgtagactgcagttatatctggcttctcatccttgccatggttgatcaagcccctgtatggctttatcaggtcttacaaaagctcctgcctacagttctttctgctatctgtacagtggtgtaactagaattctgctgttctttgcctttcagtgattccatcccactctttggatatcgacgaaggtcataccttattct

SEQ ID NO: 68598 - DNA, 1605 bp, Oryza sativa
atgtgtgagcgagtgacaggtggggtcgagctacgtgggcccggtgcgtcagtgattggggtagggtgggtttgggtgagagatggtggtggcgggaacgggaggtggactcgtgttacggggttggtgggtgtttcagtgagtgacaggtggggtcggattatgtgggcccgatgtgtcagtgagtggtgtggggtggggtggtgggggtagaggtggagggaacgggtacgagctgggtgcacccgataagcgcacacgggtgattgattggttcgttaggatggctgctgccgacgctgcctgaataagagcacctgcaatgataaagtaggtgttatctataaaatataaaacatgtacatctcaacaatagactaaattaatagtaaatcatctcaatattatgtctacatgggtatctatagctctctaatacattgcctcgtttttctctatagactatctacaggttagtagatagcttcactctctctcttcatttaatctcttccaggtaggaaaatatgctgacatggatctcttatagagagcttatagataaccattgcggatgccctagccctaagggcagtcccaacccataacactagacatggtttccataaactctacatcataaaaaaaactagtactggacactactcttccaatgcaaacactactattccatactccctccattccaaattgatctacatatttcataggtataccaagaccaagaaaagctaataactctcttatactatatttactctagcaacaaacttaatgcatgcaccatccccactattttctagccaatagcaaatcaagatattgcatgtgggttataaatacttgtgtgcatggatgcatgcatcaatgtccatttactccaatgcacaaataacgaatagacctaatgaatgaacacaaatatgtagatcatttaggaataacctcaaaaaactatatgtagatcaatttggaatggatggagtacttcaatttaatgctacttatctcatatgatgtcttggatgttgtgtagaaaccatgtctctttacttatttattcacttgccacatcattttttgtcctaggtggtaacttatttaatgctatggacatcatcctagtcattgggttgggaatgccctaaccaccctcttaccaaattggccacagtaattccttgactttgatggtaaccaatgctgccctctttttgattatcatccttgttggaatagtttaggacttgatgcttcacctaactgtaatatatatataatatataatgttcgatagcattcattcgatcgtggtgcagtcagcccgtacaacgctttgtgtcagcagctacgatagtaacaatgcattgcgatggttgtacctttgcagtcgaacatactctttcattcaaagtttcaaacaagcagaagcggatggacaactgcccatgatttttgtagcgataaactataatgaaaataaattaatgtggataaattactttgatggttaaacttgtttctatctatatagtttaaactagggtttagaaaactcccacaccactactaccaacagcattg

SEQ ID NO: 68599 - DNA, 780 bp, Oryza sativa
aggggtaaaatcaatttctggatgccgtttaacaaaatataatacctgacgttgcatgtacacagacggtgttagaacggagcaggtgctagaacacaatctgttgttatcataaaattattgattgcgttcctttttacttctttctccgttctaagactttttagcattacccatattcatatatatgttaataaatctagacatatataatatctatataaatatggacaacgctagctagaaagttttataacctgaaacgaaacgaagatacaattaacctagggtcccattccaacttggaccctagacttctctgggcacggccggcccaaagtccgcggcagcgcggtgcacgctgacgccaggaaggacggactagcgtcccgcatgcacgcgtaggcaacggcgacggcagccgcacgcagtgccagaaggacatcgtcggcggcgtcaatatccatggcggcgccgcttactatagagaaagggtttttacagatccaagtcccataccgctggagaaaccgtttgtaatctcggttaaaaacccctctagttccggttttttaaccgggactaaatatttttagtcctgagtgaaataatcggaagaagagtagaatttatagttccgggtgaaataaccgggagtagagttgaatctttagttccgggtgaaataatcgggagtaaagttaacaccaagcgggactaaagagagggtagcggcagtcccggtcggtcccttttttttcatcgtttctttgctagttg

SEQ ID NO: 68600 - DNA, 1115 bp, Oryza sativa
atgttgtcaatcattcagtttctgatattgttgtcgaacaaggtaagctgaaaataatgcagaacaaacttgttcgtgacgattcatttaaaaagactgtttgtgacttgttactaaactattaaagcgcttttgctaggacttggttatgagagatatatatatattttcattttccatctttttgttgagttagtgcaaatccagttctttccttggttgtgaaaagctatgttaacttgttaagaagtttgttcttgttttttttaaataaatgagtgacactcttggtgcaatatgcttagttatctactgtactcatgtgatatctgtaggttatctccaatcactttttggtatatattcaatcagatttgagaacattggtgtccgaaagccttctagtgatgacataaagataactggaattagtcatccacatgatttcaggaaggtactaaacattttgatttatctatctcagtctatctcgagtttttgtctcattcagacatgctttcttcaggctgttcttgtccatcttttgaatacaagcaatctgaatctcagtagaaaagcttatgtacacgatgatcagcagagcacgagttctaaacctataactatgtcttcggtatgtctatttcttaatggtaccttttaatagtttaaactgtaaagatcctttgcatttagcaagccctggagctatgagatccaacctttctgaatgtgcgatagttataaaactaagaacaagcatatattttgtatatcgaggttctgtttgtataataccttaggaagtattgtattgtagatatatagcttctaacaacatacatggttttgctaagtcaagattgtatttccatattaccctattaaacttggctaatgttttcattttacagaccattttcactgatccccgtgttttgcatgatatatatacaacacattgaatttttcaggttcctcctcttggagatttgatacttgagaagcttgacgaagttgaaatctctgtgaaggtgataattacagtatcactgttaatttctctaagttttaattatcttctgttttgttctcataccattatagaaacatgg

SEQ ID NO: 68601 - DNA, 864 bp, Oryza sativa
caggctaaagaaatgatcttttttttttatttgagtaaatttcagaaatctacaactatttgggtcaaaactatcaatttgctacacgtcatactcatgcatacatgccaagttcacacgcacgcacaactggttacagttgcagaacttgcagtttaatgataaaatcgtttgatatagttacaacagttttgcgaaatgttcgccttaatcttatagaaaagcgatacctttgaccaaataactacagctttctgaaatttactcctttatatatattttgcatcacgagaaacaattttaatcacttaggtggatatctactcatttgttgcatgtgaacaaaatgaatatgaaaaaaaaaataaaaagaataattaatacacgtatattcacagatgaattctgttttttttagttcatcaaactctgctcactcaattctcttccacttaacttttcacatttccctcattcccttccggttttacactctctctctctctacatacttgattatatattagcaccatgcaataaatggacgaacatccacccgagcgattacaatcctctccaccaacatacaagtttaaattcaacttctataaattgtaacaaaaataacaaatttaactccaataagtatatgcatattcacaaatgaatttattaattttgttataacttgtagaagtcgaatttaaaattgcatgtttgtggggtgatatatttcatattaatctatcttatcaacttttctgaattttttttcaataaacgggcgaacatccaaccgagcgattacaatcctctctcttggtagctaactaaagaagtgatcttcttcttcttcttcttcat

SEQ ID NO: 68602 - DNA, 795 bp, Oryza sativa
actgttcatgtcatgcaaatggaatcccagaacagtaaataaaggactaacaatatgctaatatacatatgaaaaaaacttttctgaaagaactgctgcgacttctaagtcatgtagtattttcaatcagttatgctatgcctgatgttgaacattgcaatctttaaactgtcaaacattccagcaaatacactacaggaaaaaggtatgcaacaggatctcatttaagctttgctcctaatgattccgataccatctggcacacaactaggaggctacagatcagaggacagtgagtacttgggtcatcggagtgcaagttcttagtttggataaagtggggacatggagccattctagttcatttcggtttttaattacatataccacatgaactagcaattgcagaaagttgtatttttagtttggataaagtggctcaatcctgaggcataccttcaatagcaggcaaatttgtgatgaaagacatcatctgtggagaaagtcttttcaatatttcatcaatctcctttgtatacccactggctgtggttgagaagtctgggcctgacaaaaataaacaatgatattttatgtgtgagaaaagttgacaattgtgtctgaatggaatggctggaagcatttgcagcccaaactatgaaaaaaaaaagttgtcaatcccatcaagtaacattatgcaattggcagattagatgttcatggtagcaattaaatgagataaccaagtgataataattttttgaccaagcattaggcagtgtaggctggcagcta

SEQ ID NO: 68603 - DNA, 2172 bp, Oryza sativa
ttccctataaaaggcagacattataacaaaaagaagatgtggataaagagaatatcataaatcatatgtcacctcacatcacataaataaaagaaaaggagaagaagaaaaaaaatattaatttaattcttttttgctctcttttaactcctctgaccagtgacccaccctcaccttcttcaagctccctcctctgaagcctcttcttcttcctctgattcctctctccttccatcagcttaaacctctctctctctctctctctgttgtgtcagtgtgtgtgcgtggcttcgaagagcaagaagctagagcttggcgagcgttgacaatggcggagcataaggcggcgaagagcaagtccaagtcaaagagcggcggccatggccatgacgcggcggcggcgtccaagaagtcgaaaggcggcaaggccaaggcgaacaacgccgcggcggcggcgccggcgacgtcgctggacgcgctgttcaggccgtgcggcgacgtgaaggggctccggttcggcgcccagctcgtcacccgcgcgctcaccgtgcgccgcgccgcgccgctcgagctcccgcacctcctccgcgtcgccgacgagaggcagcgggaggcgccgctggcgttcgcgccgacgacgacggcgtacatcccgaccaacttcgccatcctggcgcaccacgcgtggcacaccctcacgctgggcctcggcaccaggaactccaaggccgcggtgttcgtcttcgagtccgccgccatgaaggccgccgccgacgccgcgtggccgcaggtcgtcccgctcggcgacgccgggaggcgcctcatccgcgcggcgcccggcgcgccggagatggcgaggttcaagttccgcaagggctgcgtcaccttctacgtctacgccgcgcgcaccgccggcgcccgcggcttcgcccgcgccgacgagctcagggccgtcgtcgaggccgtcgccaagctcaaggacttcctggaccacaccgccatgctcgcgctgccggggcagaggagcatcgacgtcgccgccgccgccgacgccgcggcggcggcgccggtgggcgtcgtgcattaatgcattgatgcatttcggctgcttttgtgacgaactgtgaatagagcttttatttttctttttctttttcttttggtgtgtaataattaattaattgattgatttcttgatgtgagttttttggttgagatgttgagcaaattcctttgattatgccttgtcaattgctgcattggcatgagcagatgtcaagtaattatactagcttgtaataagctgataaatttagaagttttcaggtagaaaactggaaactgatctttgcatttttttttaaattttgactcctttttgtttagttttcatgctgtgatgacttgtgtatttgagctgtataattttgtcagagctctgttcttgaatctgatttactccctctggacggaggtagtattttgtattatgtgggaagccatggctcaagacacaaatttttgcaaatttatgtgcaatcatggctcagaagtgctcagctgattgtgcattatgaattgaatcttccaacagagatgctttaggtggggagagcatccatgttgaattgaaccgaactgaactgaactctctaattgcttcaagttgagctgtactttacagccatgagattctaattctacggtcactataaataattgctttaccaatgtgaattatgtgatttgcaaggttgaaaactcgaagtctgtcattcttgctgtcgattccagggcaacatttgtgtgaccatcatggatgaatgggagacctggacagctgcggggttgattccaatagagtgatctgtggttggggcggccctgtttaaggaggggttttagtagctttttctctgcttttctgctcctggagttctgttcctggggcgttaggaaataatgtacattctcgctttctttcttaatatactttggccggcaagttttgccagctcggcgaaaaaaagaaatacacagctcatctaaacaaaagctggagtccagcagtgagggccattgatgctttggaaacacagatccaagcatcaagaatgacaacctgtccatccaaaaggcagaggaaaaaagaacagatcaagaaccaaatca

SEQ ID NO: 68604 - DNA, 1706 bp, Oryza sativa
tggagtgcttcaggaacttctcagcgcagcggcggacgcaggattcctcttgcttgtcgagggtcttccggcggaaagtgtccacgcagtctgtgaagcatcgttccacgagggagttgtacattctcaaactgtgcgttgacaacccaaaaaagtcagcatctttcagttgtaatttgacaagtgaaaggcaaatcaaagagttgatcagaatttacacatcgagaatgattgaatgaatgacataactttcatgaacacgggagaaagcatcggtaagattgcacagtgatgaggtagctgattgaaaaagcatcaaagaacacatgaaacatactaaagaagattgttttactgagctattttattgtactctatcttcagaaccatcctgtttattgactccattggttttgcctatgtcatgcatggtgacaaaccagctaaaaagacaatattccaagttccaacctatgtggttagttatcatgtacatgaacttaatggaaccatcccatcaatagacttcaacatagatttcgcaagctctgcaacaacaacaaaacattgaaaaataacatctacatttacatttctggccacagcatacagaccatgaacagaacttagctatcagaagagacataggtgtagaactagccatcaaatgaatactgccaaaccagcccaaaataaagtgcttctactcgcagaatacacttggtcacaacagcaactaggcatcagtatataatactccatactttcctattagagattatgatcaccatggctaatttgagtaaatatgcaagtaaatgaaaagcatccttagctgatactacaatcagacgggcaaataccaaacccaagcaagaaaactgggaccgaacacacaaggatgcatctttcagccgcactacagtaataaccaacatacataatcctcactacaatcaatctctaaccgcacagctgaaaaattgtagaatcctaaaactaaatccccgtggattcggagtgtgtaagttcaccaagatcacacaaatctgtcagaattttccgcacgcacaacacaaacctcacctcgcaccgtatagtataatcgcgcgcacaagaaagtagccgcaaatcggccatcccgatcactcccatccatcgaggccgcaaaaaaaaactaaggaggcaccgccgaacgaatcccacatgcaagcagagcagccgcaatcgaaagaattcattcgttaattaacatgtagtgagggggcgcgggtggacctatcgcggatctggagctggtcgaccatggccgccatgcgcatcttgtcctcctccgggagaccgtcgaggtcgccgagcatgctcttgtccatcgccgccgccgccgccgggagaggaggaggaaggctagggttttggaggaagagaggagaggaagcgagatctaaaacctcgggaaattcctttttattttctttttattgatgtaatgggcttgttttaattgggccgggccacatgggcttcgaaattaagcccagtatgagaagtgtgaggcccatttgggatggaatcccacaagtttgtgtacaactcgaatgaattcttgcagataaaaaaaacgattctagtatatatttgttgacaaattttcttctaaaaattttgtcaaatgtaaatgtagtataattgtagcttacatttaa

SEQ ID NO: 68605 - DNA, 1067 bp, Oryza sativa
atggcttcaactgaatataacttcaaatcaattgtaagcagaactattggggctaacatagtattcttctatgatggaaagtacatcaaaatcatcaaagcttatgacagtttatgttgacaaatacatagcaaacatattcagaatcaatagctgaagatcgaacgtacccgcagccaccgccgcatccgcaggaaccgcagttgcaacttccaccgcacgacatcttgatcgtctgggtctcttgtaaactcttgaacttgtatagttggatgaaatgagagattgaaagcttgatatgaactcagctcagatatgcccccctatttatagtagtagtacgcttgagaataagctgcacaattatttgcaagcattatcatgccagaaagatgtagctggttgaaatggccttgaaaaatcattatcattcattgacgtcagttttctataggcatttcccggagttttaaaaaagcatatttgtttggggtgcaattgcgtcattcttagttgaagatagtattgataagtgccctaaaatataaaaatattgacgatttttatatacgccctccgtcccataaaaaacgaatctaatactagatgtgacataatctagtacgatgaatctggacatatgtatgtccagattcataatactaggatgtgtcacatctggtactagattggttttttatggaacggagggagtagttgcttacgtgcaaaggttgcattattttaattactgttaatctgaaccaagtttctggacaaatgtgatccaagttttggccaggttcaaatttgctttcacaccatgatgtcaacctttgcttaaggtcgacgccttgttgctcatatttaaatcaaacaatctgaataagtttcttgtatgaactggatttaaactttcatcacgaaaaaccgttgaatttgatcaagttcttagctgtttcaatcatgcatcagtactatgatgcagaccctttgcttaagatagatgcattattgcacagcttgaaattgaatacgtttcttgtatgagttgaattcaaatttct

SEQ ID NO: 68606 - DNA, 1659 bp, Oryza sativa
aatcggactgcattggtcgacattcggcgaatttcgttcattttggtgcagcttcagacaagtctattgacctcccactttcacccaccatatatatactttttataaaagagaatagctagtgatggtggtggttttgctaccaacattactaccaattcccaacttttaaaataaataaataaatgatatttagggctagagagtccatatgtcaactactttcatcagtttttaatttttgtgggaaggaaaaaacagtgtgagctaaaaatgtccacatatgagtaacaaatatctacaacaattaagatatgataataacatggtaatgttaattttcttcacggacaatatgctagtttttcttaatgcttattagaaatttggctcaaaggtagccatttttccctgaaatttctgaattttgccaattttgatggggcctttttttttattactatttctttgtgtttgatcgatgcaccgggaaagtgtttcaatttctttgagaagatatccccttatttcttgcatgcatgtcatctaaatagtaataaatttttttaaaaaaatgataagatagattaatataaaatatatcactccacaaatatgtaagttcaaatttagcttctacaagttggaacaaaaataacaaatataattgtgaagttaatttgttcttttttctgtgaaagttgaatttagtcttgcatgtttgtgtaatgatataatttctattaatccatattattaaattgcatcaaactttttttataactatttagatgatactccctccgtacccgtaaaggaaatcgtttaggacaatgtttaaatcaaaccttgaaaatataaatcatgaataaccctcaattgaaaatataaaaattatatgaatagatttgtctttgaaaaatactttcataaaagtatacatatatcacttttcaataaatatttttataaaaataaggagtcaaaattatgttttgaagactgtgtcgctgttctaaacaacttactttacgagtacggagagagtatagcagaaatgagggatgtccatccagggatgaaaatccaattcccaatgcacccaaatggagtatactgctagttagtcacggactcacatgtctgttgttggcacttggagacattttgtaagacagcaacaacttaacctccaataattgttctactccaagcgttcacagctactaccaccataagctcgctcgcgcaattagtatatcgatcggccagaggaggaaaaaatatataaagcgcgggtgcacgatgcgccgccgcgtcgtcccggcggcggcggccgtttccgcccagctggcagccgccctcctcctcctcctcctcctccacgccgtcaccgtcgtcgtcgtcgccggcggcggcggcagcgaagtggccgtcgacaggtacgcggctgcaggcgcgatgctgctgcttccgcggcggcggcggcagcagctggaggacgaggtggtgttcccggcggcgatggcggtcgtcggagctgagcagctgcagcagggcgggtccttcagcgggctcacggcgaacaagcaagtctgcctgcagggtcactcgtgcgccgcgttcgccatgccctacaccggccatggctgcatctac

SEQ ID NO: 68607 - DNA, 967 bp, Oryza sativa
ggatcccccctttttgcctccttcctccccttctcctatgttcgcatctctcccctctacaacaaattgccctccctagatctccaccttcatagcttggatcaaaaagcgaaatagaaaaatggaacgaggaggaggagaggagtaaaaggagggattagatcagagtctcccctattgtctcctcacaagttctctaaagaaattataggtgaggtttttccccttgttatatcagttgttctagggtggttttagtggtttaatttgtggataaggaaggttagagaaggagttttgtttgttgtggttcgaattggctgttctgcatgttggcagatttacagtgtttcggttttttgaagtttcggagagctaaatgatattttctgcgaaagtgtataactagaaagttgtagataatatttatatctatcttctgaccgaagggcgcgattttatctcaagtggtttagacgatacgaatttttgagtataactgttgtttttatgccataatctggatagtagtagattgaactgtttttggatgggctaaacagtggaacagccaagactcctatagacaaagttgtagagatttttcttagctttccatattggtaaagtacactctgattgggcaagtagaactccagttatgattgttttagtgcggatagtctgaattttctggacagattgtgaagcctgctttcaagcgcaaattagaccattttaatggcataataaaaatataatttccacataagagttgtaggcattgttctgtagatttccaaaatatatttatttgcggtcatagccttttcatatttcaagatataaaggtttgaagcaacaatattgtttatagtgcaagcggcgttccttgttattgcgttttgataggatggggcagtaggttcacctttttcattgttttatatgcatgtttgaatgtgtt

SEQ ID NO: 68608 - DNA, 1088 bp, Oryza sativa
gcttatccgaataagttattatcaaataaaagactatttatgtgcaaatcttttatatacatattcttagcgactcaaaagcaaatgctttaaaataaagtacaataagaaaaccaaaaattcaaattcaaaattaagttctaaaatttaaactttggcttataggaataagcataagccaaataacgagacttcaaacacgagctcgaattgtcgtccagctttacttcaaatcgggcaagaaatgatgatggacggaatcagcagcttcgatcatcctttatttcagttggcatattctttttgaaagtaaaattgattcttatggattatttgtaacggtatcctgataatatgtacgagcatgtgtggagactaacttgaaatcatgctaacatgtctaaggaatcgtgccatgtaatacgaatagaatcggatgatctatgcaaaacgacgtacgtgatatccgcacgaactctgcaagtttcattcgcttgtgacggagcgtggggctcctcaccgggagaccgcgcaggcccccctttgccggttcggccgggggcgctgagtgagattcttcaccctcgatctatggaacgttcgcgagagagcaaatgcacaagacacgggcgatgtatacaggttcgggccgctgagaagcgtaataccctactcctgtgttctggtggatctgtgtgtgaaggagttacagagcaaatggagagcaagagagttcaagctctagaatccctctttttccttctcctctggttctttttctccctcgatctccccctcttccttctcctctagttctttttctctctcccccctctttttttctcttcttaggtgggcaaagtcctccttttatatctcaaggggataccacatgcactacttctatctactcttcttttgggtggggacccaccctatcttgaccaaatattcactcgcgcctccgcctggaagctaaatcaccgcttgtccttgagtgatgcccagcgccgtcactcgtcggacacaggggatcaccctgtcatttcttcattaatgggaggagatctgcaatggccgctgtctga

SEQ ID NO: 68609 - DNA, 1056 bp, Oryza sativa
tatacatatgtttttttatacatatctatacatatatacatatatacatatatacatatatatacatatatacatatatatatatgaatgtgggcaatgctagaaagtcttatgatatgaaacggaggaagtatttatctggttagatacaaatcatgcttgcctgatgacttgcatttccaacatgtggttcattgaaccttaagcatccagtcatcatgtaaccacgggaagttggaaaaataaaaggattggcaacaacaggagagcatggctaaaaggcagtatctacttccagtcaaggctgactgcttaacctttctcccctttttctcatcctatgttcacacttcccacttcccagtagttagtagtatttaatcacctggctgaagattgtagtgtacctgcaaacaatttgtttgggtgtccttgtccctgatttattgggggaatggatccatcataacttagtttattgattaggtggttatggctgcatcgctttatgtctcatctattgtagtttaagcgcatagtgggcatgaattatgttgccttttgtttattgtccattattatcacgatcgattaatgttgagtgggaacctaaataatccatgattaagtgccactcagagcagcctctagtgctgtcgggcatgactttatggtagtgtgattgatctaagcctgtcttgcccaatcaaactactattacagcctgacacgattgctgttactggttgtctgcctacctgtgtagcctggactatcttggagcgtatggtgacaaagttcttatttttggggatattttaagattgaaacaatatatggttggtgccctagtcgtggatatcagcatcacggtcatggttactgtggatagtggtaagatgatgcagacattttccacggttgatatttagcttgagcaagtgtttaactatgttattgtcttatgcgttgtcgtgtctactaataggtgcttaggtagtgatggattagtgttgtttgctgcctattgtgtgattaagctgggaatctcacttt

SEQ ID NO: 68610 - DNA, 756 bp, Oryza sativa
agtagtttgacctatgaccaaatcaaaacatctttgtaacctcaaacggagggagtaacattatgtgtgcgtatatatataagcacgcgcccaaagtgcccggagagaaactggatcgagcgccgccaggacgacgacgataatgctcgggagcgaccggcgaccggccggcctcgtggcgcagctgctcctcatcaccctcgccgcccttctcatcctcctcctcaccaccgtggccgcggcggcgccggcggccggcggcgggtacagcgccagggtggtcatcgtcgccgggaagaagagcagcggcagcggcgccaccgccaccgctcaccgccgcgtcgtcgtcgacgatctcgccggcatgatggcggcggcgctggggcggcaacgcctggaggacgtggtggcgccggaggaggagctcctcatcccgggcggtctcgtggttggtgcgggcggcggcgggggcggctacggcgccttggaggcgaaccagccggcgtgcccccgcggcggctgcgccggcaagcagccaggaggggcgtacacccggccgtgcacgtacggcaacacctgcttccggccaagctaagccatggctgcatttgcaaaagataattagcagctgcaagcacacatatctgcctggtgcctgctagctcgatttgtgataattgcatgcatgtattaattaattatttactccacatgcctgtattattatgtactccctctatttcaggtaataggccg

SEQ ID NO: 68611 - DNA, 1602 bp, Oryza sativa
tatctaaatttataatagaaatatttagatatctaatatttaaggtatgaaatgttgtattataacatacatggatcgtaaaattacctaaagtgatatccttagattgtctcaacttcatcctcgtgtattctcgggccctgttcaatcgtttcctttcaaggcatggtcgaatggttatattgctaggatactccaatacagtcggtagcatcgtgaaacaatatagatgttgttagttcgtccacaaatagaagtaccatatacaattttattatgcaagttccgtatacaccaactaacatggcgggtttcactaaaactttgagagaatattttgcacgtactttcaatttcaataatattacatctatctataaagtataatttcaatttcattatattttagcaagataaaattctaatagatatgttactttttttatggctaaaacataacaaatatgaagttggtacttaatttatatgtgtatgcaatactattgaaaatacatgtatattgtttatataattttttatgatatatattatctggtgggtacatagtgtgtaaatttatgtgtatatacgatacattcccccacaaatataagcatttatatgagctttagcagagaataatgtttagcatttactagtaggggaaaatcccactcgaaatgtagcatttataataaaatgtaagaaacaatggcatatgatttgattctgttttgttttgtcagttgattttctctcaatgtatctatcttctttcacttccctcggatgcttggctattattttttatactctttggtgctttcatgtccacgagcctccctaatttcaccaccatcatctttaatttatatgccttatctcgcctacctatcccccctgtatctggcagctcatgtgccacacgtctactagccactccgatgaatcgtctccgcccccaacatcgactcaacgcactcctctatccccatggcaatgttgggctatagtggcaccgctggtgcatagctgcccaccgcttgctagccactccgacgaatcacctctgtctccaacattgatccaacgcgctcctccagccccatggtattggtgggttctggcggcaccgctagtgcatcgccatccactgctagtcgtcccttaaatccccaccccctccccgaaattcaatggctaatgtaattgactgatgttttttacaattaactgctgaacaacaaagggtaaaaattttaagacagctgatagaatccttgataatctagactgcgaatgcaaagaggcaaagctatagtagtagataagtaaagtaaaatatgagaaaattcgattggtagcataggtattgtccgagtaaaataatagcacaagaaacttgtttcttcgcctgaaagcacagctctgttagagatttctaaaatttagcacttccgtccactaaaaagaccaaaaagaaaacccttaggtcaatttcttcttcctcctccttccagtccctcactgcatacctcttcccctgttcatcgcttgcctcttgtctcttatgcatgaccgagacaccacgcataggcaagg

SEQ ID NO: 68612 - DNA, 713 bp, Oryza sativa
cattttgcaaaggcatacttgtgttaaaatttatgtgctccatggttgtgccttggactgccaagttgccatctgtgacataacttacagcacttattaaaaaccttttacatagtatcggggcaagacaatgtcaagtatggtagaaatactaagctgctgcttggtttggtcagttttggcaacaataattacacattgtaaaatcttgaaaccacattgtgggcatacaattttttttaatcttctgactgtttttgtattgatctcacccaatttattgtattgtgatcctttaatgactttatattgtgcttgttgcaatggaatttgtgtatttcctgctttcctaataacagctcatgcacaattggcattaggatgtgcatgctttatatatatttagccttatttaatttgactttggagaaaaatattttttccctcattccttgctctaaattatgttttctcaggtggaacaaagacggaaggaggctttatctaggacatccgaagacgccttatctgccttggaaaacacactttatgacgttgtttctcgatacagctatatggatctttggccatgctcaaccaaagaattggattatctatcaagacatgaggtttgcactatctcaaatatacaactactcttgcatatttcatccgaagcaaatgtaacaagctcatatttggaactcacagtc

SEQ ID NO: 68613 - DNA, 1316 bp, Oryza sativa
atgagcagtcgatatcatttaacatcgtaccatttgtgatgatgggtaccaccttaccatgttcaagttgttctattatactcctatatactagattatgatgttttgtcccattctttatttccctgcctagcaggtaactcgttttattatgacctatattaaaactagaaaatggattttgtaacttatgttgttattttctcttgcttattactccctgatatgcttgtgcatgtaaaaaaataaacataagaccgtcgttggaatgaagaaagtttgctggaatttcacgagaattcaactatgccaaaaaattcctgtattccaaaggcgctttaaaaacaatcgtctggttcaattccactgaatcttattcgaattcgttgcagatagtgttgttgcgagaaattttgtttcaaagatcctacagaaccatttcatcgtgatgcgactcatttggcccatgcactatcccaacacaaaaccacagagtaaaaaaacttatttccattgcaatctactgctgctcaagatattcttttgtaaccattttggtttgcaatttggtggtccatttattattcaatagagctactagtaggaaacttggaatgatcaaaagagactcaaaagattacatatttctagagagaagtgaattccaacagttgtaaaaaggacacgagaagaagaagcaagaaagcgaggtgtccaactacgcatgcatgcagcgccaccgtccggcggctcaccggccgccgccggggccgccgccgccgccgccgttgatctctacgggcggccagcggcggcaggcggcgacctggtcgaggaacttggcgaggcgggcgtgcttggccgcccactgctccgccatcttctgctccttggcctccgcgtcgcggcggaggccggccatcttctcccggtactccgcctccacccgctccaccgcagctgcctgctcctccctcagcgccctcatcttcgcctcgaactcctccgtcgcctcccgccgccggcacgccctctccgtctccagctgcatctccaccctcttcatcctccacgccgcctccttcctgtgcgccgcccacgccctctgcccttcctccatctccctgcaacaatagatgcgagtcaagcgacgacacataaaagaggagatccaatcgatgatagtgggtcaaagaagacgaatgagatgaagaaatcccccatttaacgccgttaactttttaattatatgtttaaatatttgttttattaaaaatttttgtgaaatatgtaaaactatatgtagtatacatata

SEQ ID NO: 68614 - DNA, 1669 bp, Oryza sativa
gagaaatcagatcatgtacaaaaaatttacgtatttttagttcaatgtagagcacttatcttacagatttcaagtgtagtaagtgtgtaagcatgaactttgcaaacagaaaagatcaaatcttcagttcagaagaaagaaacgacacactgcagatcaggaatggcttggcatggtttctagttgtgctaatctagtcaaacaaccagtcaaccacaaccagtttaaatgcaaatgttgatacagagtaaagtgattaccgtctggagggagcaagaaactggccagaacagaagctagggctgtgatagtgtaaagttagttgctttattcattgcagcatttatatgtttcagtttggggtgtcaaaagcaggggagttaatttatttgttcagtgatccataactgtgacctgcacactctacacatcctacttactaccacagtaccacagataaagcttatacatgctcctctacaacaacattggtactaaatttgtgcaagattattcctttgacattatacagttaactactcgttcagataacagttaaagcacagaaaatgacagagagagaaaaaaaaaagagaaggctgaattgctccaattggttctttggaggttgcaagggccaaccgaccataaacactattggtaagtaagagcattgttaagcacccatgattcatccagctattactatcaacatacagacaaattcacagatgtcaggacaagttgtgggcacaattcttgtgagaggaaataataaggctaccactgttttctcgcaagcttgtcttccatctttagcagtgtcaccatctggcattaattgggagctgatcaatggggagataatctgccaaaacacctacctaataccctcaagaaggctacaaaataagggaatgtgcaagaggcagaagcaaatccaaagtaaaagtgatgattctaggaccatttggagcccccactggttgcctactaatgacgaattaaagctatggccagggctaattgcgcacgagatggaattttgatttggacaataagggttagttggttaggtgtctcgagcaaatttgacaaatcgaaaaccaatttaatttgcaataaattcactctatttaatatggcacctctttagttttcacctaattgtaatgaaggactcatgagagagaaatgcaataaaatctgcaagaatttcacctagaacatcttctgaattcttgcaagcaatatgcttttgattttattttttttaagttgagacaaaacagttgtttctaaaaaaaagtatttataaaagggatttataggaaacttaggattcctcaagagtggtcttgtgccatccatttcatctagaaattcaagcattaaccaagaagaaacaaaatgaaagaatgttgaaagcatggtagtaggccaaagaaatcaatgtgttgttgtttgttgatctgattggattggaccgttgtatcctccttggctagatgttactaccacagtagtagtactgacaaattgaaagcagtgtgggggtatactatactatactactcctataccacaagtatactgaaacatggatctgtgttgctgggtgttactatctttcaggtaactaacatagcaagttctcaattactgacca

SEQ ID NO: 68615 - DNA, 1532 bp, Oryza sativa
tcaaatcagactttcctgtaggtatggactcaatggaatcaggctttggggtactgacagtaacttcacccagtaagctaccattgtcagtggaagcactatcctgctggctttcagtgttgctcccgcagcactcatcgccctgatggctctgcacattgctctcactgcaagtattattctgctgactgtctgtgttatgaggggagtcctcggtgatattagtggtaagtggagacctcggggactgatgatctgacactgattctgggagctcatcatgatcaaaagagaatggttccagcaagggtacatactttggtcgcgagaccggtggaaggaggaccatgtgtgtggcaggaccacttcctacagggactacacacattctgcagataccaggaagggaacgcatgaaatcactgagcttaggataaccaagcgtgccatgatcaagctgcattctgcaaatggctctgaaatcacccttcagggagctcaatgggtgcctatctccaagtcgttcggtagcatctgcaagaaatcctggcaaccacttcctgaatataaagaaccaagatggaagacacttctctggcaagggccggcgcttcctaatgtaatgttcctcctttagctcaccatccaacagatggtgagttacctttggaacctcctggctgtggtgcctgaatggagcaattttctggatttctgcaggcaaggatcctctagcaacagcatcctttacctccactctcttcccaagcatgtacacatgatgagtttcctttgcacttatcacatcctcttctcttttgaactttacaaaaccaaatcctcgagattgcacccgatcacccatccttatcccaatgactactgcttcctccacaggtccaaattcagcagtgaagaactcagtgaggtactctgccaggaagaacaaaacaaggtaagtgttagaacttagaaacacattagttctaactttattaagtacaagtagttcaggattctgaagtttaccagcgcccacagaaggtgggaggcccccaacaaaaattttccgagtgtagtcgtgcttcggccaatgattaggctaaaagaaaatcttataagaggcagaccatgtgaagaaaaagggaattggttaatataggcagagtatgtttgtttacccgaggcacaaacttggaaccttgcttgggagcacaatggttcttactcttgcccccttgggcagaaccattactagaccggaaatcccgatggcttgctgatgttttaagcccagtaaagctgccacattatcaaaataaatatattagtttgaaacgtaggatgagaagcaaaggttctagtatgcaaaagaatggaagatctaatataaatcatgcagtatgcaccggacatacctttcatttaaatcatcactgtcataatcaccaaaatcttccaggaactctttgcagctttccttattcgtcacacttttttttggatgtgagctacggttccctacaaacaga

SEQ ID NO: 68616 - DNA, 1654 bp, Oryza sativa
caatagagtagtagattgatttctttgtcctgacgccgtctagtgaggaacgctgactggtgccgatatcttctcttcagccaccagaagcagcattgccaacacagtaacacgaccttccatggcatatctgtaggccacctccccaacctctctggttttctctgccaggagcctcactgcattcagatcctacacatggaacaaggtgacatttttgtgtgagaagatctatggaccaattatgagacagtgaatgaacattagtagtactagtaaccatacaaaccttttcttgcagagatgacagaagatcttcaatggagttgtccagtgaccatttaacttgagctctggataagaacatcagtcagaaaaacagccattgcatggagagaacttgagaagtgagctcagtggtcaccatcaccttctgcttaagagagcgatctcgagcgcgacaagagggcggccatcgaccagcttgaggtcggtgcgcgcgttcttggagagcagcagctcgatgcaccgggccgagtgcgcctcggcggcgacctggagcggcgtccgcgtgagctggtccctggcgtccacgggcgacgccgtgatgccgtgccctccctcgaggaggagcctggcgcactgcacggcgtcgtgcttgcaggcgaggtggagcagcctcgtggacatctcctggtccagcatccgcgacgcgtcggagcccttccggagacggcccatcgcctccttcctgaagcttcccaccgccgcgagcagcagcgcggtgtcgtcctccgcgacggcgcgggacacggcggtctccttccccgtcgccgccgccgccgccttgtcctcgcgcgccgctgccttggcgcgatccatgctcccggtctcttcactcgcgccctgacaaaatcaaaccacaaaacgaactcttcaaacacagatgaacacaacgaacacataaataaatttcgctcaagtttgcatcaaccgaaaattcataggcacaaataaacgaatgcgacgagctgagtatcatctctgtgccgaaagaatcccagaagcgcgagccatcgccgcactgtacgctcaacattttcaaacaaaagcagcaagcggaagaagcaggagatgggactgaaactgcagacagatacacaagaatggaattccacgaatccatcagtcgcctcggcttttaagcaggcacgacaaggtgcaagaaaacaagcaggaaagggaccaaaatttgatgagcgccattgcaatttcctttcgcttccaaagacaaaagccctcgtaaaatcacggggaatcgaatcgaaagctcagagaatcacatgatgtcgcagacagaaacgaatgacacgtcgtgacgtgtgacaagacgcccgagattgaaacgaagctacggaagatggggaaacaccagcaaggaaggtttgctcgatacgaggaggaacttggaatctcgctcggattgcaaaaaaaaaaaacgtgggaaaaaacaaaacacacgtcgaatcgcaggctcgcagcaaaaaaaacaacgaaacagtatgaaaccacaaaaacttttcaaaaacgcgctgaaatttcgcacgcccgctgaaattggtcgaatcgtggcaccacaaataggtggaataca

SEQ ID NO: 68617 - DNA, 1684 bp, Oryza sativa
gccttagtattgtactactactacgtgaacttcttcaaaaatgatcaaaatggagacaaacccaaacccttaaccatattagagtttgtttggttaattcggctgcgtttagctagactagctaccgtagcctgcagcagttgtgaatggttgcaactgacagccgatttgaattgccgcagccgtagcaagtgcctccgaacaaagccttcataggagtaatagattggaggggatagtgagaagtgtataatcaatatccttcaaatccccttgagatagggtttaatcgaacaaaaccttagataatgataggtcaattcatccacctgtggatgcaccttcaacgagaataaaaacaacacttaagtggtgagaaatgtgcgttggtatcagtggtatggtttcgcaatagtcacacccatatcctaaatggatagcatacagtaccttctccctttaaattatgacgttggtttgttcaaaattgaattcgtcaatgtcatacaaaagatatagaagggaatatatattatgacatgttgtaaattgttatgtgacaaactggcaaatggcaatggccttttgttctccacagtcctattggttgtatgaagcatgaacatgcattagtataaagtagaatctagaatagtttatacaccttttaaattaagtggtgaacttgtggaattggatacactataatggaattggatacaccattttcaaagaaatgagttagggtcctcatacaataggagcttattaaggatgatgaaccaataaggttaaagaaatgagatatagagaagtctttctcatgttgctacaacaattgaatggtcacatatacatactattggttgtatgaagcatgaacatgcattagtataaagtagaatctagaatagtttatacaccttttaaattaagtggtgaacttgtggaattggatacactataatggttaaatttgcacttcaatttatatatatgtgtgtgctgctttatttgtgttaacttaaactattgattgttcatatgtgctatactttatccagttgtttctatttgcatggtctaggtcacccatcgagtgtattttacccacctactcctttcataaaaaaaaacaacatagacaaggatatgatataatataggactggacatgttcgttgtcctatgttatatcaagtcattggttaggttttttttttacggagggagtaggtgtgggcaaggttggaaatttcggactttgatttctgaaatttcagtcattttggacccctccgttacgatattattttggccaaaatatttaaaaagttttaacttttcgtgaattttagtaatatttattcaaaaattcctaattttcggtctaccggtgacctccgatacaatcggtcaagccgaaaagttaaaccctaggtgtgggttgagggaaaaaaaacctataaccgtgtgatttgcgtcctcgagggaaaggctacttgattatgatcggtgtagaccaaggtttaatgtagtattggttaggctatttctatcggagaaaaccgataggactgaattttgtaaaattttagaatatttgaatataaaatttgattgaatctagtacatttcgtgagatccataaaaaataaaagaaaaggtctgcaaattttagatg

SEQ ID NO: 68618 - DNA, 2008 bp, Oryza sativa
gtgcatctctctcctctctctttctcctgtgcaagaaaaagatccaagctttgagcaccgcatcaatcgcttttgttattccagcgagtttttgggttctttgtgtgatttggatggaaggtgatcggaacctctatctctctctctctctcatcttgtttgttttgtgggcgactgttcttgccttcttggttggggatgatcagacattcagaccatcagatgaatcgatttctttgtagagcagttcttgatttatttatttattttgcgctaggtagtagatcggaggggttcatatgattcttggatcttttggttgatttgatttgatctttgttcttcacatggatgaagcgagttttgtgtgtgtttgagcctttgccctttgcttctctgtctgcggaagaaaatactcgtcttttccccttcacttgttcaattttttctcagttttggtggttagaaagaaaatctttgtttgcaaacttgattttctttttggaatgctcatctgcaacgagttgcggatttttttgttttcttgctgctctctgaagagcaagtgcggatcttgcattctcggtcggatctctgcgtttctttgcaaccatcgattccactgctttgcttcttgtaggtttctttggttcgatggaactcgctttatgcatgttctttcacttctgttcttgtgaatccttcgatgtgactcctgcggtttttttcaactatattattttgttttatgtgctgttgatttcccttccagtttactaattcctactgcattgtttaatctttacaggtgggcttcaggactggtggtgataactggctgttggtaaggtgagggttttactttcaaatgtcatctgcaacaatttcatgttgctcaccaattttgttggactgtgtgtgggctgtttcttggtgcttatggttgtgggattgagtctcctgggtttgcttccacttagacactagcagtataatgcacataaagttgggcaaataagtttaatcatgcacataagttgaatttgatgcacatttttcattactttgatgcacataagttgggcaaaattcaagtgactgtcaagtcatattctgttgcctattgaacctgcaggaaacatggcagagaccagaggcgtgggtgggcgccttgcggcattggcttctaaggtggactcgaagatatattatctcaaggatgtgttggttgagtacatggacatgaaaaatgtggttgctgaaatagcagaggagagggagaggttccagcttgaacagcgtggttcgtggccttctcacgaataatgttgtgcttcgtcgattccaatgttgaactattatttagtaaaggtgtcatatgtaacttgaaatggttatggcaggaaatgacgcacttctggaagcaatgaaggaggagcttgtggcagcaaacaacgagctcgaagcagcaaaagaggaaatctctcgaaagaacaatgagctagagtctgtaaagaaacagcttcaagagagtgaagcgagaaatattcaggctgagcagcagagcggcattgtggttgagcttatgcaaccaagaggggtaataatctatagttcctgcccccaaattattcataatttcttcatggcattgactaaccacattatgttttcaacttattttaattcttcctatttagccatgtaacttaacacctcacaaatgtctatatttttcacatcatgccttagcatactttttgtactaataaagtaataactagcattttttttttgcttggagcaggtgcaaacaagatcgatgcaaaaacgcaaaaggccattgcaaggaccttcgggctgtgaggctgatgaccaagagtatacgagtcaaatcaatgtccaatctccacgttgcttggaatcgatgagaactcctgatgtatggaacattttgtttagaatatggattctcaattcttgatattttcattatgggcctaccaga

SEQ ID NO: 68619 - DNA, 1205 bp, Oryza sativa
caaggatgggaggaaggccaccctgcgtgagtgtgttgagtacgtttgcaatcaagtgaagcaactcacagtgaccaagcgcaggaagtctcgcaggtacaatgtccatggattataattgctgattgatctcatatatttactgcttcggtagcaattgtttttatagtaacaaaatgtgggatacaaaatcattgctactggtggttaactgattgtatcatcactcatcagggtggtcaacaatctttctagcactgatcagaaattcacaagtagatggcagttttacattttacaactagcagatggaagttttaatttttgaaaattagcataatggtactttcatgttttttttttagttttaggcctttagctcgctttgattatgtttagtcaccttagaagctgaaacctaccgccattcttttaccatcaagtgttcgacgagtgaatgctacgtcaaacattgcagcctatatgaaacactttccttcacccccataaaatcttataaggaaaaatgcttgtgtgactgcaggggaagttgacctgctggtggcaccacaacaacacaagggtatattgcaagaatgaacttgtaaacttcacttcaatttcttactgcgtgatgttgtgaattttactacctttttctttctacgaataaaatccttgactctcactttttctggtagtaactagaaatgggactgctcattcttcaacttatgctattggagtacccacactctccagtacctttgccttgatgttcattttagttcccacaaatcagttctcaagaacatgttattgtcaatgtatatgcatttatatttttaagaatatttatacgttgagctcatttcgccatattgttgtttttgcaggtggtgagggctgagttttgggggcagtgtaggactaatccatgaagttcctgagcaagaatggaagtcttagcttgcttatgtcttttgtaaaaatgtcatgactaggaagtaggaatctctgaagaacctgatcgtatgaagcaacggatggaaaactatgaactactactactactactactagtacatctattttgtgttttgtaaaaccaagttgtggcttatgaccactgtactgcttgtgcacccagctcattacatgctatagtatgtatttacatgagacctatagttaatgtctgagtg

SEQ ID NO: 68620 - DNA, 1001 bp, Oryza sativa
ccatttgggcgccgtgcatggcgccgccggcgtatgatccccaagatgatgaggtggtggtcgcgcgtgcagacgacgcgtacatgttgcctgcagcctccacgccgccggtggcgacggcggcggcgagggccgccgcaaggatcacgacagcgcgcggcggcggcgatggcaggtcaagccgccgcatcacgcgcgccggccggcgatgagcaatttcgatggcccgtcgtcgttgcttgctactagctagcttccgttctggtttgctgctgtcctgccgcgactttgctgcgtgtgatatcactcctataaatagcgatggaagggctgatcgagcttcctgaatatggttccatcgtttcgctccggaggcaggccggagtgtagtggtaccctaccccaccctcccttacgataggagttttttttttctttatcttatctttttttatctgtttttttttcttgacccctggcaatggccttttgacagtgtgcgttgtgtaatcaaattttgttctctttttctaacatatatattgacgtgtaatctttttgcgccttcgcgaaaaaaatgtgtttattggtacggtttattaaaatgtatctctactattatgaaaattgaaaatattttcatcggaattttggtacgtcatccgtgtttgaatcggttttaattttatgtttctgtcaaatcatttcctttttttcttacgccgctatgacgcgcgcaaattaattgggccagcatcttttcacacgctccttgccgtacgcagtgattgggctcgcgacagagtctgttttccacacgcgcctttgtgcgccgctgtgattggacccgcaacaccctcgctctcgtgattttcaacatgtccgattgggcctgcgatgccctcgtgagtgtaatttgccttgccacatgtccgagtgggactgcgtcgccctcgccagcgattcaaaaattgaatgttttttttgtcaaaactatggta

SEQ ID NO: 68621 - DNA, 1312 bp, Oryza sativa
gaagggcgccgctcttcatattatggtatttttagcattagtcattatttgtgataaggcctttcaaaatgcatatctataaatctatgccttttttaactgtactgaggaaatatgctctcgtcttatcacaacaaaattccttcagtttttctcgagtttcttctgaaaagttctgtttgctaattcctttagttgccacaccaaaattactgataggctttattgtttcatacagggaggtctcgttcccgttctcgctctccccactatcgaggtcgtccacggtcaaggtagatgaataatgtccatatatcaatcctcaagccattcaccttgtactcatgaatccggtcgcttttaaaaggtcatactctcctgctccaagacggcgagatgactactcagcttccccaccgagaaaggatacgcaccccacaaaatctcctaggcgtcagccaaaagaacatgatgaagagaagaagcggagatcctactctcctgccagtagagatggcgaccctcgcgatgctgataacggttatgagaagtaagcatagtatttcatacttccatcactttttccttaaatgcaatatttgttttcattattgcaatagggccatttacacaccaatctggtgttttacgagtagtaaccttctgtagacttgtaaagtatgatgaatatgaaaggatgtgggccttagggtcacttgaactatgggcagcattttaatctttgctgcatactcacgacagattttgttagtcttattctgtattaattaacaggaatacatagagtgaaagtgctaactatggtttatgttcttcacaggaggtcgcccccacctgacagcgatggatcccctccacaccggaggtctcctaggcactcctcagggtcgcctccaggatcccgctctaggtccgccgatgtttcccctgcccgcagcgactgacagaactttgaaccaacgaaatgggatagctgcatgatctccacagcacctccaattctagtcagtctccatcttccttcctggtccaaccaagctgtttcaattaaaccgaagccctaagcggcgtgttgtattattgctaagtgtgcttgccatgagtttggtatggcacatcgcctgtttgtgtgctcatatgttgggagtccaggatgttgtagtcttttgagagctgctttgtttggtggtcatttgctttttgctgaacattaacttgaaacaatgtgacattggtgttgtgtactaccactagtgagccttgaactgggtaaccgcctatttccacatct

SEQ ID NO: 68622 - DNA, 2027 bp, Oryza sativa
caaacgcagattggcgcacaaattgctatgagtattgtaagatgtatttgatttttcgcttcaaaacttgtgcttacagactaacttttaaaattttacagatcctgatggccgcattaaaagatgtcgaggaccaactaaattggcaaatattgaaaatcttccagagggtgttaagattattgtcagagtggatcgtttcaatataccttgctcccaatctgctatagttcatggatcctagttaggaacacttgtcaggaagccacatctagctccactgaacattcttcaatggaatcataaactttataagagagcatatcatccaaaaatgatttctgaagtagaggtattgctctttaattttcacagctttttaaatcatattcttatggtgattccaatataattccattcactctttatttttcatatgcactagagaaagcttgcaattgatagaagagctaataattggattctccactagttagatggcaaatggaggcagtacaagtcaaaactgaaaaggggctattacaagcctaacttacctatggaacgagtattgcaaaccgtgcccaaaattgttgctaaatctcaatgggccaccctagtttcttactggtacttagaggactctaaggtaaatatatgttgggactttttagtgactgaatgaccatcattttgatttatatcagctcattgatgctatatgttgtatcattagaaaatcagtgacaaaacaacgagaatgcacagaatattaagcatccacacatattaggaagaaagagttttgcaataaagaggaaagagctggtaagattttaagcaattttcatatattaattcactattgcttcaatttcgcccgcccttccaatgcaactaaagatgtataatctgcaggaagttaatggagtggaggtggactgagcaaccttctttgatgaatgccataagacgaaagatggcagatatgttaacgatgctactgaagaagaaatggtatgccatattgcttttcttatataaactctttgtaaaacaaaatacactacattaagagtctacaatcttttccaacgtagaatgaagtatatatgaaattggctgagaaaagagtggattgccaagaactcagtgaagctgattttgaacaagctatgttagaagtgcttggaaaggatcataggggtagagttagaggcatgggtccaaccattactccaacaaactattatggtagaagatttttgaatatatcaggaagcaatgaagggaatggctccagtaatgtaaatggtttcattagttttatagtatcatatttgactgagaaatatccagaggataatttgatttctaggttgccaccatcagttgctagggtcattccaagacaagaggtatggccacaaaattactaattttaaatgttgtaacttatatagccataagcttccagaataacaaattcatgcatgtatcttcaggttgatcagaatgaaggaagtcagccaccaaatactgctacatcctctcttccatttgatcagaaccatgaaaatcagctaccaaatactactccatcctctagtgctagagcatcatctcagtcttgcagtgaagaagagtgatttacaatggcaattgtaccattccgtactacttgctgcattagaatataattattttttgtgttaatttgtttgaacctattgtttcattgttatatcagaaaagatgttgaagtattttcattgtgaacaatgtatagatattgcttttgattttaatgacaagctactggcgttaaaagtcttgttaatgtggtctgatggtaattcaatctgttggtattgttttgtttatgggttttctgaatgaaagatgtattgattgttggcatgtggccaatagcggggttataaataataagtgtagatacaggcacaaccgtgtctatagaagcagaaattgtctctaggaaagaaataagtaataaattcattatg

SEQ ID NO: 68623 - DNA, 20380 bp, Oryza sativa
gtgacactatagaatactcaagcttagctgtttatacataatataggcgggtaatagtaagacgaaaataaacaaagtacaaaggcatggaacaatatcgtactagaagcagccagtgcaggtggacaagtaagtggcaatattttgaagtcaaaattacagtaaaatagaagcccacacaacatggttgataagcagcctacctgattgtaggcctcatttggtttgcagtcaaccgccatgtccatacgggcaacaaaaaaatgttggtgaactggtgcatacaaactaggggcaatagtagtaccatatttcctttgctccccgggcatgagagctcctaggctaagaattccagtaagctttacttctgcttctatcttgccatcctgcaaccaacaaaaaaacatatcaggaactagagttcctttcgaaagtataattgtgtctgtagacattccactgaaaaggtgaactactcacctgataaaaatgccaatagaacccgtattcataattagcaatagtgcatacaaatgacacagtaagcctccttgaccgtctaacttcagctaatcctgttctccaatcttgatgtttccagaggatcccatggtcttcttcatggaagcaaacaacattctcaatggtctccacaccaccagtaaaatttgtaaaatgtgcatcaaaatattttataagacccaagcagtcacatccctacagtataacaaacaaaattaagttttttcaaaaacaaacaaaattaagtcaaatcagcatttaggtgcaaccatacgaaaaattctgggcatcagcttttaggtgcaacatgaagcattactaagcctaaagaacacaatttcaattacttttaaagaatatgaaatgagaaattcttggaagacaataaagaaaaataataagcaaatggaagaagttcaagtaaattactcttctgtattaattcaaacaaatcaggttgatttgaaattttatcgtaaggctgcgtttgttctagcatttggattgggattttcagcggcacgagaagcaagacaagccgcaaatgatcaaccgaatattaattattacaaacttaaaaattggatttatttattttttaaaagatacttttttatatacctttttttgaaaaaaagaatatcattaagcagttcgggaaatgtgctcacgtagaacaagaaagttgccggtccaatgcaccttagactcagcctagtatattaactgaggtactacttgacagattaattcttgtttttactatatgcttttaacatctatttttggaataacagttggctgccttaggatataagccactagtagttttccttaggatgtatgccactcctagtttttcttagaatgtaagccactcctagtttcttaggatgtaagccactagcctataccttatggtgtaagccactagcctatatatatgtatccaaccagccatagttgattgagtggagaatagaaattaaactagtcccaaaacctgtattccttttgctaacaattggtatcagagcaaggtttatctgagttccatcgattccccatccaaaatgtctctccactccattcgttccccctctctctcgtcccatgcctcaagcacttccagtggacgaggcagcaggcggtcggcggctgacgctgagggcgacggcgatgcgactgctgctgcgcgggtcgcgcaggaggcgcaagcggctgcgcgggaagcacgcgcggcgtgtgaggaagcggaggcgcggctgcaggcagccacaagggcggcgcgtctcgcggcggcagaagctgaagcagcgcgcaccgcggaggcagccaggcaggctgcagctgctgctgctgttttgcgagctgaggaggaggaggagtggcgtgacctggagcgggcagacgcggcccgcgtgcgacgcgacgcggaccgggatcgacacgcaggtcgacgcgaccgcgacttcagcccccatcgcggaggagcagatctccaccgcggtgaggaggagcggcgcgatccatggcgcgatcctcggatagaccgcgccctggaggcccagcgactccgggagcaggcagcggcgattgaggcacaactggacttcgaccgggagcagggtggacgggacgttggcgcacggagccctcgcaggcagcgcgcctccccttccccggacaggcgccgtggtcgccgtggaccctccggctctcctcccgttgtgcagaccgtcgtcaaggatgttggcggcgcatggcccatgctcaccaagactaactacgtcgagtgggcgatggtgatgaaggtgaaattgcaggcgcgccacatgtgggacgcggtctggtacggcgacgtcgactacggggaagattggcgggcgctggaggcgctccttgcggctgttccgacggagatgcagtcctccattgtgaacaagcggatcgccaaggacgcctgggatgccatcgcttcggcacgcatcggcagcgaccgcgcccgcaggtccacgcttcagaagctgcgtcaggattgggagaacctggccttcaagccgggtgaggacatcgacgacttcgttctccgcttcaactccttgcagcagcggttggcgcagctcgtcgacaccaccatcgacaaggagagagccgtggagaagctccttcgcgtcgtccccgagaagtacacgcagctggctctgtcgatcgagacgctgctggacttcaccgagctcacgatcgaagaggtgacgggtcgcctcaaggccgtcgacaaccgcaagcagctacctccctcagagccgatcaccattggtggcaagcttttcttcaccaaggagcagtggctcgcccgccagcaggagcagaagaagggggaggccacaggctcttcggcttcaggatcgtcgagtagccgcaagcgtcgaccacgcaagtgggagaaggcgcgtagtggcactcttggcggcgccgatggcgagcgcaagggcagccgcgacaacacctgccacaactgcgggaagaccggccactgggccaaggactgccggcaggcgacgcacggcggtcaagcacacgtcgctcaagcgctggagggtgacgaggtggctctgtttttcgtacacagaagcatcgagccgcacttcactcccgcacaggacgctaccacgcccctccaactcgacgagccgcgggcccacgtcttcctcagcaacggatcctgcggcgacaagatcgacggatggtgcctcgacaccggtgccactcaccacatgaccgggcggcgggaattcttctccgagcttgactccagcgttcaaggctccgtcaagtttagggacgcctccgccgtggagatcaagggcgtcggctccatcctcttcaccgccaagaccggcgagcaccggctgctcaccggtgtctactacatccccgcgctgaggaactccaccatcagtttgggacaactggatgagaacggctcgcgcgtggagatagaggacggggtcttgcgggtttgggatcgccatcgtcgccttcttgtcaaggtgaacaggggcgccaactgcctctatgttctccatgtacaggtggcgtagcccgtctgccttgcagacggccgcgacgatgatgcatggcggtggcacgagcgctttgggcacctcaacttcgaggccctgaagcagctcggcaacaaggagatggtgcagggcatgccgcgagtcgagcacgtggagcagttttgcaacacctgcatcctcaccaagcagcggcgactcccctttccccgccaagcaagtttccgcgccaaggagaagctggagctcgtgcacggcgacctctgcggccccgtgactccggccacacctggaggccggcgcttctttctgctgctcgttgacgacgtgtcctgctacatgtgggtggtcctgctcgactccaaggcagcggctgcagacaccatcaagcgccatcaagttgctgcggagaaggaatgcggccgcaagcttcgggtgctacgcaccgacaacggtggcgagttcacggcggctgagttcgcggcgtactgcgctgacgagggatccaacgccacttctccgtgccatacaccccgcagcagaacagcgttgtggagcgccgcaaccagacagtggtggccactgcccgcgccctcctcaagcaaagagggatgccagcaatctactggggggaggcggtgatgactgccgtccatctcctcaaccgctcgcccaccaaggcccttgacggcaagacgccgtacgaggcctggcatgggcgcaagccggtggtgagccacctccgcatctttggctgtctcgccttcgccaaggagctcaaccacatcgggaagctcgacgaccggagctcgccgggagtcttcatcggctatgcggagggcgtcaaggcctaccgcatcctcgaccctgcgacgcagcgcgtccgcatttctcgggacgtcgtgttcgacgaagggcgaggttgggcttgggacaaggcggtggacgacggctcgacttcgacgctcagagacttcgtcgtcgactacgtccactttgggggagccagaggagctagcagctcatcttcaccgagctcatccacctcggcacccggctcgccatcagctccggcgagtcctccaccacctacaccaccagcgactcctccatcaccggctacgccccgctctcctacaccggcgcccacaccaccggtggagttcgccactccgttgtccaacgacgaggatcgtgttgatgcgtaccacgacgacgagcctctgcgctaccgcaccgtggacagcatcttcagtgatcagcctgtccttggactggtgacgcgcgacttcgaggccgagctgcacctagcgcatgaggacggcgagccctgctccttcgcagaggcgaatggagatgtggcatggcgcactgcaatgcagcacgagatgaacgcggtcgagcggaaccggacgtgggtgctgcagatcttcctgccggccaccgcgccatcacccttaagtgggtctacaagctcaagaaggatgaggccggggcagtgatcaagcgcaaggcgcgtctggtggcgcgcggcttcgttcagcaggagggagtcgactttgacgacgccttcgcgcccgttgcgcgaatggagtctgttcgtctcctcctcgcgctggcggcccaggaaggatggcgtgtgcaccacatggatgtcaagaccgccttcctcaacggagacctgaaggaggaggtctacgtccactagccgccgggattcgtcatccccggcaaggagaacaaggttctccgcctgcgcaaggccctctacggcttgcggcaggcgccccgagcttggaacgccaagctggactccactctcaagcaactggggttccagcagagctctcacgaagctattgtctaccggcggggcaaggacaacaatgccctgttggtaggcgtctacgtcaacgacttggtgatcaccggcaccaaggaggctgaggtggaggcgttcaaggaggagatgaaggcgacttttcagatgagcgatttgggccttctctctttctacctggggatcgaggttcaccaggacagctctgacatctcccttcgccagactgcctacgccaagcgcatcgtcgagttgggcgggctcaccggctgcaacccagcctacactcccatggaggaaaggttgaagctgagccgcgacaacacggctgaggaggtcgatgccacgcagtaccggcgtattgtgggcagccttcgctacctcgtccacacgcggccagacttggcatttgctgttggctatgtcagccggttcatgcagcgaccgacgacagagcaccagcaggctgtcaagaggatcctccgttacgtcgagggcaccaccgactacggcttgcactacccgaggtgtcccggtgcgcagcacttcatcgggtacagcgacagcgacctcgccggtgacagcgacacgagcaagagcaccagtggcacgctgttcttcctcggcaagtgcctgatcagctagcagtcggtcaagcaacaagtggtggcagtcagtcaagcaacaagtggtggccctgtccagttgcgaggcggagtacatcactaccacaaccgcctcaactcaagctctctggttggctcggctgctgggtgatctcttgggcagagacgctgaagcagtggagctcagggtggatagcaagtccgctttggccatggcaaagaatcccgtcttccatgagcgcagcaagcacatccgcatcaagtatcatttcattcggagctgcttggaggaggggagcatcaaggccagctacattaacacccaggatcagctcgccgatcttctcaccaagtccctcgggcgggtcaagttccaggagtttcgcgccaggattggaatggttcaaattccccaaaaggcgccacacaagacttagggggagaatgacagattaagtcttgtttttactatatgcttttaacatctatttttggaataatagttggctgccttaggatataagccactagtagttttccttaggatgtaagccactcctagttttccttaggatgtaagccactcctaatttcttaggatgtaagccactagcctataccttatggtgtaagccactagcctatatatatgtatccaaccagccatagttgattgagtggagaatagaaattaaattagccccaaaacctgtgttccttttgctaacactactaacagggaacaacaaaaataacctttttaagagagtgtgcgttctttccaagcccatcttctccagcatcaaatgcattcttccgataatgtggttcatttggatctccataaggaacaaccatctcaacgaaactcagcctgtgagcgataggtcgacgcccacggtttccatcaacatatgcaacagaatgaataactaaaccttctttgggagtaaagccaatacggaagttccactgttcaatagaaataacaggtgagattttttgagtcagttttatctaatagtagctcaagtgctcaacaattgaaacaagaaacagaagataaccagttaaccttctgccattccacaaagtaaccgttaacacgaaaactggggccatcaggttgattgatgataagagtcttcaaatcacttctatcaacaccacctcgtgtttcccctggagtatagtttctcaaatgatctggtggaggaagagggacaaacttcctatcttcaaactctatcacggtattattctgcacatcaatgacgatatggatcccttccacaggtcgcgcataaccattctccatagggctatcactttcagttctacagaagatcagaggtttggcaattcttcgattgggagcatcagcatcactgtaatatcctgcacacctatattcaactagaacaggtcatgtttcaaggttctattgtttcgcaacaagaatcggaggaggacgagaagaaggatgtagggaaatccttttgtttagtcagcatgctagatcaattagtgagtgactggatcgatacaactaaaaaaactgtttacaagtttctttacaaatcaaagacatggagaaagacggtagaagtgcagttggctaaaggaagaattatttggtgagtgaatctttcttttcaatgagggaaggattctacgtcagtaagacaatgacagcaaaccccgaatgttttataaagcgtttattaactacagaaattaaccagaccaagcttaccatggatctaccatgacaagatccatgtcatcaactcctctttttttcattgcttcaatgaaaggggggtgacttttcacagtagcttcacattcagcatattccatggcatcctgtaatacacacaagcactacaagataaatctagtaattgacctaatataagtattcactaagtgcttaactatcaaagtaagcatcaaactaagtttctgtgattccgctgattgttttaggccctgtttctttcagcttgggattattataatctagattattgagttagattactataagctagattgttataatctgtagtagaataagcggttagttgtttctttcatagattattagagcctagattattgggtttgcaagtctaaagagggagtggggtggcatggtgggtaatttttcacccaataatctggaaaagctcacctaaatgagtttatcagattataataagctgggctccagattataataagctacttcaataagttgtctgtttctttcagcttactcccaataatctggattataataatcctaagctgaaagaaacagggccttagtggcaaataccacagcacaccagcaataatttagaaccacatgctcattagaaaataaatttggctacatataatctcattaagtgttaaatagtttgaataaaatggtcaaaatcaagaaaattgtgcccaataaatctatagaaagtggaaatatatcattgcaggctgaacatttggaacaacctctgatgatatgagcttgcctctctaatgtccacccctagtagcagcatgcacttcggagagctctacaatccaaatactagtctcatttgtcattttgttgtagacaacaagcctggccctcctagctggcagcctggttggaatgataggagtatttttggttctgggaagcagtgaaggttggaatggtgggaaaaagtatgcatcagctaatgccacgacagttttttctggttccagaagcacaacttcgacaaaacgcatgctgtctcgaacctataatttcgggagtgacttaattatatatttggaacatgagtacataattttgtatgaaaggtagtagatggacagagacctcaggagttcttccagaagctctgacagttgctacagccacagaaatttcagcagcagatagtgggtctaaggggtggcttttctgtgtcctcgtcatgatccggattcctgaaatgtttctcccgcataacgtcaagtcattgtgatatagcatagctatgtactgatgcttaaattgaacagaaaatattaaactatccaaatacacaaattgtggcaggcaaagggaatatcatagaaaacatttgactctttttttttcttttgcaatttaattacagagtaagggacacaaagtttgtatctgtaaaagatagctacacacttacgcagatatttctcaattatgcatgtgcccaccagataaattgcatatggaaccattaaaaggcccttttgattatattgatcaagcatttccattctaaatggcagaatggcatcgttctgttagctaacacaagataatatttcagaccttttatttggtgggggagcatcgattcactcgttcgacaaacacaacgctaagatcaaacacaaaattcctaacacaatgacactctggctcgtagaaactttccaaaaaaaaaaagcacacaaccaaaacaccttaggcaaacattttccctacgctccaatctgatctctcatcgtggtcactcacacctgaagcagttcataaacggaacgccaccgaccaggcgctaacattttccgcagacaagcccaatccagcaaaggggggcacccgaagagagagggagttcaaggagagtgagtacctttagacgaggcgatggcggtggcgggcggcggcaccacagtttcggcctcctcgatcacgccggcggcggcggcgatcgcggcgccgccgcagcacccctccgcggcgcccatcggagagggtccgaaccgcgcgcgcgcgaggcgaggcgagaggcgagcggagaggaggaggggtttggggggtttttgttttgtttggttggtatttcgctcagtctcttattttattactccttccgttttaaaatataattatttttagttttcgatatggttttcgaaatattaatttgatctataatatctataaaagtaaaatattttaaataaaaatagttatagttcgtttaatgataaagatagtaatatcaaatttacatgattaattttttttaagtttttgttgctaatagttaaatttaaaaagtttgacttggcgctatactaaaaatgcttatattttggaacggatggagtattagacaatggtggctgactgagtgttaaattaacgaaaaaaattggttgactggactattcgtcatgtaattaacatgatcacttcatgtgtggctactgttcactcctccggtacgatatccgcgtcatataggccgagtttagtttcaaactttttcttcaaactttcaattttttcatcacatcaaaactttcctacacacacaaactttcaacttttccatcacatcgtttcaatttcaatcaaacttttaattttgacgtgaactaaacacacccggggttaacatgtgaattgaattagggtctcatgttttctagaagaatgttctacaccttctattcatgtatgattgacctatttgagtctaacgcagtgaccaagaaaaacgcaactcaatacacgggacattggtgcataggggaatccacaagtagttgcatttgtacgggagacgtggctgcatatgattggaatgggtgaacattcgattcacaagacctactgcgtgcatgcatgactaaaacaaagcaacgacagcatccaaacccaagaatgtgtggcaaaagaaaaagatgatgatcaaaatagaaaactttttcagagctaatatgtctattaaacacaaatgaagagaatattagatagcaaaactttatcaaatagttactagattattaaacttttccattcctattaaagtctattcaaaatgaataaaaattctgctcataagcttttctacatgaataaaaaatatatttacaaactttctacaggagaaaaatctttatacacaaactttctacaatagttaaagatagtttacctagcaaatctattttataattaaaggaatagaaaaaggaaataactgaaattcggaattaaaaataaggaatattagaagaggagtatagagtccatatagaaatacaattaggaaataactgaaattcggaattaaaaataaggaatattagaagtagagtatagagtctatatagaaacacaattaagaaaaaaatataaattcagaactaaaaaataaggaatattagaagtagagtatagagtccatataggaatttaaaacttactaaaatttagaataaatataataaaattaaaagtagtgtttagagtccgtataaaaatacaatttacaaataactaaaattcaaaattaagaaaaacatgggaataagagtttaaggtcaatataggaatataaatataggaatacaatttagaagtaattgaaattcgaaattaaaaattaaagaatatagaaagatgagtttagagtccacatagaaatacaattagaaataataaaaattcagaaataaaaataaataatattggaagaagagcatagagtctatataaaaatacaatctatagaaaattcggaattttaaaaaaagaaatattaaaagacgagtctagagtccatataggaatatacataatttacaaataactaaaatttgatattaaaaataattaataactaacacgtatataaaatataatttgaaaattcagaaataaaaataaataatattggaagaagagtataaagtctatatagaaatacaatttacagaaaaatcggaagtaaaaaaaaagaaatattaaaagacgagtctagagtccatataggaatatatataatttataaataactaaaatttgatattaaaaagtaattaataactaacacgtatataaagtataatatgaatattacacattagtagttttttaaagttattgcaaaatttaaaattatgttgtcattttaatatatttgaacaatataatgagaaaacatatatgctattatatgagagaaaatataatgatgctagccgcgcaatctgcgcgggccaccatactagtttctatgaaagtaaacgacttttcaccatataaaatctaaattgtataactttatgttaataaactttcatcacgaataaaaactttatattcaaaaactttgtacaagaataaaatgatacttgaattttcaaaaatatcttaaaactaattcttgaattaaataataaaaaagtatatgtattcttgtcttaaggtgatccaaactagtaattgagccaactcagccaaacaagctacgacacataaacgtgtaggctctcaactcctgacaagatatgttgcacgtaaaatgttaggatagtcggaaaagcaaatacggttgtaacgaaaagagaaaggatgtcatatacgcgcggtaagcttgtgtgcgtttgttcgcataacaatcttctcagtcttagctagctagtttgaggtaaaattgacggtttccatgtaaatctacggtacaatgttgccctgcttttgtcatcatggttgctgtaacacgtaatgagtcacagaatttctaacctaatactcccttcgttccaaaatataagaacctagagtagtcttcattctgagtttcattctgagttgtattcattcgaagtagtcttctaccctactgtaaaagcataccccctcgcatagaccgcgacacagttgccaatccacatgtttaattactataattactaatataaaacctaaatgaaatgtataatacatatttgagtaaatttcataaaacctcacatattatggttcaagctacacaaaccacatggattttgatatgtgacatataaccccagatattatgatcctaaagttttacaaaaccatactattgatcattgatcattttgattttgatctactatacttttgagttctacaatcacatctcaaatttataaatattttatccatcatataaatattactttttttgaaattttcaaataggaatatatcaaaatagttaacgatgtagttttgtgaagctttagtacaaaatacctgggtttatatgccacatgtcaaaatccctgtgattttgtgtaacttggaccataataataggtggaatttatgaaatttactctacatattttgaactattttaagacaactctaaccatatcactttcaaatattcagttgaaatattcaaagagaacttaagtgtcaaagtttaataacgttaattacacacatttcgaaacaccactttctgaccagaggaaatagttatttagagaaggctttgttactttctaaggcaaattacatgacgtctagttaagtatacatgatgtacaaagattacacatacaacggccgtttaaacattggtgaaatcgcttgattggatgagccacacaaacaattcacaatgtccgggtactttgcttttccaaatcagccggccataggaaggatcaatgtctgcaaaggaaaggacaattgagtgatttgagtccgagtgtaggacttggaatggtcggctacacaaggcccaggtgatagagttgcgagcacaggctgatcccaagggcctcaggcccatgaaatgaccaccacagtccacatacagcgaatactgatctgttttcaaaacgctttcattggctatttgcgttaccttccaaaacaaggagtacctatgcatctttcgaaagatttctatgatcatatcatataaatttttaatctttggattaaaatccaatagacatagtaaaaggcaaaaagcaactaagaaacaccataatagatactaaattaccatatctttaagaaaaagaccaaatccaatataaatttcaaaacttacatgcgaagattcaaaaattacactgtaagtttcataaattacactataatttacaagaaaatacactgtaaatttgagtgagaaaatcgagtgagagataaagaaaaaatctttcaagtgagatatagcaaaatcgcagaacaattcgagtccaagattattattcattaaatggacttcactgagtcatttcttgtgaagggatttcactatgttattttgatcataaatctagagttaccacttttactccccataatttgattagactttcaaggaaatattgtacgtcaaaatttgatatctcaaaatcaaaccgataaataaacatggtttgcttaaaatataacaccacatttttcacgtaatttcaatcatttttttcctatgttattgcgctctctcccctatatatataagtatgcttctatctctcctgtttgcggccgtcgaacttgcaaatggctcagtggtgccctgcaatttggtcgagttacaaatctccatttggagctacaagtatactactactcagtatctttgtttttaagttatcgtacaaattcagaagcaacaccaaactgaaatcacaggaagattcttatacctaactacagattcgaaagtgaagtcggcaaaaggagaatcagccataagaaatcttgaaactgtgcacgctttaaagacacaatacttcatccacaacacacgacttgcagggaaaaaaaaaatgtcgacctgagccctggccaactcgatgagcagaaaatgtgtctagtgcggtgtctgctaaatgataaattgtggccaatctctagtgatcgtagaagacaagatcaagtattccatacctgataaattgtggccaatctctagtgatcgtagaagacaagatcaagtattccatacctgatacagggacaaagacgctgattattcttctcttcagcatccggcctggagcacacaagttgattttctgttctgtggtccttggccagcagcgctccaatcgctactgccaaacgggaaccaccggtccatctcaccaacaaaaagaaacacgaagcaaacgcataagcatgcttacaatcttattcttggaccacagctgcgttcacttgttaaacatttattagtcgaacaagaggaaatatgcataccctgatacccatgagaagccagaccagtgttgacttcctctgcaattaaatagatttctgagcatggaaaatcttgattactaacaccgactgtatatctgaagagtcaccgtttgtgtgtcataagaacagtacgtttttctgtcataagaacagtacatataacatgagaacttcacatgtaactgtattagtttcatttatctgcacagtagatggcatcagctttagaaccacagacgcaagtatcttcagaagccttccatattaaactgatgcaagatgttaatgtcatgctaaatattgcactggagaatcaaaacaacagaaacagacaacagttagatctttaaaaaagacgatggagggaagggtggccctgatggtaacgcagactgaaaacagtcaagtggtcagctgcaaccccaggttatggattaggctggaatcttgctcgtatccccttccaccactcattccaagccaccactcgttcatctcagcccgagctgggccaccacagaaagcaagccctttcctccatccacaaaacaatgctcacttcattccacaaacacctatggccaccgcttctcattcaccttcctcctctcctcccccttaatctcatctttttcttctcggtgcttctctgctcaaacctgtactttgcttctgccactccatgtctcaatcttcccctttcttctccgttgcccgagcacatgctggagcaggagggcgagctgcggctgccgctctcctgctccgtcaccctgttgctcagctgccacctcggattcatggcctgaggtactacccttcagccattgtgtcacctgccaagacactgaactcacacctgagccttccccatgccacaatatcctcctttgccaatgctgataatggctccagcgggcaagcagatgccacagagtctgaggaggagcagaacggggaatctgaactgtcggagatggccaaggcattccatatatcgccccggatggcaatgtcaatctcagtggtgattgcatttgcagcgctcactgtgccactggcgatgcagtcagtggtcttccatgggacgaacaaaatgaaggcactggcatatctgacactgctttcagggttctacatggcatggaacattggggcaaatgatgtggccaatgccatggggacgtcagtagggtctggtgctttgacactccggcaagcagtgcttactgcggcggtgctagagttctctggtgcattccttatgggcacccatgtcaccagcaccatgcagaagggcatcctagtcgcatctgtcttccaaggaaaggactctctgctcttcgctggattgttgtcatccctcgctgctgctggaacatggttgcaggtaatattccaattagatcaccttatcagttaccgcccttttgagctttgctggaatggtgacgatcagaggatgcaatcatgtagtgccattagcagtacataattactgagacttctgcaagtttcagtatatgaaacaaaatatttaagacattccatcagcgacacattcatgatgcaagaatagcatgatctacctagcaaggcaaaatcaatagacctttgcacttgaagatgctaggttaagccccagaaataaatgatagcagtaagttgtagcagctttattatattcagtgaaacctactgcatgagaaccttctatgagttgattgtactatattacacaatttcctttgaggtataaactccacaatacggtaaacaacttccatggtaggaagtgaaaactgaaaagggaaaggaacttaacagcatagctttaaacttgttgaagtcttttaacgtaaggattttaatccaattatatgcagtttcaggatgttgtgtaacatccatccgtgaatgttgtgcagctcacttgcaattaccagagtttgatgtctatcttatcaacaatcccaactagcagaagtacagaagcaacaaaatgagacaattaaagacaatgctcactagaaatatagcaacttttacaagggatagactaatggaatcttgaatcattagacaactaggcatgcacaattttgatgaagacatttttggtgggactctaattgcgggagaatgtttcatctgcttaatcattggaattaagatattttcatgattgcgggaaaatttaaatgcatacatcatgcctcaaagaaatatttaacataaaattaaatgcctctgccaaagatccaattgtgtgctcccttttacggttatctgagcatagcatattaacatttctcagagtcaatatgaattaacgcttgctatttctaggttgcttcctcctacggctggcctgtttcaactacacattgtattgtcggggccatggttggttttgggatagtatttggaggcgtaaatgcagtgttctggagctccttggcaagagtatcttcatcatgggtcatttcaccattgatgggtgctgcagtctcatttattgtttacaagggtatacgaagggtaagcactagactaactttacttgcagcatgctagacagcatttttaatttaagagttacttagttaggcagtcaccttattgaacacacatcataaatagaggacataggactgttcaagacaagacaataagttaattctctgcttaccctatttcatttcagttcgtatatagtgcaccaaatccaggtcaggctgcagctgctgctgcaccaattgcagtttttactggtgttactgcaatatcatttgccgcttttcctctcagcaagactttttcaatcgctatcctgcaagcattagcatgtggcgcaataggagccgtaatcgttaacagagtgatccaaaaacagcttggtgacctactgtcctcagaagcagaaaagatagcatctgctgataaggcaaatgctcagcaagttggatttctttcggacatagctggaccaacaggagctcaattgcagattgtatatggtgtatttggatacatgcaggtcttgtcagcatgcttcatgtcatttgctcatggaggcaatgatgtctccaatgccataggccccctggcggcagctttgtccattcttcaaggtgtagcaagcagtgctgagatagtcatacctactgaagtccttgcttggggaggttttggaattgttgcagggcttacaatgtggggttacagggtcatagcaacaattggcaagaaaatcaccgaactaacaccaactagaggttttgcagcagagtttgcagcagcttctgtagtattgtttgcatcaaaacttggattgccaatatctgctacacatacacttgttggtgcagtgatgggagtgggatttgcaagagggctcaatagggtcagagcagagacagtgcgtgaaattgtggcctcctggttagtcacaattccagttggtgctgtgttatctatcttctacacattgctcttcacaaagattctggcatactttatgtgagtgattgtgaaatgtaattagtgttttgagaggtgtacagcccattgcacttcataaaaatttccgcaatggcaaagagataggctgactccaaaaagtttcgaccataaaatttttcaggattggccagagtaaataatcatttctttggcaacaaaacacatgattaggtaaaaagcttttacagccagttacaatgttacatactccagcttgttcgtccgtttatctctaatgtactgccttgtatcttttgttttatatcacaaggtggaccataataatttcttgtagagatacaattatacataatagacaacaatggttcttctatccttgcagttatgttacatcaaggacatggttctttaatagccactgaaaattaataatgtttttgtggtatggtgcaagataatagcaagttcactgctagcaagaattcagaaaaatccttttgcattaagaaattaaactaacaaataaataaagcataatttctgaggtgattagtgccaaaaacactcgcacattgcgcaacttgtactaagattcagcaagaaacaaggaactttgtgctttgttgtttaagtagacatatttatcaccgtaaatagaggcatggatcttcagggaaaaaatacagagaaaaggtaatcaacactaaaagtaacaggtttatccatttatgcatgagcaggacagacctatgatcataataatttttccttttaacaggactctaatgtagtgtacagtaccttttttacaaatcatccatgaattcaagcattgattaaagcatcattatgcaacttctatagatacttgatcagctcggtcctcaggttttggatgatccgtaacacaaaaccaccggtttggggggtttgcgttccggatgccccaaaatacaaggttttgtgaaatttactctttgggaaaaaaagagtataaaaaggagagcacttacacaaggctacgggcacttgcacacagttaggaaactaatactagattcttaaattgagacacgcaaatgcaccaacaagctattccgatacatgttattcaagcaataagggaagcattaagatttttccaagaaaaaaactactaggtaaactgaacacatagagatagatcagattggggatagcaagctgtagcacgcacgcaataaatatgggagcagagaagaaagggcaatggcaccagggcaggcggtgcaaacccgaagggaggagtcggagtcgggggccggctcagccggtctcctggtcgaagtcgtctccgtcggactcctcgacgttgtcggcgtcgtcgtcctcggcctcggcgtcgtactcctccttgacgtcgccggttggcttgcctatgatcaccaggttactgttggtcttgcggatctcgttcagctggaagggggggggggagagagagagggcccagacaaaggcaggtgttagcagcgctgcgcgggggggggggggggcgtaccggggaggggggagaagggtggtgaggcgatcggtaccttgtcctcgaggtcggactcggccatggcgaggaggagctcgtcctcctgggtggtggcggggacggggagcagcgtggacgccgggatcagcggcggcgacggccactgccgcatcagcgccgggaactgcagcatctccgccgcgtgccgccgccgcaaccgccgccggggttggggattgg
